United States Patent 11,098,302 (IDENTIFICATION OF POLYNUCLEOTIDES ASSOCIATED WITH A SAMPLE) - sequence listing, part 45

SEQ ID NO: 152555 - DNA, 494 bp, Homo sapiens
  misc_feature: GYAE6OF01C8ZEN.51.67.G01.1.454.CMB.1.raw
  modified_base (311)..(311): a, c, t, g, unknown or other
  misc_feature (311)..(311): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcagtcgagacattagcatgtatctgaattggtatcagacaaaaacngggacacgacccctaaactcctgactcctcgatgcatccactttaggaacacgggtccatcaagttcagtggaagtggctcgtgggacagtattttacttcacctatcagtcaggctgcacgcctagaagcattcgacaactatactttaactgtacaacagtatagatacgtctcccgtacg

SEQ ID NO: 152556 - DNA, 591 bp, Homo sapiens
  misc_feature: GYAE6OF01BGCIY.51.67.G01.1.454.CMB.1.raw
  modified_base (267)..(267): a, c, t, g, unknown or other
  misc_feature (267)..(267): n is a, c, g, or t
  modified_base (312)..(312): a, c, t, g, unknown or other
  misc_feature (312)..(312): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgaattggtatcagacaaaaacnggaacacgaccctaaactcctagactcctcgaatgactactcctaacgttttagggaaaccgacggggttacccagtaccgaaggtttccgaaggtacgggaaaggttcgggaccttcggtacgggaactaaggttactttttacctttaccaacctactacgacgactacggcttgacacgcccgtagaagactagttcgaacctaactaacgttatttaaccgtacgtaacctaaacgtacgttaactaggtaacttcggtcccgttccccgtaccg

SEQ ID NO: 152557 - DNA, 531 bp, Homo sapiens
  misc_feature: GYAE6OF01D2H17.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccgaggacacgaccctaaactcctagactcctgatgcactccctaacgtttaggaaaccgtacggggtacccagtacgtaaggttacgaaggtggaagtggacgtcgtagggactagtacttttacttcactatcagacaggctgcagcctagaacgtactattcgacaactacttattactgtaacaacgtaagttatagtatacgtcctcccgtaccg

SEQ ID NO: 152558 - DNA, 519 bp, Homo sapiens
  misc_feature: GYAE6OF01D2SHO.51.67.G01.1.454.CMB.1.raw
  modified_base (487)..(487): a, c, t, g, unknown or other
  misc_feature (487)..(487): n is a, c, g, or t
  modified_base (501)..(501): a, c, t, g, unknown or other
  misc_feature (501)..(501): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggatcaagacaaaaacccagggacaacgcccctaaaactcctgactcctcgatgcactcctactttaggaactacggggtacccactacaaggttacaggtaggaaggtggcctcgtgggactagtattttacctttcacctatcacgcaggctgcagccgtagaacgactattcgacaacactattactntacaacaagtatanattacgtcctcccgtacg

SEQ ID NO: 152559 - DNA, 510 bp, Homo sapiens
  misc_feature: GYAE6OF01CFCL0.51.67.G01.1.454.CMB.1.raw
  modified_base (370)..(370): a, c, t, g, unknown or other
  misc_feature (370)..(370): n is a, c, g, or t
  modified_base (486)..(486): a, c, t, g, unknown or other
  misc_feature (486)..(486): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaatttggtatcagacaaaaaaccaggggacacgacccctaaactccctgactcctgatgcatccactttaggaaacngggtcccatcaaggttcagtggaagtggctcgtgggactaggtattttacctttcaaccatcagcaggctgcagcctagaagacattgaccaaactacttaattactgtaccaaanagtatagattacgtctcccggtac

SEQ ID NO: 152560 - DNA, 666 bp, Homo sapiens
  misc_feature: GYAE6OF01CE0LM.51.67.G01.1.454.CMB.1.raw
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcacatcacttggccggcgagtcgagacattagcatgtatctgaattggtatcagacaaaaacaggggaacacgacccctaaactcctgaactcctcgaatgacctataccctaacgttttacgggaaaaccgtacgggggtacccaacgttacgtaaagggtttccaaggtttacgggaaaggttcggggtccttacggtagggggtaacctaaggttaactttttttaacctttacctaaccctaacttaccgaagccgtaagggccgttacgaccgaacggtacccttaggaaacggtactaacgtttaggaaccctaaaccgtaatttaacgtttaaccgttcgggttaaaccctaaaaccgtaaagtttaacgacggttaaacttacggtttaccccgtcccccgggttacccg

SEQ ID NO: 152561 - DNA, 492 bp, Homo sapiens
  misc_feature: GYAE6OF01AQUUB.51.67.G01.1.454.CMB.1.raw
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccnggacagcccctaaactcctgatcctcgatgcatccactttagaacngggtcccatcaagttcagtggaagtggctcgtggacagtattttacttcacatcagcaggctgcagcctagaagtaccattcgacaactactattacgtgtacaagtagttatagaattcgtcctcccgtcg

SEQ ID NO: 152562 - DNA, 595 bp, Homo sapiens
  misc_feature: GYAE6OF01DQ44L.51.67.G01.1.454.CMB.1.raw
  modified_base (186)..(186): a, c, t, g, unknown or other
  misc_feature (186)..(186): n is a, c, g, or t
  modified_base (316)..(316): a, c, t, g, unknown or other
  misc_feature (316)..(316): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtnccagatgtgtcatccagatgacccattctccatccctccctgtctgcatctataggagacagaatcaccatcacgttgccggcgagtcgagacattagcatgtatctagaattgatacagtacaaaacgnggacacgacccctaaactccgtgactcctacgatcgactactccgtaacgtttaggaaaccgtcggggtacccctaagttaccgtaaggttcgaaggtacgggtaagtcggtacgtacgtacgggtaactagtttacttttaccttactaacgtactacagacacggtctggacctagtccgtagaacgtactagttacgaactaaacgttacttaatttaacgtcgtactaaacggttagtaacgttagaaccttacggtccccgtccccggttaccg

SEQ ID NO: 152563 - DNA, 680 bp, Homo sapiens
  misc_feature: GYAE6OF01A2RO9.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacctatctacgttcggccggcgtagtcgacgactagttacgctagtagtatcgtagtattggtatacagaacaaaacgaggacaccgtaccctaactcctgacctccgtacgactgactacgtaccctacgtttacggaaaccggtaccgggtaccctagttaacccggtaaggttaccggtaagggtacggtaacggttcgggtaccgttacgggtacgggtaacttaaggttttaaccgtttttacctaccgaaccctattacggacgtaccgacggttcgtaccgtagtaccgtacgtaggaaaccgtacttacgttaccgaaacctttaaactaacctttttaacgttaccgttacgttaaacaaaccgttaaggttaacttacggttaacgtttacccggtaccgttccccggtttaacccggg

SEQ ID NO: 152564 - DNA, 575 bp, Homo sapiens
  misc_feature: GYAE6OF01D4BE2.51.67.G01.1.454.CMB.1.raw
  modified_base (248)..(248): a, c, t, g, unknown or other
  misc_feature (248)..(248): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtcctccattccctccctgtctgctatctatagganacagaactcacatcacgttcggccgggcgagtcgaagactattagcagttgtatcgtagtaagttggtatacaacgaaccaaaaaccgaggaacctaccgtacccctaaactcctagtactaccgtcgactcgactactacctacgtttacggaacgtacgggtaccagtacgtaagttcgaggtaggagtcgcgtcgtaggacttagttacttttacctacacatcgacgtcacggtctgaccacgtactaggaactactagtacgaactaacttagtactttacgacggtaacaagttagtatagtacttcgttcctcccgtacg

SEQ ID NO: 152565 - DNA, 644 bp, Homo sapiens
  misc_feature: GYAE6OF01DY4KD.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtcctccactcctccctgtctgcatctataggagacagaactcaccactcacgttcggccggcgagtcgaagactattagctagtgtattcgtagtaagttggtaatacgaagaaccaaaaacgacgggaacaaccgtacccctaaactctacgactccgtgatcgactacgtaccttaacgtttacggaaaccgtacgggtaccctaagttacggtaacggttacgtaacggtagggtaaacggtcggtaccgttacgggtacgggtaacctaagttttaccgtttttaaccttacctaacctattacgaacggtacgtacggtccttacggacgtacgtaccgtaagtaacggaacttagtaccgtaactaacgtacttaattacgtacgtaacgtaactagtatacgtattaccgtccgtcccgtaccg

SEQ ID NO: 152566 - DNA, 649 bp, Homo sapiens
  misc_feature: GYAE6OF01B17J4.51.67.G01.1.454.CMB.1.raw
  modified_base (321)..(321): a, c, t, g, unknown or other
  misc_feature (321)..(321): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtggggctcctgctgctctggctctcaggtgccagatgtgtcatccagatcgacccagtcctccactcctcctgtctgcatcataggagacagaatcaccatcacgttggccgggcgagtcgagactattagcatgtatctagattggatcgaagaacaaaacgnggaacacgaccctaaactcctagactccgtagatcgactacttacccgtaagtttacggaaaccgtacggggtaccctaacgtacgtaacggttccgtaaggtacgggtaacggtcggtacgttacggtacgggtaaccgttacggtttaactttttacctttaccgtaacctaacgttacgaacgtacgtacggtacgttcggaccgtacgtaccgttaggaaacgtacgttacgtacggtaacctaaacgttaacgttaacgttaacgttacgtaaccgtaaataacgttattacgtaagtaaccgttccgttaccccggtaccgg

SEQ ID NO: 152567 - DNA, 535 bp, Homo sapiens
  misc_feature: GYAE6OF01B8B7R.51.67.G01.1.454.CMB.1.raw
  modified_base (407)..(407): a, c, t, g, unknown or other
  misc_feature (407)..(407): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagatcaccatcacttgccgggcgagtcgagacattagcagtgtatctgtaattggtatcagacaaaaacgaggacacgaccctaaactcctgactcctacgatcgctactcctacgttaggaaacgcgggtacccagtactaaggttcaggtggagtgctcgnggacagttactttacttacaccatcagccgaggctagcgacgtcgagaacgactattacgacctaagtacttagttacttcgtacctaaagtaagttatacgtaattacgttcccgtccccgtacccg

SEQ ID NO: 152568 - DNA, 702 bp, Homo sapiens
  misc_feature: GYAE6OF01CPWIB.51.67.G01.1.454.CMB.1.raw
  modified_base (341)..(341): a, c, t, g, unknown or other
  misc_feature (341)..(341): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcagttggccggcgagtcgagacatagcatgtatctagtaattggtatcaagaaccaaaaaaccgagggaacaacgaacccctaaacnccgtagactccgtacgaagtcgactacgtaccgtaacgttttaacgggaaaaccgtacggggttaaccctaacgttaccgtaaaggttaccgtaaggttacgggaaacggttcgggaccttacgggtaggggtaacctaaacgggtttactttttaaccgttttacccaacctaacgtaaccgtaaggtaacccgtaacgggtccgttacggaaccgtacggtacccgttaagggaaacggtaaccttacgttaaccggtaacctaaaaccgttactttaaacgttaacgttcgggttaaccaaaacgttacgttaaacgttacggttaaacgttacggttccccgttcccggttaacccg

SEQ ID NO: 152569 - DNA, 711 bp, Homo sapiens
  misc_feature: GYAE6OF01BLLHU.51.67.G01.1.454.CMB.1.raw
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggngagtcgagacattagcatgtatctgaattggtatcagacaaaaccgngggaacacgaccctaaactcctagactcctcgattcgactactcccgtaacgtttacgggaaaccgtaccggggtacccctaacgttaccgtaaggtttaccgaacgggttagggtaaacggttcggtaaccgttcgggttaacggggaacccgttaaagggtttaaccttttttttaacccgtttacccgtaaacccgtaacgtttacccgaacgggtaccgtaacggggtcccttacggtaccgtaacgtacccgttaggtaaaacgaccgttaagtttaaccggaacctaaaactaaccgttttaatttaaacccggttcgttaaaccgaaaccgttaagtttaaccgtaggttaaccgttaccggtttaacccctcccccgggtttaaacccg

SEQ ID NO: 152570 - DNA, 512 bp, Homo sapiens
  misc_feature: GYAE6OF01ACZDU.51.67.G01.1.454.CMB.1.raw
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
tcagcgatcgtatacacgaccggtgctcgatttagagtatacatattgggtttgggcacgaccggtgctcgatttagagtatacatattgggtttgggggcaggagtcgagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgngggacagcccctaaatcctgatccncgatgcatccagtttggaaacngggtccatcagttcagtggagtgtctgtggacagtactttacttcacatcagcagctgcagcctagaacgtacagttacgactaacgtacttaattacctgttaccaaacgtacgtaacgttagaattacgttccgtcccggtacccg

SEQ ID NO: 152571 - DNA, 589 bp, Homo sapiens
  misc_feature: GYAE6OF01B0BJ4.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagatcaccatcacttcggccgggcgagtcgagacattagcatgtatctagaattgtatcagacaaaaaccgaggacacgacccctaaactcctagactcctacgatcgctactaccctaacgtttacgggaaaccgtacgggtacccaagtacgaacggttcagggtagggaacgtggccgttacggtagggtaactagtttaactttttaccttccaacctactacgacgacgtaggtcctcgacctacgaccgtagaacgtactagttcgaacctaaacgtattaattaccgtagtaacctaaacgtagttaatagtaacttcgtacccgttccccgtaccg

SEQ ID NO: 152572 - DNA, 538 bp, Homo sapiens
  misc_feature: GYAE6OF01B6TL9.51.67.G01.1.454.CMB.1.raw
  modified_base (436)..(436): a, c, t, g, unknown or other
  misc_feature (436)..(436): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtcctccatcctccctgtctgcatctataggagacagaatcaccatcacttgccgggcgagtcgagacattagcatgtatctgaattggtatcagacaaaaaccgagggacacgacccctaaactcctagactcctcgatcgcatccactttacggaacgacgggtcccagtacgaaggttcaggtaggaagtggctcgtggactagtactttacttacacctancagcaggctgacacgacctagaacgactattcgacctaaacgtattaattaccgtagtacctaaacgaagttaactagtaattacggtccctccccgtaccg

SEQ ID NO: 152573 - DNA, 561 bp, Homo sapiens
  misc_feature: GYAE6OF01BD41Q.51.67.G01.1.454.CMB.1.raw
  modified_base (316)..(316): a, c, t, g, unknown or other
  misc_feature (316)..(316): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttgccgggcgagtcgagacattagcatgtatctgaattggtatcagacaaaaaccngggaacacgacccctaaactcctagactcctcgatcgctactccctacgttttacgggaaaccgtacggggtccccaagttccgaaaggttcgtaaggtagggaaggttcgggcttaccgtaggggtaactaggttactttttacctttcactatcagcgaggctgcacgtcctagaacgactagttcgacaaactattaacttactcgtacaaactagtactagtatacgttcctcccggtacc

SEQ ID NO: 152574 - DNA, 596 bp, Homo sapiens
  misc_feature: GYAE6OF01AFCH8.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagaccaaaaaccgagggaacacgacccctaaactcctgaactcctcgactcgctactcccacgttttacgggaaacgtacggggtacccaagttaccgtaagggttcctagggttagggaaggttcgggtaccgttcggtagggactaggttaactttttaccttcaactacgtcaacgtcaggtcctaggccagtcccgtagaacgtactacttacgactaaacgtatttaactttaccgtggttaccaaacgtagttaactaggtaacttacgttcccgttcccgtacccg

SEQ ID NO: 152575 - DNA, 697 bp, Homo sapiens
  misc_feature: GYAE6OF01AOPO0.51.67.G01.1.454.CMB.1.raw
  modified_base (188)..(188): a, c, t, g, unknown or other
  misc_feature (188)..(188): n is a, c, g, or t
tcagcgatcgtatacacgaccggtgctcgatttagagtatacatattgggtttgggcacgaccggtgctcgatttagagtatacatattggggtttgggggcaggagtcagtcccaaccaggacacagcatggacatgagggtccctgctcagctccgtggggctcctgctgctctggctctcaggtnccagatgtgtcatccagatcgacccagtcctccactccctccctgtctgctatctagtaggacgacagaactccaacctatccacgttggccgggagacgtacggaagtacctagttagacctagttacgttaactcgttaggtaagtttcggtaactacgaaacgaaaacccaaaaaccggcgggtaaaccaccggtaacccccttaaacgtcccgtacgtaaccttccgtacgtacgttacgaccttaacgtacccttaacgggtttaacggaaaccgggtccgggtaccctaagttaccggtaacggttcggtaaggtacgggtaacggtcggtacgtacggtacgggtaacgtacgtttactttcctaccactaagtcgagcgtacggtactcgacgtacgtaccgtaagactacgtacttacgaaccttacgttaacgttacgttaccgtagttaaccaagttaacgtactaacgtaaccttacccgtaccctcccgttaaccg

SEQ ID NO: 152576 - DNA, 552 bp, Homo sapiens
  misc_feature: GYAE6OF01DRYY9.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcaagacaaaaaccgagggacaacgacccctaaactcctagactcctcgatgctactcctacgtttagggaaacgtacggggtacccagtacgaaggttcaggtggaaggtcggctcgtagggactagtatttttaccttccaaccattacgagtcaggcgtgcgagccgtagaacgactattcgaccaactacttaacttacgttcggtactaaacgtagttactagtaattacgtccgtcccgttacccg

SEQ ID NO: 152577 - DNA, 680 bp, Homo sapiens
  misc_feature: GYAE6OF01BDFQK.51.67.G01.1.454.CMB.1.raw
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtctccatccctcctgtctgcatctataggagacagaatcaccatcacttgccggtcgagtcgagaccattagctatgtatctagtaattggtancagacaaaaaccgnggacacgacccctaaactccgtagacgtcctacgatcgacctactaccctaacgtttacgggaaaccgtcggggtacccaacgttaccgtaagggttacgtaaggttacggtaaacggttcggtaccttacggtacggggtaacctaggtttaactttttaaccgtttacctaacctacttaccgtaacgttaccgtaacgggttaccttacggtaccgtacgggtacccgtacggaaaacggtccgtaaggttaccgaacccgtaaacgttaactttaacgtttaccgtacggttaaccctaaacgttacggttaacttaacggttaatttaccgttcccgtaccccggttaacccgg

SEQ ID NO: 152578 - DNA, 624 bp, Homo sapiens
  misc_feature: GYAE6OF01DE26P.51.67.G01.1.454.CMB.1.raw
  modified_base (242)..(242): a, c, t, g, unknown or other
  misc_feature (242)..(242): n is a, c, g, or t
  modified_base (349)..(349): a, c, t, g, unknown or other
  misc_feature (349)..(349): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggnacagaatcaccatcacttggccgggcgagtcgagacattagctatgtatctagtaattggtatcaagacaaaaaccgaggacacgacccctaaactcctgacttccncgtaatcgactacgttacctacgtttacgggaaaccgtacggggtaccccattaaccgtaaggttacagggttaggaagtcggctcggtagggaacctagttactttttaccttacacctacttacgaacggtaccgtaggccttaggaccgtacggtaccgtaggaaacgtaaccgtattacggacctaaacgttacttaatttaaccgtacggttaacctaaacgttaacggtaacttacggtaatttacccggttcctcccccggtaaccgg

SEQ ID NO: 152579 - DNA, 651 bp, Homo sapiens
  misc_feature: GYAE6OF01CILZR.51.67.G01.1.454.CMB.1.raw
  modified_base (232)..(232): a, c, t, g, unknown or other
  misc_feature (232)..(232): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctcctgtctgcntctataggagacagaatcacctatctacgttggccgggcgagtcgagactattagcatgtatcgtagtaatttggtatcgaacgaacgaaaaaccgacggggaccaacgaccccctaaactcccgtagtacctcctacgactcgacctactacccgtacgtttacgggaaaccgtaccggggtaccctaagttaccgtaaggttccgtaagggtgggaacggttcggtaccgttacgggttacggggtaaccttaaaggtttaaccgttttttaacctttaccgtaaccctaacgttaccgacggtacgtacggtctacggacaccggtacgtacgaagtactagttacgacctaaactattacgtacgttagtaccgaaagtagttaagtcgaagtttacgtcccgtacccgtaccgg

SEQ ID NO: 152580 - DNA, 555 bp, Homo sapiens
  misc_feature: GYAE6OF01DFJR5.51.67.G01.1.454.CMB.1.raw
  modified_base (238)..(238): a, c, t, g, unknown or other
  misc_feature (238)..(238): n is a, c, g, or t
  modified_base (323)..(323): a, c, t, g, unknown or other
  misc_feature (323)..(323): n is a, c, g, or t
  modified_base (356)..(356): a, c, t, g, unknown or other
  misc_feature (356)..(356): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatcgaccagtcctccatccctcctgtctgcatctanagagacagaatcacatcacgttgccggcagtcgagacagttagcatcgtatctaggtaaattggtatacgaagaaccaaaaacgnggaacacgtacccctaaactctagactccgtanatgacagtccctaacgtttaggaaaccgtacgggtaccagtacgtaaggttcgagtaggaacgtgtactcgtaggactagttactttacttcgactacncagacgngctacgactagtccgtagaacgtanagttacgactaacgtaattnttaactgtaaccgaacgtaagtagttacgactcgtccgtcccgtaccg

SEQ ID NO: 152581 - DNA, 679 bp, Homo sapiens
  misc_feature: GYAE6OF01ATVYL.51.67.G01.1.454.CMB.1.raw
  modified_base (245)..(245): a, c, t, g, unknown or other
  misc_feature (245)..(245): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtcctccatcctccctgtctgcatctatagganacagaactcacctatccacgttcggcccggggtcgaggtccgaagactagttagcctaagtcgtatcgtagtaattggtactcaagtaaccaaaaaccgtggaaccaaccgtaccccttaaaactccgtagaaccttcctagactcgactactccgtaacgttacgggaaacccgtcgggtacccagtaccgtaacggttacgtaaggtacggaacggttcggtaccgttccgggtaacgggtaactacggtttaactttttaccttaacccgacgtaacgtccgtaacggtaccgtaacgggtccgtacggaccctacggtaccgttaggaacgtacgttacttacgaacctaacgttaacttacgttacctacggtaaacctaacgttaagtaccgtaaggtaccttcggttaccccgtcccgttaaccggg

SEQ ID NO: 152582 - DNA, 630 bp, Homo sapiens
  misc_feature: GYAE6OF01C30PO.51.67.G01.1.454.CMB.1.raw
  modified_base (273)..(273): a, c, t, g, unknown or other
  misc_feature (273)..(273): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtcctccactccctcctgtcctgcatctaataggagacagaatcaccatcacttggccggngagtcgagacattagccagtgtatcgtgtaatttggtatacgaacggaacctaaaaaaccgagggaaccaacggtaccccctaaaactccctagactccgtcgatcgactactccctacgtttacggaactacggggtaccctagtacgtaaggttaccgtaggtaggtaaggtacggcttcgtagggtacctagtactttttaccgtttaccacctaagtccaagcgtaacgggcctacgcctacggtcctaggaacgtaacgttacgttacgaacctaaacgttaagttaactttaccgttagtaacctaaacgtagttaacgttagtactttacgttcccgtacccgttacccg

SEQ ID NO: 152583 - DNA, 724 bp, Homo sapiens
  misc_feature: GYAE6OF01EIYX0.51.67.G01.1.454.CMB.1.raw
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaactcacatcacttcgccggngagtcgagactattagcatgtatcgtagtaattggtatacaacgaccaaaaaccgnggaccaacgacccctaaactcctagacttcctcgatcgcctaagtaccctaacgtttacgggaaaccgtacggggtaccctaagttaccgtaacgggtttactaacgggtaggtaaacggtcgggtacccgttacggttacggggtaaaccgttaaggtttaacccttttttaacccgtttacccgtaaacccgttaagtttacccgtaacggtacccgtaacggggtaccgtaacggtaccgtaacggtacccgttaacggtaaaccggtaacgttaacgtttaccggaaacccttaaacgttacgtttaaacccgtttacgttaaccggttaacctaaacggtaacgttaacggttacggttaacgtttaccgtttaccccgtccccggtttaacccg

SEQ ID NO: 152584 - DNA, 600 bp, Homo sapiens
  misc_feature: GYAE6OF01B7PA2.51.67.G01.1.454.CMB.1.raw
  modified_base (356)..(356): a, c, t, g, unknown or other
  misc_feature (356)..(356): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtcctccactcctccctgtctgcatctataggagactagaactcgaccatcacgttgccgggcgagtcgagacattacgctatgtactcgtatagtgtatacgaacaaacaacgacggacaccgtacctaactcgatactctactntcactactctagtacgaacggtccgactacgtacgtacgtagtacggtagtacggtcgtacgtcggtacggtaattaacgtttacttttactacctactactacgaccgtacggtacgtctacgacgtacgtaccgtaagtaacgtacgttactacgtaacctaacgttacgttacttacggtacgtaaacgttaacgtagttaacggtagttaaaccgttccgttcccgtcccgtttaccggg

SEQ ID NO: 152585 - DNA, 587 bp, Homo sapiens
  misc_feature: GYAE6OF01B9A7O.51.67.G01.1.454.CMB.1.raw
  modified_base (576)..(576): a, c, t, g, unknown or other
  misc_feature (576)..(576): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctccgtggggctcctgctgctctggctctcaggtcgccagatgtgtcatccagatcgaccagtctccactcctcctgtctgctatctagaggagacagatcaccatcacgttggccggcgagtcgagactattagactatgtatcgtagtagttcggtatacaacgaaccaaaaacgcgggaaccacgtacccctaaaacgtcctaagtactcctacgatcgacctacgttacctaacgtttacgggaaaaccgtcgggtaccctaagtacgtaagttcgaggtaggaagtcggtactcgagggtaactagttaatttaccttacacacgtacgcgacacgggtcttaggctacgaccgtagaaacgtctagttacactaaactatacgttacttcgacgtaatcgtaagtacgtaatccgttcncccgttaacgg

SEQ ID NO: 152586 - DNA, 626 bp, Homo sapiens
  misc_feature: GYAE6OF01C62K6.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtcccctgctcagctcctggggctcctgctgctctggctctcaggtgccagatgtgtcatccagatcgacccagtcctccactcctccctgtctgcatcataggagacagaatcaaccatcacttcgccgggtcgagtcgagactattagctatgtatctagtaattggtatacaagaacaaaacgaggaccacgaccccttaaatcctagactcctgatcgaccacgtacctacggttaacggaaccgtaacggggtaccccagttacgtaacggttacgaggttacgggaaggttcggtaccgttcggtagggtaacctacgtttactttttaccgttccaacttcacgtagaccgtagggtctacgaccgacgtcgtaggaactacgtattacgaactaacgttaattacgttaacgtactaaaccgaaacgttaagttaacgtaacgtacgtttaaccgtccccgtacccggtttaacccgg

SEQ ID NO: 152587 - DNA, 615 bp, Homo sapiens
  misc_feature: GYAE6OF01BLW4N.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccactcctccctgtctgcatctataggagacagatcaccatcacttggccgggcgagtcgagactattagctatgtatcgtagtaacttggtaactcgaagaaccgaaaaaaccgaggggaacctaaccgaacccccttaaaactcccgtagtaccttcctacggactcgtactacttacccgtaacgtttacgggaaaccgtacggggtaccccaagttaccgtaaggtttccgtaagggtacgggtaaggtcggtcgttacggtacgggtaactagtttaccttttacctttccgaacctatcgacgcgtacggtcgtagaccacgtccgtagaaacgtctattcgactaactattatacgtgacctaagtatagtagtatacgtcccgtccgtaccg

SEQ ID NO: 152588 - DNA, 885 bp, Homo sapiens
  misc_feature: GYAE6OF01A3NK5.51.67.G01.1.454.CMB.1.raw
  modified_base (756)..(756): a, c, t, g, unknown or other
  misc_feature (756)..(756): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcagtggacagtggacgggttccctgcctcgacggtcctccggtggggtcctccgtgctgtctcgtcggtctcgtcgaggtcgacgtagtattcggtcgtactacgtacgacgtaccgtaccgtaccgtccttccctaccttcccgttccgttcgtacgtccgtacgtacgtacgtaacggtaacggaccgtaacgtaccgttaaccgtacccgtaccgtacggtaccggtaccgggtaccgggtaccgggtacggtaacgggtaacgtaacggttacgtagttacgtacgttaagtttacggttacgttacggttaacggttaacggtaaccggtaacccgtaaacccggaaaccggtaaacccggtaaccgaaccccggttaaccgtaacccgttaccgtacgttacgtaccgtaccgtacgtaccgttacgtaaccgttaccgttaccggtaaccggtaccggtacggtacggtacgtaacggtacgttaacgggtctacggggttacggttactaccgggtacgttccgttaaacgttcgtttaaccttaccgttacacggtactaccggacgtaccgtacgtcccttagacccgtacggttaaccgtaaattaccgacgttaaccncggttaaactacgttaacgttaaaccggttccctaaggacctttacgggaacgtttccccgaacggtttacccggtaccggtcccggttaaacggggccgttttaaccggggggtaccggggtaaccgg

SEQ ID NO: 152589 - DNA, 606 bp, Homo sapiens
  misc_feature: GYAE6OF01A6YFS.51.67.G01.1.454.CMB.1.raw
  modified_base (251)..(251): a, c, t, g, unknown or other
  misc_feature (251)..(251): n is a, c, g, or t
  modified_base (351)..(351): a, c, t, g, unknown or other
  misc_feature (351)..(351): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcactccagatcgacccagtctccatccctccctgtctgcctatcgtaagtagganacaagaactccaccactccacgttcggccgggacgagtcgacgactattagctagttagtactcgtagtaagttggtactacgaagaaccgaaaaaccgngggaacctacgtaaccccgtaaactcgtacacgtccacgtatcgactactaccgtacgttacggaaacgtacgggtacccaagtacgtaagttacgagtacggaagtcggcgtcggtacggtaacgtagttacgttttacctacgtacctacgtacgacgacgtacggcctagtccgagtcccgtaagaacgtactagtacgactaacgtacttagtactacgtacaaacgtatagtactatacctctccgtacg

SEQ ID NO: 152590 - DNA, 491 bp, Homo sapiens
  misc_feature: GYAE6OF01CSDFG.51.67.G01.1.454.CMB.1.raw
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctgggactcctgctgctctggctctcaggtgccagatgtgtcatccagatgacccagtctccatcctccctgtctgcatctataggagacagaatcaccatcacttgccgggcgagtcgagacattagcatgtatctgaattggatcagcaaaaacngggacagccctaaancctgactccncgatgcatcactttgaacngggtccatcaagtcagtgaagtgctcngggacagtattttacttcaccatcagcaggctgacctagcctaggaacgactattgacaacgtaatattaactgtacaaacgtagtaattacgataagtctccccggtc

SEQ ID NO: 152591 - DNA, 651 bp, Homo sapiens
  misc_feature: GYAE6OF01DBR5I.51.67.G01.1.454.CMB.1.raw
  modified_base (268)..(268): a, c, t, g, unknown or other
  misc_feature (268)..(268): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatcgacccagtcctccatccctccctgtctgctatctataggagacagatcacatcacttgccggngagtcgagacagttagctatgtactcgtagtaagttggtactacgaacgaaccaaaaaaccggacgggaaaccaaccgtaacccccttaaacgtcccgttacgtaacttcccgtacgacttacgactaaccttccgttaaccgtttaacgggaaaccgtacgggtaccctaagtaccgtaaggtttacgaggttacgggtaagtcggtcgtacggtgggaactagtttacttttacctacacgtatcacgtacgacgtcgtagacctacgtaccgtaagaacgtaactacgtacgaactaaacgttacttaacttaacgtacgttaaccgaaacgttaagttaacgtaaggtaaccttccggttaccctcccggttaacccgg

SEQ ID NO: 152592 - DNA, 783 bp, Homo sapiens
  misc_feature: GYAE6OF01B6QLG.51.67.G01.1.454.CMB.1.raw
  modified_base (244)..(244): a, c, t, g, unknown or other
  misc_feature (244)..(244): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgctagatgtgtcatccagatgacccagtcctccatcctccctgtctgcatctatagganacagaatcaccatccacgttcggccgggcgagtcgagacagttagctatgtatcgtagtaattggtactacgaagtaacaaaaaccgagggaccacgtacccctaaactcctagactcctacgtagtcgactacttacccgtacgttttaacgggaaaccggtaccggggttaccctaacgttaccgtaaagggtttaccgtaagggttaacgggtaacgggttcgggtaccgttacgggtacggggttaaaccgttaacggttttaaccttttttaacccgttttaacccgtaacccttaacgttaacccgtaaccgggtaccggtaaaccggggtcccgttaccggtaccgtaaaccgggtacccgttaaaccggaaacgggttaaccgttaaggtttaaccgaaaccgttaaaaccgttaacgttttaaaccgtttaaacccgttacggttaaacccgttaaaacgttaaacggtttaacgttaaacggttaaaccgtttacccggttacccccgtttcccccggttaaccccggg

SEQ ID NO: 152593 - DNA, 698 bp, Homo sapiens
  misc_feature: GYAE6OF01CYIQ7.51.67.G01.1.454.CMB.1.raw
  modified_base (236)..(236): a, c, t, g, unknown or other
  misc_feature (236)..(236): n is a, c, g, or t
  modified_base (673)..(673): a, c, t, g, unknown or other
  misc_feature (673)..(673): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctccgtggggctcctgctgctcgtggctctcgaggtcgaccagatgtgtcatccagatcgacccagtcctcactccctcctgtcngctatctaagtaggagacaagactaccgaacctatccgtacgtcgggaccggtacgacgtacgaacgtactaattacgctagtcgttatacgtagttaagttgtaactacgaaacgaaaccgaaaaccgacggaacctaccgtaacccctaaacgtccgtacgtacctaccgtagacgtacgtaccgtacgttacccgtaacggttaacgggaaacccgtcgggtaaccctaaggttaacccgtaaggtttacccggaagggttacgggaacggttccgggtaccgttacgtaacggggttaacttaacgttttacgttttaaccctcgaaccggtctacggacgtacgtacggccgtaggaccgacgttccgaggtaaccttacgtacgtaacggaacctaacgttacgtaacttaccgatacgaaactgttaacntaccggtcttcccgaccgttaccgg

SEQ ID NO: 152594 - DNA, 736 bp, Homo sapiens
  misc_feature: GYAE6OF01AGMUX.51.67.G01.1.454.CMB.1.raw
  modified_base (188)..(188): a, c, t, g, unknown or other
  misc_feature (188)..(188): n is a, c, g, or t
  modified_base (602)..(602): a, c, t, g, unknown or other
  misc_feature (602)..(602): n is a, c, g, or t
tcagcgatcgtatacacgaccggtgctcgatttagagtatacatattgggtttgggcacgaccggtgctcgatttagagtatacatattggggtttgggggcaggagtcagtcccaaccaggacacagcatggacatgagggtcctgctcagctcctggggctcctgctgctctggctctcgaggtcnccagtatgtcgtcatccagactcgaccctagtcctccactccctcctgtctcgctattctaagtaggacgactaacgaactaccacctacttaccgaccggttccgggacccggggtacggtaaccggtaccggaacggtaacctaagttaccgaccgttagttaggttacttccgttaaggttaagtttagggtaactaccggaaacgtaaaacccgaaaaacggacgggtaaccctaacccggtaaccccgtaaacttaccgtactacgttaccgtacgtactacgacctacgttacccgtaacggtttacggaaaccggttaccgggtacctagtaccggttaacgttcgaagggttacgggacgttcggccgtttacggacggtaacgtttactttacgttttaccctanaccgtacgtacgacggctacggctacggaccgtaacgtcgtaacgagtctaagttaccagttaaccttaattccgtaatcgttaaccaaggtacgttataacggtaactttcccggacctttcccgtaacccgg

SEQ ID NO: 152595 - DNA, 667 bp, Homo sapiens
  misc_feature: GYAE6OF01BLF9T.51.67.G01.1.454.CMB.1.raw
  modified_base (246)..(246): a, c, t, g, unknown or other
  misc_feature (246)..(246): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtctccacttcctcctgtctgcatctagtagganaacagaactcaccatcacgttcggccgggcgagtcgagactattagctagttgtatcgttagaagttggtaactcgaacgaaccaaaaaccgagggaaccaccgtaaccccttaaactccgtagactaccgtcgaatcgacctacgttacccgtacgtttaacgggaaaccgtcggggttaccctacgttaacggtaacggttacgaaggtaggtaacggttcgggacgttcggtagggtaacgtacgtttaacttttaccgttactaaccctagtacgaacggtaccgtacggtccgtagaccgacggtaccgtaggaacgtaacgtagttacgaacctaagtaacttaacgttaccgttaacgtacgtaaacgtaaggttacgttacgtaactttaccggttcccgtcccggttaaccg

SEQ ID NO: 152596 - DNA, 595 bp, Homo sapiens
  misc_feature: GYAE6OF01CWGKT.51.67.G01.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
tcagcgatcgtatacacgaccggtgctcgatttagagtatacatattgggtttgggcacgaccggtgctcgatttagagtatacatattggggtttgggggcaggagtcagtcccaaccaggacacagcatggacatgagggtccctgctcagctcctggggctcctgctgctctggctctcgaggtgccagatgtgtacatccaagatcgaccctagtcctccactccctcctgtcngcatcatagganacagatcacatcagtcgccggnagtcgagactattgctagtntatgtagagttggactacgagaaccaaaacggcggacacgtaccctaatcctagactccgntancgtacctacgtacctaacgtttaggaacgtacgggttccacgtactaagggtcaggtggaagtgccgttagtacggactaacgttacttttacgttaccacttaagtcgtaaggaccgtaggccgttagaccgtcggaaccgtagaaacgttactgttacgaacgtaacgtagtttactttacggaattcccgtaaacgtagtacttacgtactttacggcccctttacccgtaccggg

SEQ ID NO: 152597 - DNA, 718 bp, Homo sapiens
  misc_feature: GYAE6OF01CFGJR.51.67.G01.1.454.CMB.1.raw
  modified_base (372)..(372): a, c, t, g, unknown or other
  misc_feature (372)..(372): n is a, c, g, or t
tcagcgatcgtatacacgaccggtgctcgatttagagtatacatattgggtttgggcacgaccggtgctcgatttagagtatacatattgggtttggggcaggagtcagtcccaaccgaggacacagcagtggacagtggagggtccctgctcagctcgtgggctctgctgctctggctcgtcgaggtcgaccagtatggtgtacactccaagtactacgaccctagtcctaccacttccctcctgtactgactattacgtaagacggaacgacgaagtactaccaactactaccgtaccggttcgggacccggtacggacgtacggaacgtactagttaacgctagtttgtacttcgtaagttagtagtanacgaagaaaaccgaaaacggacggtaaccaaccgtaaccctaacgtcctacgtaactcccgtagacttacaccgttaacctaaccgttaacggtttaaccgggaaaccggtcccgggtaccttaaagtacggtaacgggttacagggtaaggtacgtcggttcacggtaggtaacttgttttaactttaccacgacttagcgacgacggtcgtcctacggcgtaccgtacgtaagaacctagtagttaaccgaattaaacgtttaaccttaattacgtaacccgtaaagtaacgttagttaaacgttacgtaacccttacccgttccccggttacccggttaccgg

SEQ ID NO: 152598 - DNA, 634 bp, Homo sapiens
  misc_feature: GYAE6OF01C4L5Z.51.67.G01.1.454.CMB.1.raw
  modified_base (234)..(234): a, c, t, g, unknown or other
  misc_feature (234)..(234): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtcctccatccctcctgtctgcntctatacggagacagaatccacatcacgtggccggcgagtcgagaccattagctagtgtatctagtaagtttaggtaataccgaagaaccaaaaacgacgggacaaccgtaccccctaaaactcctagtactccctacgatcgctaacgttcctaacggtttacggaaaccggtacggggtacccccagttaccgtaaggttccgtaaggtcgggtaaagttcggcgttacgtacggggaacttacgttacttttttaaccgttaccaaccgtacgtacgactaccgaggtcctacggacgaccgtacgtagaacgtaacgtacgtagaacccgtaaatacgttaacgttactgtaaccaaacgtgtatacgtaagttaccgttcccgccccgttaaccg

SEQ ID NO: 152599 - DNA, 728 bp, Homo sapiens
  misc_feature: GYAE6OF01ESD89.51.67.G01.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
tcagcgatcgtatacacgaccggtgctcgatttagagtatacatattgggtttgggcacgaccggtgctcgatttagagtatacatattgggttgggggcaggagtcagtcccaaccaggacacagcatggacatgagggtccctgctcagctcctggggcctcctgctgctctggctctcgaggtnccagatgtgtcatccagatcgacccngtctccactccctccctgtctgctacgtactagtaggagtaacagtaactaccgaccattcgtacgttcggccggcgaggtacgagtactattacggactagttcgtatcgtagtagttagtactacgaacgaaaccgaaaaaccggcgggtaacccaacccgtaaccccgttaaaccttaccgttacgtaaccccttccgtacgtaagtaccgtacccgtaacctttaaccgtaacgggtttaaaccgggaaaccgggttaccgggtaaccctagtaaccggttaacggttacggaggtaagggtacggttggtacccgttaggggtaaccggtaagttacgttttaaccttttcccgttaaccacccgtaatcgtaaccgggtactacgggtactaacgggtaccacggtacccgtaagtaaccgtacgtaacgttcgaacccttaagtactttaagtaccgtctaaacgtactaagtacgttacgttaacgttccgtccgtacccgtaccgg

SEQ ID NO: 152600 - DNA, 683 bp, Homo sapiens
  misc_feature: GYAE6OF01B3W8P.51.67.G01.1.454.CMB.1.raw
  modified_base (173)..(173): a, c, t, g, unknown or other
  misc_feature (173)..(173): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctntggctctcaggtgccagatgtgtcactccagatcgaccccagtcctccactcccttccctgtctgcactctataggagacaagaatccaccatcacgttggccgggcgagtcgagacagttagctagtgtatctagtaagtttggtaatacaagaaccaaaaaccgacggggtaaccaaccgaccccttaaactccctaggtacctaccgtacgtagttacggaccctacttacccgtaacgttttacgggaaaccgggtaccgggtaccctaagttaccgtaaacggtttcggtaaaggttacgggaaggttcgggtaccgtacggttacgggtaactaaggttttaccttttaccgtttacaaccttacgtacgacgacgtacggcgttacgaccgtacgtaccgtagaacgtacgtaacgttagaaccctaagttaacttaacgttacgttacgtacctaaacgttagtaacgttacgtaacttccgttccccgtcccgttaacccg

SEQ ID NO: 152601 - DNA, 652 bp, Homo sapiens
  misc_feature: GYAE6OF01DGFAB.51.67.G01.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
tcagcgatcgtatacacgaccggtgctcgatttagagtatacatattgggtttgggcacgaccggtgctcgatttagagtatacatagttggggtttgggggcaggagtcacgtccccaaccaggacacagcatggacatgacgggtccctgctcagctccgnggggctcctgctgctgtcggctncgaggtcncagtntgtcgtacactccgagtactaccgaaccctgtccctccaccttcccctcgtgtctagctatacgagtaagganacacgactcaacnctcncggtcggccggnagacanatatgctagtntatgtagtaattgaactaacaacgaaaccgaacgtccggaacaaccctacctacactcgtactcgactagtacacttactaccgtagttaaccggaaccggtccgtactagtaccgtagtaggtaacggtagggtagtccggtattacgggattattaccgtttacttacctacctacttaccgcgttacggacgtacgccgtacgtaccgtaacgtacggtaacgactaacgtcgtaaccgtaactaacgtttaacgtaccgttacgtaacgtaattaaaccgtagttaacggtaccgttaaaccgtccgttacccgtcccggttaacccggg

SEQ ID NO: 152602 - DNA, 666 bp, Homo sapiens
  misc_feature: GYAE6OF01BM5UQ.51.67.G01.1.454.CMB.1.raw
  modified_base (313)..(313): a, c, t, g, unknown or other
  misc_feature (313)..(313): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgattggtatcagacaaaaccngggacacgacccctaaactcctgactcctcgatcgctatccctacgtttagggaaaccgtacggggtaccccaagttaccgtaacgggtttccaagggtagggtaacggtcggtaccgttacggttaggggtaccttaacggtttaacttttttaacccgtttacctaacccgtaacttaccgaacggtaccgaagggtccttacgggtacgaccggtaccgttacggaaacggtaccgtaagtttacggaacctaaacccgttatttaacgtttaaccgttacgttaccgtaaaaccgttaaggtaacgttacgttaaacgtttacggttccccgttccccggttaccccgg

SEQ ID NO: 152603 - DNA, 612 bp, Homo sapiens
  misc_feature: GYAE6OF01A6VRV.51.67.G01.1.454.CMB.1.raw
  modified_base (245)..(245): a, c, t, g, unknown or other
  misc_feature (245)..(245): n is a, c, g, or t
tcagcgatcgtatacacgaccggtgctcgatttagagtatacatattggggtttggggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtctccatcctcctgtctgcatctatagganacagaatcacatcacgtcgccggacgagtcgagactattacgctagtgtactcgtagtaagttgtactcgaagaaccaaaaacgaggggaacaacgtacccctaaagtcctagactcctacgtactcgactactacccgtaacgtttacggaaaccggtacgggttacccacgttacgtaacggttctaaggtaggaagtcggtactcggtaggtactagttaacttttactctaactactacgagtacgtacggtcgtacgactacggtacctaggaacgtacgtagttacgactaactaagtttacgtaacgtcggtaacaaacgtagtaacgttacgtaacgttacgttcccttcccggtaccg

SEQ ID NO: 152604 - DNA, 708 bp, Homo sapiens
  misc_feature: GYAE6OF01CFM3U.51.67.G01.1.454.CMB.1.raw
  modified_base (189)..(189): a, c, t, g, unknown or other
  misc_feature (189)..(189): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtggggcctcctgctgctctggctctcgaggtnccagatgtgtcactccagatcgaccctatcctccatccctccgtgtactcgctaactcgttaagaacggaacgacaacgtaactaccaacctacgtcaccgttcggcccgggagacggtacgatacgtatacgacgtatgtactgtaggtattaggtataccgaagaaaccaaacgtacggaccaccgtaacccgttaacnctagaccttaccgntacgtacacctacgttacccgtaacgttacgggaaaccggtaccggtaccgtaagttaccgtaacggttaacggtaggtaacgggtacggtcggaccgttacgggtacggtaaccttaacggtttactttttacctaaccgtaacctacgttacgaaccgacggtcgtaccgtacgtaccgaccggtacgtaacgaacctaagttaccgtaaggaacctaagttaaccttagttaacgtaccgtaacctaagttaacgtacggtttaacgtaccgtttaccgtccccgtaaccgttaccccggg

SEQ ID NO: 152605 - DNA, 652 bp, Homo sapiens
  misc_feature: GYAE6OF01BED3B.51.67.G01.1.454.CMB.1.raw
  modified_base (271)..(271): a, c, t, g, unknown or other
  misc_feature (271)..(271): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtctccatccctcctgtctgcatctataggagacagaatcaccatcacgttcgccgggngagtcgagactagttagcatgtactctagtaatttggtaatcgaacgaacaaaaaccgagggaaccaacgtaaccccttaaactccctagtacctccgtacgtaactcgacctactacccgtacgtttaacgggaaaccgtacggggtaccctaacgttaccgtaagggttacgtaaggtacggtaaggtcggtacgttcggtacggggtaacttacgtttactttttaccgtttacgtacctacgtacgtacgacgtaggtaccgttggaccgtaacgtaccgtaggaacgtactacgttacgacctaaacgtacgttaacttacgtacgtacctaaagtacgttaacgttacgtacttacgtcccgttccccgttaccg

SEQ ID NO: 152606 - DNA, 775 bp, Homo sapiens
  misc_feature: GYAE6OF01CDKMK.51.67.G01.1.454.CMB.1.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (322)..(322): a, c, t, g, unknown or other
  misc_feature (322)..(322): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtgggctcctgctgctctggctctcgaggtgccagattgtgtcatccagatcgacccagtcctccatcccctcctgtcctgaccntactaagtagganacgaagtaactcctaccactcgtaccgttggacccgggctagtcgaagtacctagttacgactaagtntactacgttagtaagtttcggactacgaacggaaaccaaaaaccggcggggtaaccctaaccccgtaaacccgttaaccctcgttacgtaacctccgtacgtacgtcgacctacgttaacccgttaacggtttaacgggaaccggttaccgggtaccctaaggtaccgttaagggtcgtaagggtacggtaacgtcggtaccgttagggtacgggtaactttaacgttttacctttttaaccgtaccctaactaacgttccgaaggtaccgtaaggtcccgttagacccggtattaacccggttacgaacggttaacttaccggttaaaccgaaacttaaaccgtttagtttacccgttaaacggttaccgtaaacggtaaaaccttttaaggtaacgttttaaccggaacggttttaaacccccggtccccgtttcccggttaaaccccggg

SEQ ID NO: 152607 - DNA, 722 bp, Homo sapiens
  misc_feature: GYAE6OF01BA6JJ.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcgaggtgccagatgtgtcatccagatcgaccctagtcctccactccctcctgtctgctatactagtaggagaacaagtaactccaacctactcacgttcggccgggtacgaggtcgagactattagactaagttgtattcgtagtaattggtaactacgaacgaaaccgaaaacgacggtaaccaaccgtaaccccttaaactccgtagtaccctacctacgtatccgaactacctaaccgtaacggtttaacgggaaccggtaccgggttacctaaggttaaccggtaacggttacgaagggttacgggtaacggtccgtacgttacgggtacggtaacgtttaacgtttaccgttttaccttacgtaacctagttacgaacgttacggacgggtccttacggaacgtacggtccgtaaacggtaacacgttacgtacgaaaccttaaagtttaaccttaacggttaacttacgaaaccgtaaacgttagttaaacggtaggttaaaccctttccggttaccccgttcccggttaacccgg

SEQ ID NO: 152608 - DNA, 657 bp, Homo sapiens
  misc_feature: GYAE6OF01AFOTJ.51.67.G01.1.454.CMB.1.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtcgccagatgtgtcatccagatcgacccagtcctccactccctcctgtcngctatctagtagganacgaagaactccacctctctacgttcggccgggcgtacgcgaagactagttacgactagtgttactcgtagtaacgtttggtactacaacgaaaccgaaaaccggacggaaccaaccgtaaccccctaaacgtccgtagtaccgttccgtacgtagtcgacctaccgtacccgttaacgtttacgggaaaccggttccggtaccctaagttccgtaaggttcgtaagggtaggacggtcgtacgtcggtacggacttaacgtttacttttaccgttacccgactatacgacggtcgtaggcctagccacggtacctaggaacgtctacgtcgaacttaacgaactttcgttaacctacgtaaacgaacgttgtaacgttactaaccttccgtttccccgccggttacg

SEQ ID NO: 152609 - DNA, 778 bp, Homo sapiens
  misc_feature: GYAE6OF01E3YVO.51.67.G01.1.454.CMB.1.raw
  modified_base (756)..(756): a, c, t, g, unknown or other
  misc_feature (756)..(756): n is a, c, g, or t
tcagcgatcgtatacacgaccggtgctcgatttagagtatacatattgggtttgggcacgaccggtgctcgatttagagtatacatattgggtttgggggcaggagtcacgtccccaaccaggacacagcatggacatgagggtccctgctcagctccgtgggctcctgctgctcgtggtcctcgtcgaggtcaccgagtatggtcgtcactccgagtactaccgaccctagtccctccgtaccttccccgtccgttaggtcctcgaccttacttaccggtaaggtaacggaagtaaaccgaaggtaaacctccctaacccgtacttacccgtacgttccggggaccggggtaccgtaaggtaccgaacgtacgtacgttacgactagttacgtacgttcttaagttaagtacgtactacgtaaaccgaaaaccgaaaccggtcggaaaccgaccccgtaaccctacgtccgtacgtacgttcccgaagtccgtatcccgtaacgttacccgtaacggttaaacgggaaccggttaccggaaccttaacggtacgtaacgttaccggaaggttgtaacggttcgtacggtcggtaagtacggtttactttacgtttacccataaccgtagtcggacgttacgtacgtacggtacctacggtaccgtaacgaggttaaccccgtggtaacttaaccgaaacttacgttaattattacccgtagttaccgtaagttacgtaacgttagtacccggttnttcccccgttcgtaaccccggg

SEQ ID NO: 152610 - DNA, 776 bp, Homo sapiens
  misc_feature: GYAE6OF01CST4N.51.67.G01.1.454.CMB.1.raw
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (738)..(738): a, c, t, g, unknown or other
  misc_feature (738)..(738): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatggagggtccctgctcagctccgtggggctctgctgctctgctctcaggtnccagatgtgtcatccagntacgacccagtcctaccactccctcccgtcgtctcgctattactaagtaagggacaacagtaaactccaacctacttacctacggttccgggaccggggcgaacggttacggaacggtaactagttacggtacctagttaggttacttcgtagtaagttcggtaactacgaacgtaaaccgaaaaaccggcggtaacaaccgtaacccctaaactacccgtagtaacctcctacggtattccgactacgttacccgttaacgtttaacgggaaccgttaaccggggtacctaacgttaacggttagttacgtaagggttacggggaacttgggtccttacgggtaggtaaccgttaaagtttaccgtttttaaccttaccgtaaccgtactacggtaactacgggtacgtaccggtacgagttaaccgaccgttaagggtaaccttaaccgtacggttaaacacccgttaaaacgttaattaaccggtttaacgttaacggttaaaccctaaaagttaacgtaacggttttaanacggttttaaaccccgtcgttccccggtttaaacccgg

SEQ ID NO: 152611 - DNA, 782 bp, Homo sapiens
  misc_feature: GYAE6OF01CECI5.51.67.G01.1.454.CMB.1.raw
  modified_base (284)..(284): a, c, t, g, unknown or other
  misc_feature (284)..(284): n is a, c, g, or t
  modified_base (631)..(631): a, c, t, g, unknown or other
  misc_feature (631)..(631): n is a, c, g, or t
  modified_base (642)..(642): a, c, t, g, unknown or other
  misc_feature (642)..(642): n is a, c, g, or t
tcagcgatcgtatacacgaccggtgctcgatttagagtatacatattgggtttgggcacgaccggtgctcgatttagagtatacatattgggtttgggggcaggagtcagtcccaacaggacacagcatggacatgagggtccctgctcagctccgtggggctctgctgctcgtcggctcgtcgaggtcgcagtacgtgtgtcaatccgagtactacggacccagttcccacctacttcccctccgttgtacctcgactactcgtagtaaggacgaacaagacncctaaccagtcctacgttcgggccgggacgtacggtaccgaacggtactaagttacgaccgtaagtttcggttaactcgttaaggttacgtttacggtataaccgaaaacggaaaaccgtaaaaacccgggacggaaacccgtaacccggttaaaccccttaaacgttcccgtaaggtaccctttacccgaagggttactcccggaccgtaaacgttaaccccggttaaggtttaaaccgggaaacggttcccgggtaaccctaagttacgttaacggttagtaaccggtaggaacgttcggtacgttacgagggttaactatttaacgtttacccgtcaaccgttntaacgtacggngttcgggaccgttcgaccgttacgtaccggtaagtaacggtaaccttcgtagaaaccttagtttaacccgtaaagttccgaaacgttacgaaacttacggtagttaactacggttccctaacccggtccccggttaacgg

SEQ ID NO: 152612 - DNA, 675 bp, Homo sapiens
  misc_feature: GYAE6OF01A38I5.51.67.G01.1.454.CMB.1.raw
  modified_base (249)..(249): a, c, t, g, unknown or other
  misc_feature (249)..(249): n is a, c, g, or t
  modified_base (282)..(282): a, c, t, g, unknown or other
  misc_feature (282)..(282): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctccgtggggctcctgctgctcgtggctctcaggtcgccagatgtgtcatccagactcgacccagtctccatccctcctgtctgctatctagtagganactagaactcaacctatcctcgttaggccgggngtacggtcgaacgactattacggctagttagtactcgtagtaacgttgactacgaacgaaacctaaaacgcggaacctaccgtaaccccgtaactcctaggtacctcgtagtactcgaccgtacttacctaaccggttagaaaccggtcggttaccacgtacgtagttaccgaggtacgaggttcgacgtgtacggtaacttagtttaactttacctcaacccgtagtacaggtacctagggttcccacggtactaccggtaacgtacgtaaacggttacgtacgttaaccgaaattaacccggttaatttacggtaaccttacggtaaccgtaaacgtacggtttaacgacgtttaaccgggttaaccgtccccgtcccccggtttaccggg

SEQ ID NO: 152613 - DNA, 589 bp, Homo sapiens
  misc_feature: GYAE6OF01B9V6N.51.67.G01.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
tcagcgatcgtatacacgaccggtgctcgatttagagtatacatattgggtttgggcacgaccggtgctcgatttagagtatacatattgggttggggcaggagtcagtcccaaccaggacacagcatggacatggagggtccctgctcagctccgtggggctcctgctgctctggctctcaggtcacagtntgtcgtactatccgaagacncggtaccccagtcctcctacgttccctcctgtctgctactnaatacggactaacagaactccaactactnaccgtggccgggctacgcgagtcaattgctacgtgtatcctagtattgtancaacgaacaaacgcggacaccgtaaccctaacgtcctgtactaccncgtanctacgaccttacgtaacgttaggaccggtacggacctagtacgtaaggtcggaagtcggtagtcgacgtcgaggtacgtacgtttacgtttactacacctagtacgcgtacgccgtntcgtacacgtaccagaacgtntacgtacgactaactcgttatacgtactacgtaagtacgtaagtctagtaccgcccttcgtacccgg

SEQ ID NO: 152614 - DNA, 622 bp, Homo sapiens
  misc_feature: GYAE6OF01BIKSQ.51.67.G01.1.454.CMB.1.raw
  modified_base (350)..(350): a, c, t, g, unknown or other
  misc_feature (350)..(350): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtggggctcctgctgctctgctctcaggtcgccagatggtgtcataccgagactcgaccctagtcctccacttccctcccgtgtctgactatcgtagtaggagacgagtaactcacctatcctacgttggcccggtagacgtacgagtacgtattagctagtgtatctagtaattgatcaacgaacgaaaacgnggaacaccgtaccctaactctgtactctagtctacgctactaccgtaagttacgaacgtccggtactagtagtacggttcgtaggtaggacgtcggacgtggtacggtatacgttttacgtttaccctagtacctactacacggtcacggtcctggtacctacgggtacctaggaaactagtacgttacgaacctaacgttagttaaccttacgttacggaaacctacgtattaacgtacgtaaacgttcggttaccccgtccgttacccgg

SEQ ID NO: 152615 - DNA, 710 bp, Homo sapiens
  misc_feature: GYAE6OF01C6E7Z.51.67.G01.1.454.CMB.1.raw
  modified_base (190)..(190): a, c, t, g, unknown or other
  misc_feature (190)..(190): n is a, c, g, or t
  modified_base (279)..(279): a, c, t, g, unknown or other
  misc_feature (279)..(279): n is a, c, g, or t
  modified_base (531)..(531): a, c, t, g, unknown or other
  misc_feature (531)..(531): n is a, c, g, or t
  modified_base (575)..(575): a, c, t, g, unknown or other
  misc_feature (575)..(575): n is a, c, g, or t
  modified_base (696)..(696): a, c, t, g, unknown or other
  misc_feature (696)..(696): n is a, c, g, or t
tcagcgatcgtatacacgaccggtgctcgatttagagtatacatattgggtttgggcacgaccggtgctcgatttagagtatacatattgggtctgggggcaggagtcagtcccaaccaggacacagcatggacatggacgggtccctgctcagctccgtggggcctcctgctgtctcgtggctctacgnggtcgcagatgtagtccagtccagtacgccggtaacctcgtcctcctacctccctccgttgtcctggtactacgtactagtaacggaanacaacgtaacacctactacgttaccacggttccggacgggtcgtaacgtaccggtaatacgttagtacgactagttactacttacgtaggttaagttgtacgtaacgaacgaaacgaaacggaccgttaaccgacctaaccctaacgtctacgtacctacgtacagtcacgttaaccgtacctaacgggtttaaccgaccggtacggtacctaacgtcggtaacggtttagaaacgggtggggttaaccgtnacccggtttaggaggtttaacctttagttttacctttacccganaccgacggttaaccggtttcaacggtctaacgtacgaccggtcctaaagtagacgttcgtaactaaaccgtcggtattaacctcgttacgaaacgttgtaactggtaacccttacgtcccnccgggttaaacccg

SEQ ID NO: 152616 - DNA, 647 bp, Homo sapiens
  misc_feature: GYAE6OF01EMO5W.51.67.G01.1.454.CMB.1.raw
  modified_base (287)..(287): a, c, t, g, unknown or other
  misc_feature (287)..(287): n is a, c, g, or t
tcagcgatcgtatacacgaccggtgctcgatttagagtatacatattgggtttgggcacgaccggtgctcgatttagagtatacatattggggtttgggggcaggagtcagtcccaaccaggacacagcatggacatgagggtccctgctcagctcctggggctcctgctgctctggctctcaggtgccagatgtgtcatccagatcgacccagtcctccactccctccctgtctgctatctagtaggagacaagtaactaccacctatccgacgttcggcccgggngacgtcggaagactagttagctagttgtactctagtaattggtactacgaacgaaaccaaaaaccggacggaacctaaccgtaacccccttaaactcccgtagtacctcccgtacggtactcgacctacgtaccgtacgtttaacgggaaccgtacgggtacctagtacgtagtacgaggtacggagtcggacgtcggtacggacttaagtttacttttacctacaactacgtacgacggcgtacggtctacgtacctagaccgtaggaacgtactacgttaccgacttaacgttattaacttacgtagtaacccgtaagtagttactacggtaacttccgttccccgtccgttacccgg

SEQ ID NO: 152617 - DNA, 844 bp, Homo sapiens
  misc_feature: GYAE6OF01E4G6Q.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtggggctcctgctcgctcgtcggctcgtacgaggtcgaccgagtatcggtcgtactactaccgtaagtacgtaccgacccgtaagtccctacctaacccttccccgtcccgttgttccgtcggtactacttacggtaaacggtaggaacgtaacaacgtaactacctaccacttaccgtaccggttcgggcccgggtacggtaacgtacgggaacggaacttaacttacggtacctaaggtttccgggtaattaccggttaggtttaacgttaacgggtaacgtacccgaaaaacgtaaacccgggtaaaaacccggtacggtaaacccgtaaccccggtaaccccttaaaccgtacccggtagtacccgtccgtaaggtacgtcctaactaacccgttacggttaacgggttaaccggaaccgggttaccggtacctacggttaaccgttaacgggtacggtaacgggtaaggtacggtacgggtacgtaccgggtaacggttacgttaccgttttaaactttacctaccgtaacgtacgtacaccgggtagtaccgtacgtaccgtacgtacgggtaactaaacgtaccggtactaacgttacggaacttaacgtacgttacgttacgtaaagttacaaacgggttattaacgtacggttacctcgttccgacccgtttaccggg

SEQ ID NO: 152618 - DNA, 519 bp, Homo sapiens
  misc_feature: GYAE6OF02HVIKZ.51.67.G01.1.454.CMB.1.raw
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
tcagcgatcgtatacacgaccggtgctcgatttagagtatacatattgggtttggggcacggaccggtaggctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagacccctaaatcctgatcctcgatgcatccatttgaacngggtcccatcaagtcagtggagtgatctgggacagtatttttacttcacctatcagtacagggctgcagcctagaacgtactagttcgactaactnttaactttacgtcgtacaaacgtagttatacggtaacttacgttccctacccggttacc

SEQ ID NO: 152619 - DNA, 502 bp, Homo sapiens
  misc_feature: GYAE6OF02IC1QM.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaccagggacagaccctaaactcctagactcctacgatgcactccctactttacggaaactacggggtcccaatcgaaggttcagtggaagtcggctcgtgggacagttacttttacttcaccatcagcagctgcagcctagaagtcacttgacacattacttactgtacaacagtatgatacgtctcccgtc

SEQ ID NO: 152620 - DNA, 585 bp, Homo sapiens
  misc_feature: GYAE6OF02IZ7OF.51.67.G01.1.454.CMB.1.raw
  modified_base (310)..(310): a, c, t, g, unknown or other
  misc_feature (310)..(310): n is a, c, g, or t
  modified_base (334)..(334): a, c, t, g, unknown or other
  misc_feature (334)..(334): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaacnggacacgacctaactctagactcncatcgactactaccttacgttaacgaacggtaccgggtacctatacgtaagttacgtaggtaggtaaggtgtcctcggtacggtaacgtagtttaacgttttacttacccgacctactacgagtaccgtacgtcgtacgacgaccgtccgtaacggaaacgtacttacgttacgaactaacgtaatttaacttacgtacgtaacctaacgtaacgttagtacgtaagttaccgttaccgtcccgttacccg

SEQ ID NO: 152621 - DNA, 480 bp, Homo sapiens
  misc_feature: GYAE6OF02FTPSP.51.67.G01.1.454.CMB.1.raw
  modified_base (313)..(313): a, c, t, g, unknown or other
  misc_feature (313)..(313): n is a, c, g, or t
  modified_base (359)..(359): a, c, t, g, unknown or other
  misc_feature (359)..(359): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagcatgtatctgaattggtatcagcaaaaaccngggacagccctaaatcctgatcctcgatgcatccactttggaaacngggtccatcaaggttcagtgagtgctcgtggacagtattttacttcaccatcagcaggctgcagcctagaagacattgacaactatacttactgtacaacagtatagatacgtcctccgtc

SEQ ID NO: 152622 - DNA, 486 bp, Homo sapiens
  misc_feature: GYAE6OF02IKXHV.51.67.G01.1.454.CMB.1.raw
  modified_base (314)..(314): a, c, t, g, unknown or other
  misc_feature (314)..(314): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgaccccagtctccatcctccctgtctgcatctataggagacagaatcaccatcacttgccgggcgagtcgagacattagcatgtatctgaattggatcagcaaaaaccngggacagccctaaactcctgatcctcgatgcatccactttggaacagggtcccatcaaggttcagtggaagtggctcgtgggacagtattttactttcaccatcagcagctgcagcctagaagctattgacaacattattactgtacaacagttatgatacgtcctcccgtc

SEQ ID NO: 152623 - DNA, 477 bp, Homo sapiens
  misc_feature: GYAE6OF02GPRNP.51.67.G01.1.454.CMB.1.raw
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaccagggacagcccctaaatcctgatcctcgatgcatccactttggaacagggtcccatcaaggttcagtggaagtggctctgggacagtattttacttcaccatcagcaggctgcagcctgaagacattgacaacatattactgtacaacagtatgatagtctccgtc

SEQ ID NO: 152624 - DNA, 478 bp, Homo sapiens
  misc_feature: GYAE6OF02I1R9B.51.67.G01.1.454.CMB.1.raw
  modified_base (445)..(445): a, c, t, g, unknown or other
  misc_feature (445)..(445): n is a, c, g, or t
  modified_base (459)..(459): a, c, t, g, unknown or other
  misc_feature (459)..(459): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaacagggtcccatcaaggttcagtgaagtggctctgggacagattttacttcaccatcagcaggctgcagcctgaagacattgcaacgnttattactgtcaanagtatgatagtcctccgtc

SEQ ID NO: 152625 - DNA, 516 bp, Homo sapiens
  misc_feature: GYAE6OF02H0JVW.51.67.G01.1.454.CMB.1.raw
  modified_base (314)..(314): a, c, t, g, unknown or other
  misc_feature (314)..(314): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccngggacacgacccctaaactcctagactcctacgatgcatccacgtttacggaaactacggggtcccatacgaaggttcaggtaggaagtggctcgtagggactagtacttttacttcacctatcagcaggtctgcagcctagaagactattgactaacgaattacttactgtacaacgtagtactagatacgtcctcccgtc

SEQ ID NO: 152626 - DNA, 497 bp, Homo sapiens
  misc_feature: GYAE6OF02GVSB5.51.67.G01.1.454.CMB.1.raw
  modified_base (448)..(448): a, c, t, g, unknown or other
  misc_feature (448)..(448): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaacaaaaaccagggacagacccctaaactcctgatcctcgatgcatccactttggaaacaggggtcccatcaaggttcagtggaagtggctcgtgggacagtattttacttcacctatcagcaggctgcagcctagaagacattnacaactatacttactgtacaactagtatagtatacgtctcccgctaccg

SEQ ID NO: 152627 - DNA, 518 bp, Homo sapiens
  misc_feature: GYAE6OF02I6N4B.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctagactcctcgatgcatccactttaggaaacacgggtcccatacgaaggttcagtaggaagtggctcgtgggacagttattttacttcacctatcagcagctgcagcctagaagactattgacaactaattacttacgtacgtacaacgtagttactagtatacgttccgtacccgtaccg

SEQ ID NO: 152628 - DNA, 516 bp, Homo sapiens
  misc_feature: GYAE6OF02HGDIB.51.67.G01.1.454.CMB.1.raw
  modified_base (315)..(315): a, c, t, g, unknown or other
  misc_feature (315)..(315): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccngggacacgacccctaaactcctagactcctcgatgcactcccacgttttaggaaacgtacggggtcccatcaaggttcaggtggaagtggctcgtgggactagtattttacttcacctatcagcaggctgcagcctagaacgtacattgactaacgtattaacttactgtacaactagtatagatacgtcctcccgtaccg

SEQ ID NO: 152629 - DNA, 526 bp, Homo sapiens
  misc_feature: GYAE6OF02IAGTJ.51.67.G01.1.454.CMB.1.raw
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccngggacacgaccctaaacncctagactcctcgatgcactccaacttttacggaaactaggggtacccagtacctaaaggttcaaggtggaagtggcttcgtgggactagtattttacttcacatcagcagctgcagcctagaagtacattacgactaacattaacttactcgttacaacgtagtaacgtgtaattacgtccctcccgtaccg

SEQ ID NO: 152630 - DNA, 546 bp, Homo sapiens
  misc_feature: GYAE6OF02IRH1K.51.67.G01.1.454.CMB.1.raw
  modified_base (245)..(245): a, c, t, g, unknown or other
  misc_feature (245)..(245): n is a, c, g, or t
  modified_base (455)..(455): a, c, t, g, unknown or other
  misc_feature (455)..(455): n is a, c, g, or t
  modified_base (474)..(474): a, c, t, g, unknown or other
  misc_feature (474)..(474): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtcctccatccctccctgtctgcatctatagganacagaatcaccatcacttgccgggcgagtcgagacattagcatgtatctgaattggtatcaagacaaaaccgaggacacgacccctaaactcctagactcctacgatcgctactaccctaacgttttacggaaacgtacggggtacccctaagtaccaagggtttcaggtggaacgtggctcgtggactagttacttttacttcaccatnagcagctgcacgctgaacntatcgactaacgtattaacttactacgtacaaacgtagttaacgttgtaacttacggtccctacccgttccg

SEQ ID NO: 152631 - DNA, 508 bp, Homo sapiens
  misc_feature: GYAE6OF02H5PT3.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaacagggacacgacccctaaactcctagactcctcgatgcactccactttaggaaacagggtcccatcaaggttcagtggaagtggctcgtgggactagtacttttacttcacctatcagcaggctgcagcctagaacacattgactaacattacttactcgtacaacgtagtactagtactagtccctacccgtccg

SEQ ID NO: 152632 - DNA, 503 bp, Homo sapiens
  misc_feature: GYAE6OF02GRLU7.51.67.G01.1.454.CMB.1.raw
  modified_base (314)..(314): a, c, t, g, unknown or other
  misc_feature (314)..(314): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccngggacagcccctaaatcctagactcctcgatcgcatccactttaggaacagggtcccatcaagttcagtgaagtgctctggactagtattttacttcacctatcagcaggctgcagcctagaacgactattacgacaacgtattaattactagtactaacgtagttatagattacgtcctacccgtacg

SEQ ID NO: 152633 - DNA, 558 bp, Homo sapiens
  misc_feature: GYAE6OF02J0OZP.51.67.G01.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
tcagcgatcgtatacacgaccggtgctcgatttagagtatacatattgggtttgggtcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgaccccagtctccatcctcctgtctgcatctataggagacagaatcaccatcacttgccgggcagtcgagacattagcatgtatctgaattggatcagacaaaaaccgnggacacgacccctaaatccctagactccctgactgcatccacttttggaaacncgggtaccatacaaggttcagtggaagtcgctcgtgggactaggtattttaccttacacctattcgagtccaggtctgacgagtcccgtagaacgtacctattcgactaaacgactttaactttaacttcggttaaccaaacgttaacgtttagtaacgttaacgttacggtttaccccaccccggtttcc

SEQ ID NO: 152634 - DNA, 666 bp, Homo sapiens
  misc_feature: GYAE6OF02IH028.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgaccccagtctccatccctccctgtctgcatctataggagacagaatcaccatcacttggccgggcgagtcgagacattagcatgtatctgtaattggtatcaagacaaaaaccagggacacgaccctaaactcctacgactcctcgatgactactaccctaacgttttacggaaaccgtacggggtacccctaagtaccgtaaacgggtttcgaaggttagggaaacggttcgggtccgttacggtagggggtaaccttaaggttaaactttttttaccttttaccaacccgtaattccgaagtaccgtacgggtccttcggtaccgaacgtacccgtaggaaacgtacttaacgtttacgaacctaaaccgttaattaaaccgtttaaccgttacggttaaccaaaacgttacggttaagttacggtaacgtttaccgttccccgttaccccgtacccg

SEQ ID NO: 152635 - DNA, 586 bp, Homo sapiens
  misc_feature: GYAE6OF02GR67D.51.67.G01.1.454.CMB.1.raw
  modified_base (241)..(241): a, c, t, g, unknown or other
  misc_feature (241)..(241): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccgggcgagtcgagacattagcatgtatctgaattggtatcagacaaaaccgaggacacgaccctaaactcctagtactcctcgatcgactactccctaacgttttacgggaaaccgtacggggttacccaagttaccgtaaacgggtttacagggttaggtaaacggtcggtaccttacggtagggaacgtaggtttaactttttacctttaccacctatacgtacgtacgtaggtcctagcctaacgtcctaagaacgtactacgttacgactaacgtattaacttactagtacaatagtatagacttacgtccctacccgtcc

SEQ ID NO: 152636 - DNA, 706 bp, Homo sapiens
  misc_feature: GYAE6OF02GWGQH.51.67.G01.1.454.CMB.1.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatcgacccagtctccactcctcccgtgtctgacatactataggngaccagaactcacatcattggccggnagtcgagtacattagcaatgatctagattggtatcgaagaaccaaaaacgcgggacaacgtaccccctaaatcctagtacctcgtacgacgtacgcttaactcccgttaaacgttttacgggaaaacccggtacggggttaccccaagttaccgtaaacgggtttacgaacgggtagggtaaacggtcggtaccgtacggtacgggtaacgttaaggtttacctttttaaccgtttacctaaacctaccgtttacgaacggtaccgtaacggggtacctttaccggaccgtaacgtaccccggtaaggtaaaacccgtaccgtaagttttacggaacccttaacgtaaacgttttaactttaaccgttaccgtaaccgttaaccgaaggtttaataccggtaataccgggtttaccctccccgtttaaccccgg

SEQ ID NO: 152637 - DNA, 518 bp, Homo sapiens
  misc_feature: GYAE6OF02GWLB8.51.67.G01.1.454.CMB.1.raw
  modified_base (451)..(451): a, c, t, g, unknown or other
  misc_feature (451)..(451): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagaccaaaaacgagggacagcccctaaactcctgactcctcgatgcactcctacgttttacggaaacgacggggtacccataccgaagggtttccaggtggaagtggactcgtagggactagtattttacttcacctatcagacagtcngcagctagaacgacattnacaanacttattactagtacaacgtagtactagatacgtactcccgtac

SEQ ID NO: 152638 - DNA, 572 bp, Homo sapiens
  misc_feature: GYAE6OF02F6YV5.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctgactcctcgatcgcactcctacgttttaggaaacgtcggggtacccagtacgaagggtttcaaggttagggaaggttcggtcctcgtaggggtaactaggttacttttacctttcaacctattacagcagggtcctggccagtcctggaaacgctagttcgacctaacgtaattaactttacgtacgtaacaaccgtaaggttactaggaacttacggtacctcccggtacccg

SEQ ID NO: 152639 - DNA, 682 bp, Homo sapiens
  misc_feature: GYAE6OF02HHIPR.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctatagagacagaatcaccatcacttgccgggcgagtcgagacagttacgcatgtactctgtaagttggtatcaagacaaaaaccgaggaacacgacccctaaactcctacgtactcctacgactacgaccacttaccctaacgttttacgggaaaaccggtacggggtacccctaagtaccgtaaacgggttaccgtaaggttacgggaaaggtcgggtaccgtcggttacggggaacctaacggtttaaccttttttaacctttacctaaccccgtaattacccgtaacgaccggtacgggaccttacgggacctaacgggtcccttaaggaaacgtacgtacgttacgaacctaaaccgtaattaaccgtttacgtaccggttaactaaaccggttaagtttaacgtaggttaaccgtttacggttacccctacccggttacccg

SEQ ID NO: 152640 - DNA, 537 bp, Homo sapiens
  misc_feature: GYAE6OF02I4X8M.51.67.G01.1.454.CMB.1.raw
  modified_base (315)..(315): a, c, t, g, unknown or other
  misc_feature (315)..(315): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccngggacacgacccctaaactcctagactcctcgatgcactcctacgtttacggaaacgcgggtacccagtcgtaaggttcaggtggaagtggctcgtacgggactaggttactttttacttccacctattacgagtcgaggctcgctacgcctagaagactagttacgactaacgtattaacttactagtacaacgtagttatagattacgtcctacccgtcg

SEQ ID NO: 152641 - DNA, 537 bp, Homo sapiens
  misc_feature: GYAE6OF02GEL03.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcactgccgggcgagtcgagacattagcatgtatctgtaattggtatcagacaaaaaccagggacacgacccctaaactcctgactcctacgatgctactcctacgtttacggaaacgtacggggtacccatacgaaggttcaggtggaacgtggacgtcgtgggactagttacttttaccttacacctatcagcaggctgctacgctagaacactattcgacaactattaatttacgtgttaaccaagtacgttatagtaacttacgtccctcccgttacc

SEQ ID NO: 152642 - DNA, 635 bp, Homo sapiens
  misc_feature: GYAE6OF02HXAPF.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctagtaattggtatcagacaaaaaccgagggaccacgacccctaaactcctagactcctcgatcgactactaccctacgttttacggaaacgtacggggtaccctaagttaccgtaaacgggtttcaaggttagggtaaacggtcgggaccgttacgtacggggtaacctaggtttaactttttacctttaccaccctaacgtcgaacgaccgtacgggtctacgccgacgtccctaggaaacgaccgtaagtttacgacctaaacgtaactttaactttaaccgtacgttaccaaaccgtacgttaactaggtaaccgttaacggttcccttaccccggtacccg

SEQ ID NO: 152643 - DNA, 551 bp, Homo sapiens
  misc_feature: GYAE6OF02FQD4V.51.67.G01.1.454.CMB.1.raw
  modified_base (317)..(317): a, c, t, g, unknown or other
  misc_feature (317)..(317): n is a, c, g, or t
  modified_base (517)..(517): a, c, t, g, unknown or other
  misc_feature (517)..(517): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgtaattggtatcagacaaaaaccgngggaacacgacccctaaactcctagactcctacgatcgacactcctacgtttaggaaacgtacggggtacccatacgaacggttcaggtaggaagtcggctcgtgggtacaggttacttttacttaccacctatcagcgtacgctgcacgcctagaagtacgtattcgactaacgtattaacgttactacgtaccgtaanagttacgtagtacgttacggtccttcccgtaccg

SEQ ID NO: 152644 - DNA, 520 bp, Homo sapiens
  misc_feature: GYAE6OF02HWUGR.51.67.G01.1.454.CMB.1.raw
  modified_base (315)..(315): a, c, t, g, unknown or other
  misc_feature (315)..(315): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggcgagtcgagacagttagcatgtatctagaattggtatcagacaaaaacgngggacacgaccctaaactcctagactcctcgatgcactcccagtttacggaaactgggtcccatcgaagttcagtggaagtggctcgtggactagttattttaccttacacctatcagacaggctgctagcctagaagactattgacctaacgtattacgttactcgtaacaactagttactagagttacgtccctaccgtaccg

SEQ ID NO: 152645 - DNA, 577 bp, Homo sapiens
  misc_feature: GYAE6OF02GB6TR.51.67.G01.1.454.CMB.1.raw
  modified_base (231)..(231): a, c, t, g, unknown or other
  misc_feature (231)..(231): n is a, c, g, or t
  modified_base (284)..(284): a, c, t, g, unknown or other
  misc_feature (284)..(284): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatcgacccagtctaccatcctccctgtcngcatctataggagacagaatcaccatcacttgccgggcagtgagacatagacntgtatcgtgaattgtatcaagaaccaaaacgaggacacgaccctaaactccagactccacgatgacacttccgaacgtttacggaaaccgtacgggtacccaatacgtaaggttcgaggtaggaaggtcggtactcgtgggtaactagttattttacccgttaccgtaacctacgttactaacggacgacggtaccgttcgaccgagttacccgtagtaaacgactagttcaacgtaactaagtaacttactacgtaacctaagacgttatacgaattactaccctcctaccg

SEQ ID NO: 152646 - DNA, 577 bp, Homo sapiens
  misc_feature: GYAE6OF02JFARS.51.67.G01.1.454.CMB.1.raw
  modified_base (247)..(247): a, c, t, g, unknown or other
  misc_feature (247)..(247): n is a, c, g, or t
  modified_base (439)..(439): a, c, t, g, unknown or other
  misc_feature (439)..(439): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcgaggtgccagatgtgtcatccagatcgacccagtcctccactccctcctgtctgcatctatagganacagactcaccatcacttcggccgggacgacgtcgagactattacgctagtgtactctgtaagttggtatacgaagaaccaaaaccgacgggaaccacgtacccctaaactcctacgtactcctacgatcgactactaccgtagtttaacgaacggtccggtaccagtacgtagtcaggtagtagtgctcgnggtaatacgttactttactactactatacgacggtacacgcgtgccgtacgtacgtagaacgactagtccgtaacaacgtaactttaacttacgtcgtaacctaagtagttacgtagtacttcgtcccgtcctaccgg

SEQ ID NO: 152647 - DNA, 635 bp, Homo sapiens
  misc_feature: GYAE6OF02G8JUK.51.67.G01.1.454.CMB.1.raw
  modified_base (331)..(331): a, c, t, g, unknown or other
  misc_feature (331)..(331): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtcctccatcctccctgtctgcatctagtaggagacagaactcaccatctacttggccgggacgagtacgagacattagcatagtatctagtaattggtatcgaagaaccaaaaaccgnggaacaccgaaccctaactacctcgactccgtacgtactacgctactactaacgtttaaggaaaccggtaccggggtacccaagttaaccgtaacggttacgaaggtagggtaacgttcggtccgtacgggtacggaacgtaagtttacttttaaccgttaccacctagtaccgaaggtacgtacggtacgaccgtactaacgccgtaagaaacgtactagtacgaacctaacgtaacttaacgtttacgtacgtaaccaagtaacgttacgtacgttaagtaccgttccgtacccgttaccgg

SEQ ID NO: 152648 - DNA, 519 bp, Homo sapiens
  misc_feature: GYAE6OF02FUE0M.51.67.G01.1.454.CMB.1.raw
  modified_base (314)..(314): a, c, t, g, unknown or other
  misc_feature (314)..(314): n is a, c, g, or t
  modified_base (430)..(430): a, c, t, g, unknown or other
  misc_feature (430)..(430): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaacgngggacacgccctaaactcctagactcacgatgacatccagtttacggaaactacgggtaccagtcaaggttcgagtaggaagtggctcgtgggactagtacttttacttcgacctntacacgacagggactgacagcctagaagactattcgacaactataacttactacgtacaacgtagtactagtactacgtctcccgtacg

SEQ ID NO: 152649 - DNA, 676 bp, Homo sapiens
  misc_feature: GYAE6OF02IGE63.51.67.G01.1.454.CMB.1.raw
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgccgggcagtcgagacattagcatgtatctagattggtatcagacaaaaaccgaggacacgaccctaaactcctgaattcctacgtactacgctaactccctaacgttttacggaaaaccgtacggggtaccccaagtaccgtaaacgggttaccagggttacgggaaacggttcggaccgttaccggttacggggtaaaccttaagggttaactttttttaacccgttttacctaacccgtacgttaaccaacggtacgtaacggccgttacgaccggtaacgtacccttaacggaaacggtacctaactttacggacctaaaccgtaatttaacccgtttacgttacggtaacctaaaccgtagttaaacgttacggttaacgtaccggtttacccctacccccggtttacccgg

SEQ ID NO: 152650 - DNA, 655 bp, Homo sapiens
  misc_feature: GYAE6OF02G4HT2.51.67.G01.1.454.CMB.1.raw
  modified_base (314)..(314): a, c, t, g, unknown or other
  misc_feature (314)..(314): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaacgngggaacacgacccctaaactccgtagtactacctcgagtcgactactcccttaacgttttagggaaaccgtacggggtaccctaagtaccgtaaaggttaccgtaaggtagggaaagttcgggtaccgtcggtacgggtaacgtaggttaacgtttttaacctttccgtaaaccctaagttaccaacggtaccgtaggtccgttacggacctacggtacccgttaaggaaaccgttaccgtaatttaccgggaacctaacgtaattaaccgtttaacgttacgttaacctaacgtaacgttaacgttaggttaacgttacgtacccgtaccccgttacccg

SEQ ID NO: 152651 - DNA, 718 bp, Homo sapiens
  misc_feature: GYAE6OF02H9RPC.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagactgacccagtcctccatcctccctgtctgcatctataggagacagaatcaccatcacttgccggcgagtcgagacattacgcatgtatctagtaattggtatacaagtaaccgaaaaaccgagggaacaccgtacccctaaaacgtcctagaacgttcctacgtactcgaccttactccgtaaccgtttttacgggaaaccgtacggggtacccctaattaccggtaaagggtttacccgaagggttagggtaaacggtcgggtaccgtttaccggtaggggtaacccttaaggtttaactttttttaaccgttttacccgaaccgtaagtttacccgaagggtaccgaaccgggttacgtccggaacgtacgttaacccgtaggtaaaaccgggtacttaagtttaccgaacctaaaacttaccgtttaaacgtttacgtccggttaaacctaacggtacgtttaagtaaccggtttaacttaccggtttaccccgtcccggtttaaccccgg

SEQ ID NO: 152652 - DNA, 604 bp, Homo sapiens
  misc_feature: GYAE6OF02FVYIS.51.67.G01.1.454.CMB.1.raw
  modified_base (353)..(353): a, c, t, g, unknown or other
  misc_feature (353)..(353): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgcccagatgtgtcatccagatgacccagtctccatcctccctgtcctgcatctataggagacagaatcaccatcacttgccgggcgagtcgagacagttagctatgtattctgtaattggtatcagacaaaaaccgagggacacgacccctaaactcctagacttccncgtactgactactccctacgtttacggaaacgtacggggtacccagtaccgtaggttacgaggtagggaagtcgggctcggtacgggtaactagttacttttaccttacacctatcagtacgaggctggcacgtcctagaacgactagttacaccgtaactaacgttaactttaccgttacgttaaccgtaaacgtaacggtttaacgttacggttaacgttacggttaccccgttaccccgttaccccgg

SEQ ID NO: 152653 - DNA, 856 bp, Homo sapiens
  misc_feature: GYAE6OF02IYEX2.51.67.G01.1.454.CMB.1.raw
tcagcgatcgtatacacgaccggtgctcgatttagagtatacatagttgggtttgggcacgaccggtgctcgatttagagtatacatacttgggtttgggggcaggagtcagtcccaaccaggacacagcatggacatggagggtccctgctcagctccgtggggctcctgctgctctggctctcgaggtcgccagtatgtgtccatccagatcgaccctagtcctaccacttccctccgtcgtcctacgactatctagtaggacgaacacgaactccaacctatcctacgttcggccggcgtacgtcgagacgtatacgactagtagtactctaggtagttggtactacgaacgaaacgaaaccggacggaacctaacccgtaaccccttaaaccgtccgtacgtaccttccgtaacgtacgtaccgaccgtaaccttacccgttaacggtttaaaccgggtaaaccggggtaccccgggtttaacccctaaaggtttaaacccgggtttaaacgggtttcggtaaagggtttaacgggacgggtttccgggttaccgttaaccggggtaacgggtttaaacccttaacgggtttttttaaccccgtttttaacccgttaccgtaaacccgttaaccgttaccggaaccggtaacggttaacccgggtcggttacccggtaacgacccggtttaaacgaaacggtaaaccgtaaccggtttcgtaccggtaaaccttaaccgtttaacgttaacccgttttaaaccggtccgttaaaaccgtttaagttaaacgtttacgtaacccggtttaaacccggtcccccggttttacccgacccggtttaaccccgggg

SEQ ID NO: 152654 - DNA, 649 bp, Homo sapiens
  misc_feature: GYAE6OF02GN5ZL.51.67.G01.1.454.CMB.1.raw
  modified_base (294)..(294): a, c, t, g, unknown or other
  misc_feature (294)..(294): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctcctatccctccctgtctgcatctataggagacagaactcaccatcacttggccggcgagtcgagacattagcatgtatntgtaagttgtatacagaacgtaaaaccgaggaacaccgaccccttaaactcctacgtactaccgtacgatcgactactaccgtacgtttacggaaaccgtacgggttaccctagtaccggtaacggttcgaacgggttggtaacggtcgggtacttcggtacggggtaacctaggttttaactttttaccgtttaccgaaccgttaagtaccgaagaccgtacggtcgtacgtactaccgtcgttacgaacgtacgtacgttacacgtaacttaaacgttaacgtttacgttacgtaacctaaacgttattacggtaacgttaccgtaccggtttacccgaccccggttccccgg

SEQ ID NO: 152655 - DNA, 742 bp, Homo sapiens
  misc_feature: GYAE6OF02H3PMM.51.67.G01.1.454.CMB.1.raw
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctgggactcctgctgctctggctctcaggtgccagatgtgtcatccagatgacccagtcctccatccctccctgtctgctactctataggagacagaatcaccatcacttcggccggtcgacgtcgaagtacaagttacgctacgtgttatccgtagtaagtttggtactacgaacgaaccgtaaaaaccgcgggaaccaaccgtaaccccctaaaacgttcctaggtaaccttcccgtacgacgtcgactaccttacctaccgttttaagggaaacccggttacggggtacccctaagttacccgtaaacgggtttaccgtaagggtacgggtaaacgggtcggtacgttacggttacgggtaactaacggtttaactttttaaccctttaccgtaaacctacgtaccgtaacggtaccggacgggttaccgttaggacctacggtcccgttaaaggaaaccgtacgttaacttaccggtaacctaaacgttaacgtttaacgtttaaccggtacgttaaccgtaaaccgttaaggtttaacgttacggtaactttaacccggttacccgttaccccgttaacccgg

SEQ ID NO: 152656 - DNA, 583 bp, Homo sapiens
  misc_feature: GYAE6OF02F79ES.51.67.G01.1.454.CMB.1.raw
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctcctgctgctctggctctcaggtgccagatgtgtcatccagatgacccagtctccatccctcctgtctgcatctataggagacagaatcaccatcacttgcggcagtcgagacatagcatgtatctgaattggatcgagacaaaaaccgaggacacgcccctaaactcctagactcgtaccgatcgactataccctacgtttagaaccgtacggggtaccctagttaccgtaaggttcacggttaggaaggtcggtaccttacggtacgggtactaggttacttttaccgtttacaacctattaccgagtaccggtacggtacgtcgaccgtagtaccgtacgaacggtacctacgtttacgactaacgtattaacttacgtacgtacaacgtagtaactgtactacgttcctcccgtaccg

SEQ ID NO: 152657 - DNA, 782 bp, Homo sapiens
  misc_feature: GYAE6OF02GK8QS.51.67.G01.1.454.CMB.1.raw
  modified_base (187)..(187): a, c, t, g, unknown or other
  misc_feature (187)..(187): n is a, c, g, or t
  modified_base (748)..(748): a, c, t, g, unknown or other
  misc_feature (748)..(748): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctggggctccgtgctgctctggctctcaggtcnccagatgtgtcatccagtatcgacccagtcctcctacttccctccgtgtctcgcactctaagtacggagaacagtaactaccgaacctataccgtacgttcggacccggggacgtaacggttaccggaacgaaccgttaacgttaacgaccgtaacgtttggttaacgttccgtttaaggtaaacgttttagggttaacttaccggaaacgtaaaaacccggaaaaaccggttaacggggaaacctaaccccggtaacccccttaaaccgttccgtacgtaacccgttacccgtacgtacgtacgaccttacctaccgttaacgttaacggaaccgttaaccgggtccctaagtacggtaacggttcaaagggtaggtaacgtcgggtaaccttacggtacgggtaacttaggtttttaaccttttaaccgttaccgaaccgttactacgtaacgggtactacggtaccgtcgaacctacggtaccgtaagaaaaccgtcgttaacgttcaaccttaacgtaatttaaccgttaccgttacgaaacccgtagttaccgtanaacgttaccgtttaccgtcccgtaccgttaccgg

SEQ ID NO: 152658 - DNA, 605 bp, Homo sapiens
  misc_feature: GYAE6OF02IHHLS.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccactcctcccctgtctgcatctaataggagacagaatcaaccatcacttgccgggcgagtcgagacattagcatgtatctgtaattggtatcagacaaaaaccagggacacgaccctaaactcctagactcctacgatgcatcccgtaacgttttacggaaacctacggggtcccaagtaccgtaaaggttacaggttagggaaggtcggcgtcgtaggggactaggttaatttttaccgtttaccaaccgtatcgaacgcgacggtctacgaccacgtcccgagtaaagaacctaatttacgactaaacgtaacttaaactttaacgtacgtaacctaaacggtacgttaacgttacgtatttaaccggttcccttacccgttacccg

SEQ ID NO: 152659 - DNA, 554 bp, Homo sapiens
  misc_feature: GYAE6OF02GVQOC.51.67.G01.1.454.CMB.1.raw
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtcctccatccctccctgtctgcatctataggagacagaatcaccatcacttggccgggcgagtcgagactattagctatgtatctagaattggtatcgaagaccaaaaacgacggacaccgtacccctaaactcctagactcctacgatacgactactacctacgtttacggaacgtacgggtacccagtacgtaaggttcaggtaggagtcgacgtgtaggactagttacttttacttctaccngtacagcgagctcgacacgtctagaacncatacgactaactaatacttaactagtacctaagtattacgtagtacgtcgttaccgtcccgttaccg

SEQ ID NO: 152660 - DNA, 590 bp, Homo sapiens
  misc_feature: GYAE6OF02JAIVE.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgaccagtctccatcctccctgtctgcatctagtaggacacagaactcaccatcacttggccgggcgagtacgagactattagcatagtatacgtagtaattggatacgaacgtaaccaaaaaccgacgggactacgaccccttaaactcctagacttcccgtagacttcgacctacttccctaacgtttacggaaaccggtccggtaccagtaccgtaaggtcaggtaggtacgtggcttcgtggaactagttactttaacctcaactgtacagtacgagtcgtagacgtcgtacagtaatacgtagtagaccgtaactacgttaacttcgtacgttacgaaacgtggttaactacgtagttccgttacccgtaccggttaccg

SEQ ID NO: 152661 - DNA, 733 bp, Homo sapiens
  misc_feature: GYAE6OF02IPCSL.51.67.G01.1.454.CMB.1.raw
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctgggctcctgctgctctggctctcaggtgccagatgtgtcatccagatcgaccagtctccatcctcctgtcctgactatcctagtaggagaacagaactccaacctatacctacgttcggcccggggactaacggtaccgaacggaactagtttaacgctaattgtaacgttctaggtaaatttgggtacttaccaagtaaaccgaaaaacccgtaggggacctaaccggtaaccccctaaaacttcccgttaggtaacccttaccggtaccgtaacttggtaacccctaactttacccgtaacggttttaacggaaacccggtaccgggttaccctaacgtaacggttaacgttacgtaggttaacggtaagttcggtacgtacggtagggtaacgttaagttacgtttttaaccgtaacgtacctaacgttacgacggtaccgacgtcgtaccggtctacgtaccgtaagaaacgtacttacttaccgaaactacgtaaactttacggttactaaccgtaacgttaacgtaagttaacgttacgtaacggtttacccgttacccgttcgtacccgg

SEQ ID NO: 152662 - DNA, 612 bp, Homo sapiens
  misc_feature: GYAE6OF02GXH3S.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttcgccgggcagtcgagacagtacgcagtgtatctagtaattggtatacagaaccaaaaaccgcgggaactacgacccctaaactcctagactccgtacgtatcgacactaccgtactttacggaacgtacgggtacccatacgtaaggttcgaggtaggaaggtggtacctggtacgggactaggttacttttaacgtttcactacttacgagtaccgaggtcctacggctacgtaaccgttacgaaagtacctacgttacgaccgtaaaccgtaattaacctttaacgttcgttaaccgtaaaccgtaagttacgttagtaaccgtttaccggttccgtaccccgttaccgg

SEQ ID NO: 152663 - DNA, 665 bp, Homo sapiens
  misc_feature: GYAE6OF02GK17R.51.67.G01.1.454.CMB.1.raw
  modified_base (250)..(250): a, c, t, g, unknown or other
  misc_feature (250)..(250): n is a, c, g, or t
tcagcgatcgtatacacgaccggtgctcgatttagagtatacatattgggtttgggcacgaccggtgctcgatttagagtatacatattgggtttgggggcaggagtcagtccccaaccaggacacagcatggacatgagggtccctgctcagctcctggggctcctgctgctctggctctcaggtcgccagatgtgtcatccagatcgacccagtcctaccactccctccctgtctgcatctatagganacagaactcactatcacttggccggcgaggtcgagactagttagctatgtatctagtatttggtactacgacgaaccaaaaccgagggaacctacccgtaacccctaaactccgtaacgtaccttaccgtacgtagtcgacctacctacccgttacgtttaaccggaaacggttccgggtaccctagtaccggttaacgtacggtagggtacggtaacggtcggtaccgtacggtacgggtaacttaacggttttactttttaacccgttccgtaaacctagtaccgaacggtaccgtcggtactcggaccgtacgtacgacgtaacgtataccgttacgaacctaacgtacgttaacttacgttacgaacctaacgagttactaggtaccgttaccttacccgtacccgtaccg

SEQ ID NO: 152664 - DNA, 777 bp, Homo sapiens
  misc_feature: GYAE6OF02GIACK.51.67.G01.1.454.CMB.1.raw
  modified_base (193)..(193): a, c, t, g, unknown or other
  misc_feature (193)..(193): n is a, c, g, or t
  modified_base (652)..(652): a, c, t, g, unknown or other
  misc_feature (652)..(652): n is a, c, g, or t
tcagcgatcgtatacacgaccggtgctcgatttagagtatacatattgggtttgggcacgaacggtgctcgatttagagtatacatattgggtttggggcaggagtcagtcccaaccaggacacagcatggacatgagggtccctgctcagctcctggggctcctgctgctctggctctacaggtcaccgagntgtgtacactccgagactacgacccctagtcctacccacttccccgtcccttcgttccgtaggcctaacgttacgtaagttaagggaacgtaacgtaacggtaaacttaccgaaccccgtatttacccgtaacccggtttccgggacccggggtaaccgtaaggtaccggtaaacggtacctaacgtttacggaccgttaagttacggtacttaccgtagttaagttttacggaccttacgaaaccgtaaaccgaaaaccgggtacggaaccctaaccgtaacccctttaaaccgtccggtacttaccgttacccgtacgtacgtaccggtaactaccgttaccgttaacgggtaaccggtaaccggtaccggggtaacctagtacgtaaccggttacgtaaggtacggtaggtcgtccgtcggtagtacgttataacgtttcttacacctatcgtaancggtaccgatcggtaccgacgtaccgtagacgtaacttcgttaccgattaacggtaactttaacgttaccgtagttaacgtaactagttacgtacgttacctacttcccggtacccttacccggg

SEQ ID NO: 152665 - DNA, 713 bp, Homo sapiens
  misc_feature: GYAE6OF02IZ18J.51.67.G01.1.454.CMB.1.raw
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (599)..(599): a, c, t, g, unknown or other
  misc_feature (599)..(599): n is a, c, g, or t
tcagcgatcgtatacacgaccggtgctcgatttagagtatacatattgggtttgggcacgaccggtgctcgatttagagtatacatattgggtttggggcaggagtcagtcccaaccgaggacacagcatggacatgaggtccctgctcagcgtctggggctccgtgctgctcgtggctctcgaggtcgaccagtattggtctcaactccgagtagtcgaccctagttccacctactccccttcgngttcctgactactacgtagaggagacaanaactaccacgtactccgtacgttcggaccgggacgtaggtaccggaataacgtagttacgcgttaaagtgttactaggttaaggttaacgttaggtctaaccggaacgtaaaccgaaaaacggacggtaaccaacccgttaaccccgttaaatccccgtagtaccctaccgtcggtataccggctaaccttaccgaacggtttaacggaaccggtaccgtaccgtaacgtaccggttaagtaccggtaagtacgggtaacgtcgtacgtacggtacgtacgttagtttacctttactccgtacgtactacgtacgtacgacgtnacgtcctacggtactacgaagtacgtactcgtactaatcggtttaacctcgttaacgtaccttaagtaggtttagtaacgttacgttacccggtttcccaccggtttaacccgg

SEQ ID NO: 152666 - DNA, 716 bp, Homo sapiens
  misc_feature: GYAE6OF02H1W81.51.67.G01.1.454.CMB.1.raw
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (415)..(415): a, c, t, g, unknown or other
  misc_feature (415)..(415): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctccgtgggctctgctgctctgctcncaggtcnccagatgtgtcactccagactccgaacctcgttcctcctacttcccgttccctgtctgcctatctagtacggaacactagaactccaaccatccacgttcggccgggtcacggtacgaacgacttaagttacggaccttaagtttacgttacttcgtagttaacgtttaggtaacttacgaacgtaaacccgaaaaacggacggaaccctaacccgtaccccgtttaaacncccgttacggtaacctccgtaacgtactgaccttacctaccgttaacgtttacgggaaaccggttaccgggtaccctaacttacggtaacgttacggtaacggtacgggtaggtcgttaccgtaggtagggttaacctttaaggtttactttttaccgacgaccttcggtatacggtacgaacggtcctcggacgccgttagaaagttaccgaagtttacgacgtactaacgttaactacgtttcaacttaaacttacgtcgttaaccgtagtacccgtacgttccccttaccggttaccg

SEQ ID NO: 152667 - DNA, 763 bp, Homo sapiens
  misc_feature: GYAE6OF02I1OXP.51.67.G01.1.454.CMB.1.raw
  modified_base (246)..(246): a, c, t, g, unknown or other
  misc_feature (246)..(246): n is a, c, g, or t
  modified_base (316)..(316): a, c, t, g, unknown or other
  misc_feature (316)..(316): n is a, c, g, or t
  modified_base (750)..(751): a, c, t, g, unknown or other
  misc_feature (750)..(751): n is a, c, g, or t
  modified_base (753)..(757): a, c, t, g, unknown or other
  misc_feature (753)..(757): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
tcagcgatcgtatacacgaccggtgctcgatttagagtatacatattgggtttgggcacgaccggtgctcgaatttagagtatacatattgggtttgggggcaggagtcagtcccaaccaggacacagcatggacatgagggtccctgctcagctcctggggctcctgctgctctggctctcaggtgccagatgtgtcatccagatgacccagtctccactccctccctgtctgcatctatagganacagatcacatcactgccggcgagtcgagacagttagcatgtatctagtaattgtatcagaccaaaacgnggacacgaccctaactcctagactcctacgatcgactacgtaccctacgtttaacggaaaccgtacggggtacccctaagtacgtaacggttacgtaacggttacgggtaacggttcgggtaccgttacgggtaacggggttaaccgttaacggtttttaaacgtttttttaacccttttaacccgttaaccccgtaaaccgtttaccgtaaacggtacccggttaaccggggtacccgttacgggtaaccccggttaaaccccggggtttaaaccccgggtttaaaacccggggttaaaaaaacccgggtttaacccggttttaaacccggggttttttttaaaccccccggggggaaaaaacccccccctttttttaaaaaaaaaaacccccgggtttttttaaaaaccccgggtttttttttaaaaaaatnnannnnntncntc

SEQ ID NO: 152668 - DNA, 873 bp, Homo sapiens
  misc_feature: GYAE6OF02IFPR1.51.67.G01.1.454.CMB.1.raw
  modified_base (187)..(187): a, c, t, g, unknown or other
  misc_feature (187)..(187): n is a, c, g, or t
  modified_base (196)..(196): a, c, t, g, unknown or other
  misc_feature (196)..(196): n is a, c, g, or t
  modified_base (816)..(816): a, c, t, g, unknown or other
  misc_feature (816)..(816): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtgggctcctgctgctctggctctcaggtcnccagatgtntacactccagtaatcgaacctagtcctcacttccttcctgtctcgactacgttctaagtacggacaacgaagtaactccaacctacgtaccttaacggtccgggaccggacgtacggtaccgaaggtaaccttaacgttagtaacctaaggttacgttacgttacgttaacgttaaggtttacggtaagttaaccgaaacggtaaaaccgaaaaaaccgggtacgggtaacccgaaaccccggttaacccccgttaaaaccgttccgttaacgtaacccggttacccgttacggtacgtaaccggtcccttaaaccgtttaacccgtttaaacgggttttaaaccgggaaaaccggtttacccgggggtaccctaaaccggtttaacgggtttaaacgggttacccgtaagggttaaccggtaacgggttccggtacgtttacgggtacggtaactttacgggtttttaaacctttaccgtttacccgacctttacgtaaccgtaaccggttcgacggtttcgtaccgaaccggtaccgttacgtaaacggtaaccgttaccgttacgacgttaacccggtaattaaacgtttaaccttaccggaccgtttaaaaccggntttaacggtacgttttaacggaccggttaccgtttacccggacccggttttaacccg

SEQ ID NO: 152669 - DNA, 781 bp, Homo sapiens
  misc_feature: GYAE6OF02G35PR.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgaccctagtcctcctactccctccctgtctgctatcgtaagtaggagacaagaactccaaccatcctacgttcgggaccgggcgtaaggtccgaagtactagttacggacctagtcgtatcgtagtaacgtttggtaactcgaaacgaaaccgaaaaaccggtacgggaaccctaacccggtaaaccccttaaacgtcccgttaacgtaaccttcccgtacggtacgtaccgtaccttaaccgttcccgttaaacggtttaacgggaaaccgggtaccgggtaccctaagtaacccggttaacggttacgaacgggttagggtaaaccggttcggtaccgttacgggttacgggtaactttaacgggtttacctttttaaccgttacccgtaaccgtacttaccgaacgtacggtaccggtaccgtacgtacccgtacgtaaccggttaagaaccgttacgttaaccggttacaaaccttaaccggttacttaaccgtttaccggttaacgtaaccgttaacgttacgttaacgttacgtaacgtttacccgtttcccgttaacccgttcccggg

SEQ ID NO: 152670 - DNA, 724 bp, Homo sapiens
  misc_feature: GYAE6OF02JV5E1.51.67.G01.1.454.CMB.1.raw
tcagcgatcgtatacacgaccggtgctcgatttagagtatacatattgggtttgggcgacgaccggtgctcgatttagagtatacatattgggtttgggggcaggagtcagtcccaaccaggacacagcatggacatgagggtccctgctcagctcctggggctcctgctgctctggctctcaggtcgccagatgtgtcatccagatcgacccagtcctccactcccgtccctgtccgtgtctactacgttacgaggaacgacaagtaacctaccaaccacttaccgtaacttcgggacccggggacgtacgtaccggaacgtacctaagttacgtagtaacggtagtttactcgttaaggtaagtttggtaataccgtaaaacggaaacccgaaaaaccggtacggaaaccctaaccgggtaaacccccctttaaaacgtccgtttaacgtaccttacccgtaaccgacgtactaccctaccgtacgttaacgttacgggaaacggtaccggtaccgtacgtaacgtacgtacgtaaggtaggtaagtcggcgttacggacggtacgtaacgttagttttacctacgtaacctacgtacgtacgtacgtacgtcgtacgtccgacgtaacgggtacaaccggtactactacgtacgtaacttaacgttaacttacggtacttacggtaactagtactagtaaccgtcggtacttacccgtacg

SEQ ID NO: 152671 - DNA, 753 bp, Homo sapiens
  misc_feature: GYAE6OF02FXY1O.51.67.G01.1.454.CMB.1.raw
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (245)..(245): a, c, t, g, unknown or other
  misc_feature (245)..(245): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctcctgggctcctgcctgctctggctntcaggtnccagatgtgtcatccagatcgaccagtctccatccctcctagtctgctagtctatagganactagaactcaccatcacgttgccggcgtacgtcgaagtacctaagttagacctataggtactacgtacgtaaagttcggtaacttacgaacgtaaccgtaaaaaaccgcggggtaaacctaacggtaccccctaaaacctccgttaacggtaaccttccgttaaccgaacgtacggtaccttaacgttcccgttaaacgttttaaccgggaaaaccggttccggggtaaaccctaacgttacgtaaaccgggttacgtaacgggttaaggaacggttcggtcccgttaacggttcgggtaaacctaacgtttaccgtttttaaccgttaccctaaccttaacgtcccgttaaccgaacgttacggtaccgtttacggaccgtaacgtcccgtaaagaaccgtaaccgtagttaccgaacttaaccgtaattaaacggtaaccgttacgttaacgtaacgtaaggttaacgtaccgttaacgttacggtacccccgttccgttaaccg

SEQ ID NO: 152672 - DNA, 630 bp, Homo sapiens
  misc_feature: GYAE6OF02HDINV.51.67.G01.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctgctctcaggtgccagntgtgtcntccngatcgaccagtctccactcctccctgtctcgacacttcgtaagtaggacacaagactaccaccatctacgttcggccgggacgacggtcgagataacgttagactgtagtatcgtagtaagttgtactcgaacgaaccaaaaccggtacggaaccaaccgtaccctaactccttacgactcctacgagtgacctactccgtaacgttacgaaccgtaccgggtaccagttacgtaaggtacgtacgtaggtacggtgtacgtacggtacgtacgttacttacttttcgttacacctatactaggacgcggtactacgcgtacgccgtaagtaccgacttaagtacacgtaacttaacgttacgttacgttaactacgtaacgttacgttaattaccgttaacgtccgttaccgtccccgtttaacccgg

SEQ ID NO: 152673 - DNA, 669 bp, Homo sapiens
  misc_feature: GYAE6OF02FT3PV.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcagtccagatcgacccagtcctccgtactccctacccgtgtctgacctagtctagtacggagacagtaactccacctatacgtacgtcggaccgggcgtacggtcgaacggactattagcctagtacgtactctagtaagttcggtaatactaacgaacaaaacgacgacgaccgtaccctaaacgtcgtacgtacgtccgtacgtacgtcgacctacgttaccgtacgttacggaaaccgtccgggtaacctagtacgtaaggtccggtaaggtcgggttaacgtcggtcctacggttacggtatacggtttaactttaccgtacctactagacctaggtacgacgtaccacggtacaccgtctaacggtaaacgtaccgtagttaccgaagtaaccggttattaaacttccggtaactaactaaccggttagtacgttacgaacgtttccttacccggtcccgttaaccgg

SEQ ID NO: 152674 - DNA, 748 bp, Homo sapiens
  misc_feature: GYAE6OF02F342N.51.67.G01.1.454.CMB.1.raw
  modified_base (150)..(150): a, c, t, g, unknown or other
  misc_feature (150)..(150): n is a, c, g, or t
tcagcgatcgtatacacgaccggtgctcgatttagagtatacatagttgggtttgggcacgaccggtgctcgatttagagtatacatactgggtttggggcaggagtcagtcccaaccaggacacagcatggacatgagggtccctgctnagctcctgggctcctgcctgctctggcctctcgaggtcgccagtattcgtgttacacgtccgaagtatacgaccctacgtcctaccctacttcccctcccgttcgtcctacgacctaacttaccgtaacggtaacgacgtaacgaacgtaactaccaacctactacgtacgttccggccggtacgtacgtacgaacgtacgtaacgttagactagtacgtactacgtagttaagttacggtatacgtaagaaaccgtaaaaaccggacggaaaccgacccggtaaccctaacccttaccgacgttacctaccgtagactgacctactaaccttacgttaacggacggtaccggtactacgtaacgtaacggttacgtaaggttaagtacggttcggtaccgtacggtcgggtaaaccttaggtttacctttacccgtttacccgaaccgttctaaccggtcgtaccgtaggtaactaccggtacgcttaaacgaaggttaaaccaacgttgtacgtaactaacgttaattaccggtaattacgtaccgtaaatttaccgacgtttactaaccgtcgtttacccggtacgttaacccgg

SEQ ID NO: 152675 - DNA, 689 bp, Homo sapiens
  misc_feature: GYAE6OF02ISNPD.51.67.G01.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
  modified_base (587)..(587): a, c, t, g, unknown or other
  misc_feature (587)..(587): n is a, c, g, or t
tcagcgatcgtatacacgaccggtgctcgatttagagtatacatattgggtttgggcacgaccggtgctcgatttagagtatacagtattgggtttggggcaggagtcagtcccaaccaggacacagcatggacatgagggtccctgctcaggctcctgggctcctgctgcctctggctctcgnggtcgccagacttgtgtctactaccanacgtccgaacctgtaccttaccacttcccgtccgtcgtcncgtacgtacttactacgtaaggacgaaccgaagtaacctaaccgaaccgttactacgttaccggttcgggccgggtacgtacggtacgtaacgtaactaggttaacgtccgtaagtttccgttaagttaccgtagttaacgtttacgtactacgaacgtaaaccgaaaaccggacggaacctacccgtaacccgttaacctcctaggtacctcgtacgtatcgtactactaccgtacgtacgtacgtcgtacctagtacgtaagtcggagtacggagtacgcttcggacgttagtactttactttactacgtacnctaagngtacgtgcgtcgtanaccgtacgagtaacgtcgtataccataccgttagtttaaccctgttaacgtagtaacgtaggttacgtaccgtttacggccgtttaccgtccgttaacccgg

SEQ ID NO: 152676 - DNA, 599 bp, Homo sapiens
  misc_feature: GYAE6OF02I6M2C.51.67.G01.1.454.CMB.1.raw
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (460)..(460): a, c, t, g, unknown or other
  misc_feature (460)..(460): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtggggctcctgctgctcgtggctctcaggtgccagatgtgtcatccagactgaacccngtcctccagtccctccgtgtccngctatcgtataggagacagactcaccatcacgttcgcggcgtaagtcgagacattagccaatcgtaatctagtaattcggtatccgaagaccaaaaaacgtcgggaacagtccccttaaagcctagtaactcctagaattcgctaacgtccctaagttacggaaaccgtacggggtaccctaataccgtaacggtatacgtagggaacgttggacgttacgngggtacctaggtaacttttacgtacacctatcgacgcaacggtcacgtacgntaccgtanaccgtaacngttacgacctaatcgtaacttacaacgtttaacaacgacgttaactggaaactcgtaccggttcctaccg

SEQ ID NO: 152677 - DNA, 652 bp, Homo sapiens
  misc_feature: GYAE6OF02G4HPU.51.67.G01.1.454.CMB.1.raw
  modified_base (249)..(249): a, c, t, g, unknown or other
  misc_feature (249)..(249): n is a, c, g, or t
  modified_base (553)..(553): a, c, t, g, unknown or other
  misc_feature (553)..(553): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagtatgtgtcatccagatcgacccagtcctccactccctccctgtctgctatctagagganacagaactccaccatctacgtggccgggacgtaggtacgaacgactaattacgactagtagtactcgtagtaagttgtactacgaacgaaaccgaaaaacggacggtaaccaacccgtaaccccttaaacgtccgtaacgtactaccgttacgacgtcgtacctaacgtacccgttaacggtttaacgggaacgtaccgggtaaccctaagttacgtaggtaccgtaggtagggtacgtcggtcggtacggtaggtacttaacgtttacttttaccgtactaacctgacgacggtctacggtcncgacgacgtcgaagtaactatacgtacactaagtcgttaacttacgtaccgtaagtaccgttagttacgtaacgtcttaccggtccgtaccgttaccgg

SEQ ID NO: 152678 - DNA, 763 bp, Homo sapiens
  misc_feature: GYAE6OF02FJB3B.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatcgacccagtctcctatccctcctgtctgctatctagtaggagaacagtaactccaacctatccgtacgttcggaccgggtcgtacgtacggaacgactaagttacggacctagttaggtacttcgtagtaagtttagtactacgtaacgaaacctaaaaaccgacgggaacctaccgtaacccccttaaaacgttcccgacgttactacccggttacgacgttcgacctaaccgttacccgttaacggtttaacggtaaacccggtaccggggttacccaaccggtttaaccggttacggtaaacggttacgggtaaacgttccgggtacgttaccgggtaacgggtaacttaacggtttaactttttaacccgttacctaacgtacgttaccgaacggtaccacgggtaccgtacggtaccgtacgttaccgtaaggaacttaacgtacgttaccgtactaacgttaactttaactttacggtaacgttaacctaacgggttaattaacgttcgttaaccgtttaccggtcccgttacccgttcgttaaccccgggg

SEQ ID NO: 152679 - DNA, 633 bp, Homo sapiens
  misc_feature: GYAE6OF02I7NF6.51.67.G01.1.454.CMB.1.raw
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (338)..(338): a, c, t, g, unknown or other
  misc_feature (338)..(338): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatccctcctgtctgcatctatagganacagatcaacctatcctacttcggccgggngacggtcgaagaccattacgctatgttactcgtagtaagttggtatcgaagaaccgaaaaaccgngggaaccacggtacccctaaactcctagtaccttccgtacgaatcgacacttacctacggtttaggaaccgtcgggtaccctagtacgtaacggttcgaaggttaggaacggtcggtctaggtacggatacgttacttttaccgtacaccgtatacgaacgtcgacggtccgtgacctacgtaccgtaacgaagtacgtacttacgaacgtaactaacgttaattaccggtataacccgtaaacgttaacgttagttaacggtacttaacccggtacccgtccccgttaacccgg

SEQ ID NO: 152680 - DNA, 749 bp, Homo sapiens
  misc_feature: GYAE6OF02GSGGC.51.67.G01.1.454.CMB.1.raw
  modified_base (251)..(251): a, c, t, g, unknown or other
  misc_feature (251)..(251): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtgggctcctgctgcctctggctctcaggtgccagatgtgtcatccagactcgacccagtcctccacttccctcctgtctgctatctagtagganacagtaactccaacctatacgtaccgttcgggacccgggcgtacggtaccgaagaccttaagttacgcgtagttcggtaactcgtagtaacgttggtaactacgaacgaacaaaaccggtacggaaccaccgtaacccctaaacgtccgtacgtacctaccgacgtactagacccttaacgttacccgttaacggtttaacgggaaaccggttaccgggtaccctaagtaaccggttaaggttaccggaaggttagggtaccggtcggtaccgttacggtagggtaaccttaagtttaccgttttacctaccgtacctacgtaccgtacggtaccgtacggtccgttacgaccgttaaccggtacgtaacgaaccgtaaccgtacttaccggaacttaaccgttaaacttaaccgtttaccgtaacgtaaacccgttaattacgttaacgttacggttaaccgtttaacccggttccccgttaacccgtttacccggg

SEQ ID NO: 152681 - DNA, 709 bp, Homo sapiens
  misc_feature: GYAE6OF02GE7KV.51.67.G01.1.454.CMB.1.raw
  modified_base (188)..(188): a, c, t, g, unknown or other
  misc_feature (188)..(188): n is a, c, g, or t
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtgggctcctgctgctcgtggctctcgaggtnccagtactgtgtcatccagatcgacccctagtcctccacttccctcctgtctgcacttctaagtaggacacagtaactccacctatctacgtgccggctagcgacgactataggacattgtactcgtacgttaagtttggtactacgaacgtaaaccgtaaaaaccggccggaaaccgaaccgtaacccccttaacgttacccgtaacgtacttacccgacgtacgtccgaccttaccgtaaccctttaacgggtttaaaccgggaaccggttaccggggttaaacctaccgtaacgttaaacgggttcgaaagggtggtaaacggttcggaccgttacggtacggtaaacttacggttttacttttaccgtacccgtaacctacgtacgacgttacggacggtcctagaccgtaacgtccgaagtaacctacggtaccttgaaccttacgtaatttaccttaacggacttaacgtaacgtcgttagtaaccgtctttaaccgtcccgtacgttaacccgg

SEQ ID NO: 152682 - DNA, 642 bp, Homo sapiens
  misc_feature: GYAE6OF02FU0P8.51.67.G01.1.454.CMB.1.raw
  modified_base (273)..(273): a, c, t, g, unknown or other
  misc_feature (273)..(273): n is a, c, g, or t
  modified_base (324)..(324): a, c, t, g, unknown or other
  misc_feature (324)..(324): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagcgatcgtatacacgaccggtgctcgatttagagtatacatattgggtttgggcacgaccggtgctcgatttagagtatacatattgggtttgggggcaggagtcagtcccaacaggacacagcatggacatgagggtccctgctcagctccgtgggctccgtggctgctcgtggctctacgaggtcgcagatgtgtcactcgagatcgaccagtctccactccctcccgtgtcgtcgactactacgtagtaggacggtaaccagtaacnccacacgtctacgttcggccgggacgtacggagtacggacctaagtaggtnaacttggtatcgtaggtaacttggtatacgagtaacccaaaaacgtacggacaaccgtaacccgtaacctacgacgtctaccgtgctcgactctccgtagtacggaacggtccggtacagtacgtaacggtgacggagtagtcgnggtcnggtactagttactttcgactactacgtcacgctacgcgtcggacgaccgtaccgtaaggtaacacgtaacttccggaaactacggtaacgttaacttttccgaaccgtttaaacgagtttaaccttgggttaactaacccggtttccgtaccccgttgtaacccccgg

SEQ ID NO: 152683 - DNA, 755 bp, Homo sapiens
  misc_feature: GYAE6OF02HSJC5.51.67.G01.1.454.CMB.1.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagcctccgtgggctcctgctgctctggctctcaggtcaccagatgtagcactccanactcgacctgtcctccactccctcctggtctagactagtacgtaagtacggacgaacaacgtaactccacctataccgtacgttcggcccgggagtcgtacgagtaactacgttanaccgtattactacgtacgtacgtaagttcgtaatacgaaacgaaacgtaaaacggtaggaacctaccccgtaaccttaacgtccgtataacggtacctcggtaactacgtccgtaaaccgttaccgtttaacgggttaaccgggaaccgggttaccggtaaccgtaacgtaaccgttaacgggtacgtaacgggttaacgggtaacggtcggtacgtacgggtacgggtaacgtttaaaccgtttaacgtttttacccgtaacgtaaccgttacgaacgtacggtaccgtacggtacgtcgtacgtaacggtacctaaggtaaaccgttagacgttaacgaccttaacgtaacgtttaaccttacgtacctaaccggttaagtacggttaccgtaagtttaccgttacccggttacccgtaccggtttaaccgg

SEQ ID NO: 152684 - DNA, 782 bp, Homo sapiens
  misc_feature: GYAE6OF02HF28Z.51.67.G01.1.454.CMB.1.raw
tcagcgatcgtatacacgaccggtgctcgatttagagtatacatattgggtttgggcacgaccggtgctcgatttagagtatacatattggggtttgggggcaggagtcagtcccaaccaggacacagcatggacatgagggtccctgctcagctccgtggggctcctgctgctctggctctcgaggtgccagatggtgtcatccgagatacgacccctagttcctaccacttccccttccccttggttcctcgacacttcttagtagggacgtaacaagtaactaccaaccgtactaccgtacggttccgggaccggggtacgtacggtacggaacgaactaagttacggcctaggtacgttacttccgtaggtaacgtttagttaactccgaaacgaaaaccgaaaaaccggtcgggaaaccctaacccgtaaccccttaaacctccgttacggtaaccttccgtacgtatacgactaacttacccgttaacgtttaacgggaaaccggtaccgggtaccctagttacggtaacggttacgaacgggttagggaacggttcggtaccgttacggtacgggtaacttaacgttttacgttttaccttacccgaacttactcgaacggtcctacgtcccgtaccgtaaccgttacgtaacgtcttaccgttataacctaattaccgtttaactttaaccgtcgtaaaccgtaattaccgggtaattaacgtaacctttacccgttaccccggttaccttaaccgttccgggtttaaccgggg

SEQ ID NO: 152685 - DNA, 700 bp, Homo sapiens
  misc_feature: GYAE6OF02JT6EB.51.67.G01.1.454.CMB.1.raw
  modified_base (614)..(614): a, c, t, g, unknown or other
  misc_feature (614)..(614): n is a, c, g, or t
  modified_base (650)..(650): a, c, t, g, unknown or other
  misc_feature (650)..(650): n is a, c, g, or t
tcagcgatcgtatacacgaccggtgctcgatttagagtatacatattggggtttgggcacgaccggtgctcgatttagagtatacatattggggtttgggggcaggagtcagtcccaaccaggacacagcatggacatgagggtccctgctacagctccgtggggctccgtgctgctcgtggctctcgaggtgccagagttgtacgtcacgtccgaaggactacgaccctacgtcctaccctactcccgtccctgtctgcctagttactagtacggagaacgtaagtaactaccgaactactaccgtaacgttcgggccgggtaacggtacgtaccggaacgaacgtacgttacgcttaagtacgttactacgtagtaacgtttaggtactagaacgaaaccgaaaacggaccggtaaccacccgttaacccgtaaacgttccgtaacgtaccttcgacggtaactcgtaactaaccgttccgtaacgggtttaacggaacggtaccgggtacctaagtacggtaacggtcgtaaggtcgggaaggttacgcggtaacgtcggtacttaacggttactttacgtcaacttacgcgtaaagtccgtaggccgttnaacgtcgtacgaaacgacgaattgctaacgttaaancgtttaccagacttaacagttagttaccagtcgttacaccggtctaacgg

SEQ ID NO: 152686 - DNA, 779 bp, Homo sapiens
  misc_feature: GYAE6OF02HJ64D.51.67.G01.1.454.CMB.1.raw
tcagcgatcgtatacacgaccggtgctcgatttagagtatacatattgggtttgggcacgaccggtgctcgatttagagtatacatattgggtttgggggcaggagtcagtcccaaccaggacacagcatggacatgagggtccctgctcagctccgtggggcctcctgctgctcgtggctctcgaggtcgacctaggatcgtgtctataccgaagacgtacgacccgtaggttacctaccctacttccccttcccgttcggtctcgacctagtctaaggtaggtacgaacaagtaaccttaccgaacctagtacctacgtttcggccgggtacgtacggacggaacgtacgttaacttagtaccaagtttacgtacttccgtaagttaagttaggaccttacggaaaaccgaaaccggaaaaaccgggacgaacccgtaaaccctaaccccgttaaactcccgttaacgtaacccgtaccgtacgtacgtacgtaaccttaaccgttaccgttaaacggtttaaccgggaaccggggtaaccgggtaccctaacgtaaccgttaaacggttcggtaacggtacgggtaacgggtcggtacgtcggtaggtaccgttacggtttacttttacctacgtacctagtacgacgacgtcgtcgtacgacgaccgtaggacttaacgatttacgactaaacacgttaacgttactaaccgttaacaacggtaatacggttaacgttacgtaaccgtttcgtaccccgttaccggttaacccgg

SEQ ID NO: 152687 - DNA, 674 bp, Homo sapiens
  misc_feature: GYAE6OF02HJQ26.51.67.G01.1.454.CMB.1.raw
  modified_base (181)..(181): a, c, t, g, unknown or other
  misc_feature (181)..(181): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (634)..(634): a, c, t, g, unknown or other
  misc_feature (634)..(634): n is a, c, g, or t
tcagcgatcgtatacacgaccggtgctcgatttagagtatacatattgggtttgggcacgaccggtgctcgatttagagtatacatattgggtttggggcaggagtcagtcccaaccaggacacagcatggacatgagggtccctgctcagctccgtggggctcctgctgctctggctctnaggtgccagatgtgtcatccagatcgacccagtcctccactcctcctgtctgctatctatagganaacganaactaccacctatcctacgttcgccggganacggtacgagacctagttacgacgtattaggtacttaccggtagtaagttaggtaactacgaacgaaacccgtaaaaaacggcgggaaccaaccgtacccctaaaccttccgtacgtaaaccgtccgttaacggtacttacgacctaaccttccgtaacgtttacggaaacgtaccgggtaacccagttaacgtaacgggttacgaggtaaggtacgttcggtactcggaggtaaacgtgttttacttttacccgttacaacctacgttaccgaacgtcgtaacgttcgtcgaccgtaacgttacccgaaggtaatacccgtattaccggaatacgttaagttactacggtntaacctacgtagtacaggttacctacgccttaccgtaccg

SEQ ID NO: 152688 - DNA, 494 bp, Homo sapiens
  misc_feature: GYAE6OF01C9IKG.25.83.H06.1.454.CMB.1.raw
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
tcagactgtacagtcacgaccggtgctcgatttagatcacgtgcgtcgcgggggagctacaacaggcaggcaggggcagcaagatggtgttgcagaccccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttactgggcatctaccgggaactccgggtcctgaccgattcagtgcagcggtctgggacagatttcactctcaccatcagcagcctgcaggctgaagatgtgctagtttattactgtcagctaatattatagtactcctccgacgttcgccagggaccaaggtggaaatcaaagactgtagntgnacctag

SEQ ID NO: 152689 - DNA, 529 bp, Homo sapiens
  misc_feature: GYAE6OF01EGWGM.25.83.H06.1.454.CMB.1.raw
  modified_base (405)..(405): a, c, t, g, unknown or other
  misc_feature (405)..(405): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcagaaaccaggacagcctcctaagctgctcatttactgggcatctacccgggaatcccggggtcctgaccgattcagtggcaggcggtctgggacagatttcactctcaccatcagcagcctgcaggctgaanatcgtgctagtttatacgtgtacagctaaattattatagtacctcctccgtacggttcggaccgtaggggaaccctaagggtacggaaactcgaaaacgtacgtgtaggacctggccacctacg

SEQ ID NO: 152690 - DNA, 511 bp, Homo sapiens
  misc_feature: GYAE6OF01AC15B.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttactggcatctacccgggaatccgggtccctgaccgattcagtgcagcggtctgggacagatttcactctcaccatcagcagcctgcaggctgaagatgtggctagtttattactgtcagactaatattatagtactcctccgacgttccggccaggggacccaagggtaggaaactacgaaaacgaactggtaggactgccacgtac

SEQ ID NO: 152691 - DNA, 531 bp, Homo sapiens
  misc_feature: GYAE6OF01B0T82.25.83.H06.1.454.CMB.1.raw
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacngggcatctacccgggaatcccggggtcctgaccgattcagtggcagcgggtctgggacagtatttcactctcaccatcagcacgcctgcaggcagaagntgtggctagtttattactgtcagactaattattatagtacctcctccggtacgttccggaccgaggggtaccaagggtacggaaacgtaccgaaaacgaactcggtagtcctgcctaacctacg

SEQ ID NO: 152692 - DNA, 544 bp, Homo sapiens
  misc_feature: GYAE6OF01BN6TO.25.83.H06.1.454.CMB.1.raw
  modified_base (308)..(308): a, c, t, g, unknown or other
  misc_feature (308)..(308): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacnggcatctaccggaatccgggtcctgaccgattcagtggcagcggtctgggacagattcactctcacatcagcagcctgcaggctagaacgatgtgctagtttatactgtacagctaattattatagtacctcccgtccgtacgtttccggaccgtaacgggggaacctaaagggttaggaaaactaccgaaaaacggtaaccgttagggtacggtacctcgaccgtaaccctaacg

SEQ ID NO: 152693 - DNA, 500 bp, Homo sapiens
  misc_feature: GYAE6OF01B8U5F.25.83.H06.1.454.CMB.1.raw
  modified_base (308)..(308): a, c, t, g, unknown or other
  misc_feature (308)..(308): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacngggcatctacccgggaatccgggtcctgaccgattcagtggcagcggtctgggacagatttcactctcaccatcagcagcctgcaggctgaagatgtgctagtttatactgtcagctaatattatagtactcctccgacgttcggaccgtaggggaccaaggtaggaaatcaaacgactgtagctgcactac

SEQ ID NO: 152694 - DNA, 516 bp, Homo sapiens
  misc_feature: GYAE6OF01D06K0.25.83.H06.1.454.CMB.1.raw
  modified_base (340)..(340): a, c, t, g, unknown or other
  misc_feature (340)..(340): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggatccgggtcctgaccgntcagtggcagcggtctgggacagatttcactctcaccatcagcagcctgcaggctagaagatgtggctagtttattactgtcagtactaattattatacgttacctcctaccgtacgttccggaccgaggggaaccaaggtacggaaatacgaaacgactagtaggctcgcactac

SEQ ID NO: 152695 - DNA, 509 bp, Homo sapiens
  misc_feature: GYAE6OF01BSFV5.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactggcatctacccgggaatccgggtcctgaccgattcagtggcagcggtctgggacagatttcactctcaccatcagcagcctgcaggctgaagatgtgctagtttatacgtgtacagctaattattatagtacctcctccgacgttcgaccaggggaccaagggtaggaaactcgaaacgacgtgtacgactgccacgtacg

SEQ ID NO: 152696 - DNA, 632 bp, Homo sapiens
  misc_feature: GYAE6OF01DEBU0.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcattttctctgttgctctggatctctggtgcctacggggacttcgtgatgacccagtctccagactccctggctgtgtctcgtgggcgaggagggccaccatcaactgcaagtccagccagtagttgttttttacacgtctaccgaacaaataagaacttacttagcttaggcaccagacaagaaaccaggacacgcctactaagctacgctactatttacgtggactacgttaccgtacccgggaacgttcccggggtccctacggaccgtatttcgaggttcgggcgtacgggccgggttacggtagggaccgtaaggtacttttccgacttccgtaccaaccctatccgagcacgtccgtacgcgacgggctaggaacgtgttggtggtactagttttactagtgtacagtactaattattactacgttacctccgtaccgtcggttaccggaccggaacggggtaaccgtaaggtaacggaacctaacgaaacgtacgttaggacgactcgtacgacctacg

SEQ ID NO: 152697 - DNA, 533 bp, Homo sapiens
  misc_feature: GYAE6OF01BKTRM.25.83.H06.1.454.CMB.1.raw
  modified_base (366)..(366): a, c, t, g, unknown or other
  misc_feature (366)..(366): n is a, c, g, or t
  modified_base (519)..(519): a, c, t, g, unknown or other
  misc_feature (519)..(519): n is a, c, g, or t
tcagactgtacagtcacgaccggtgctcgatttagatcacgtgcgtcgcggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggctatcgtacccgggaatcccgggtcctgaccgattcagtgcgagcggtctgggacngattcgactctcaccatcagtcagccctgaccgaggctagaagatggtgctagtttattactgtcagtactaattacttatagtacctccgtcgtaccgttccgaccgtacggggacctaagggtcgtaaactacgaaacgtacgtgtacggntacgcgtacctacg

SEQ ID NO: 152698 - DNA, 635 bp, Homo sapiens
  misc_feature: GYAE6OF01DHG1J.25.83.H06.1.454.CMB.1.raw
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggcgaggacgggccaccatcaactgcaacgtccagccagtagttgtttttacagtctaccgaacaataagaactacttagcttggaccacagacaagaaaccaggacacgcctactaagctgctactactttacgtggactacgtaccgtaacccgggtaacgtcccggggtccctacggaccgtaattcgaaggtcggacgacggcggtcgtaggactagtattcgactcgtaccaccatcagcacgcctgacnggctaggaagtnttggtaggtacttttaaggtttaactacgtcgtaacacgtaattaaatttacgttaattaccggttaccctccggttaccggtacggttcccgggacggaacgggtaaccgtaagggtaacgtaaacgtaaccgtaaaaccggttacgtcgggaacggtcctacgggacctacgtacg

SEQ ID NO: 152699 - DNA, 573 bp, Homo sapiens
  misc_feature: GYAE6OF01C62T3.25.83.H06.1.454.CMB.1.raw
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (562)..(562): a, c, t, g, unknown or other
  misc_feature (562)..(562): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagaggccaccatcaactgcaagtccagccagagttgtttttacagctccgacaataagaactactagcttgcaccagcaagaaaccaggacagccctactaacgctgctctactttactgggctactaccgtaaccccgggaagtcccggggtccctcgaccgtattacaggtggcacggtcgggtcngggtacnggtacttcacttcacaccatcagcacgtcctgacgaggccgtagaacgagtggtcggacttaagttttacttacgttgtacacgtaactaagtttattaattacgtcctccctcggtaccgtccggacgacggggactaagggtacgtaaacgtacaaacggtcgtaggtcggancgctccgtacg

SEQ ID NO: 152700 - DNA, 777 bp, Homo sapiens
  misc_feature: GYAE6OF01B6JXL.25.83.H06.1.454.CMB.1.raw
  modified_base (493)..(493): a, c, t, g, unknown or other
  misc_feature (493)..(493): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacgggggacttacgtgtagagtaccgaccgtagtccctaccgaacgtacccttccggtcgtcgttggttcgttccttcgggtcggggacggaaggggaccgggacccaacctactaacctaacgtcgaacgtaaccgtaccgaccgaccgaaggttagtttttacgttttaacgcgtcccgtaccgaaataaagtaaacgtaaccttaacgtacgttcggttcggaccaacgacgacgaaaaccgaaaccggacggtaacgaccgtccctaacgaacgtcgtcgtcctacttaactttcgggcggactacgtaccccggtaaccggtacgggtccccgggtcacggactctacgnggtcgagcgggtccgtggtacggacagtttactaccacttcaccaacgtctacgacgcgaccgtcgacgacggcgtcgtaaaggaaagtggtggtacgacgttttaagtttactacggttcaacgacgtaaactaaatttagttaacgttacttacccctacccggtacggttacccggtacccgggacggggtaaaccgggtaaaccggtaagggttaaaccgaaacctaaacccgggtaaaacggttcgttagggtacggttacctccggaacccctaaacg

SEQ ID NO: 152701 - DNA, 550 bp, Homo sapiens
  misc_feature: GYAE6OF01DSNDI.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcagaaaccaggacagcctcctaagctgctctatttactggcatcctacccgggactccgggtccctgaccgattcagtcggcaggcggtcgtgggacagtatttcactctacaccatcagcagtcctgcaggctaggaagattggtgtactagttttattacgtgttacagtactaattattaatacgttacctaccgttccgtacgttcccggaccgtaacggggacctaagggtaggaaactacgaaaacgtacgtggtagacctcgccacgtacg

SEQ ID NO: 152702 - DNA, 548 bp, Homo sapiens
  misc_feature: GYAE6OF01EHN3G.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgacaagtccagccagtagttgtttttacagctccgacaataagaactacttagcttggcaccagcagaaaccaggacagcctcctaagctgctcatttactgggcatcctacccgggaatcccgggtcctgaccgtattcagtggcaggtcgggtctcgggacagtactttcactctacaccatcagcagcctgcacggctggaacgtagtgtggctagtttactactgtacagtactaattattatagtacctccgtaccgtacgttccggaccgacggggtaccaaagggtacggaaaactacgaaaacgaacgttgtacggactcgcctactacg

SEQ ID NO: 152703 - DNA, 541 bp, Homo sapiens
  misc_feature: GYAE6OF01CB02H.25.83.H06.1.454.CMB.1.raw
  modified_base (308)..(308): a, c, t, g, unknown or other
  misc_feature (308)..(308): n is a, c, g, or t
  modified_base (404)..(404): a, c, t, g, unknown or other
  misc_feature (404)..(404): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacngggcatctacccgggaatccgggtcctgaccgattcagtggcagcggtctgggacagtatttcactctcaccatcagccagcctgcaggctgaagntgtgctagtttattacgtgtacagactaattatttatacgtaccttccgtcccggtacgttccggaccgtagggggaaccctaagggttaggaaacttaccgaaaacgtacgtggtacggacctcggaccacctacg

SEQ ID NO: 152704 - DNA, 570 bp, Homo sapiens
  misc_feature: GYAE6OF01D52M2.25.83.H06.1.454.CMB.1.raw
  modified_base (414)..(414): a, c, t, g, unknown or other
  misc_feature (414)..(414): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaggagggccaccatcaactgcaagtccagccagtagttgtttttacagctccgacaataagaactacttagcttggcaccagcagaaaccaggacagcctcctaagctgctcatttactgggctatcgtacccgggatcccggggtccctgaccgattcagtggcaggcggtctgggacagtattcactctcaccatcacgcagtcctgcaggtctaggaanagtggtaggcgttagttttactacgtgtacacgtactaattagtttattaacttaccgttccgtaccgtacggttccgcgtaacgggggtaacctaagggtacgtaaagtaccgaaaacggtacgtaggtacggtaccgtacgtacaccgttaacg

SEQ ID NO: 152705 - DNA, 548 bp, Homo sapiens
  misc_feature: GYAE6OF01AN4GD.25.83.H06.1.454.CMB.1.raw
  modified_base (320)..(320): a, c, t, g, unknown or other
  misc_feature (320)..(320): n is a, c, g, or t
  modified_base (426)..(426): a, c, t, g, unknown or other
  misc_feature (426)..(426): n is a, c, g, or t
tcagactgtacagtcacgaccggtgctcgatttagatcacgtgcgtcgcgggggagctacaacaggcaggcaggggcagcaagatggtgttgcagaccccaggtcttcatttctctgttgctctggatctctggtgcctacggggacttcgtgatgacccagtctccagactccctggctgtgtctctgggcgagagggccaccatcaactgcaagtccagccagtagttgtttttacagctccgaacaataagaactacttagcttggcaccagcaagaaaccaggacacgcctacctaagcctgcctactatttacgngggcagtccgtacccgggaagtcccggggtccctgaccgattcgagtggcaggcgggtctgggacagtactttcactctcaccatcgagcagcctgcagctagagntgtgctagtttattctgtacagactaattattatactaccttccgtccgtacgtccggaccgaggggacctaagggtacggaaactaccgaaacgtacgttaggcgtacgtacgcacgtacg

SEQ ID NO: 152706 - DNA, 509 bp, Homo sapiens
  misc_feature: GYAE6OF01A4MLJ.25.83.H06.1.454.CMB.1.raw
  modified_base (503)..(503): a, c, t, g, unknown or other
  misc_feature (503)..(503): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctaccgggaatcccgggtcctgaccgattcagtggcagcggtctgggacagatttcactctcacatcagcagcctgcagctagaagatgtggctagtttatactgtacagactaattattatagtacctccgtcgacgttcgaccgagggaccgaaggtaggaatacgaaacgacgtgtacgactcgcncgtacg

SEQ ID NO: 152707 - DNA, 617 bp, Homo sapiens
  misc_feature: GYAE6OF01B7KH5.25.83.H06.1.454.CMB.1.raw
  modified_base (316)..(316): a, c, t, g, unknown or other
  misc_feature (316)..(316): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaggagggccaccatcaactgcaagtccagccagtagttgtttttacagctccgacaataagaactactagcttggcaccagacagaaaccaggacacgcctacctaagctgctactatttacngggacacgtccgtaacccgggaactcccggggtccctacggaccgtattcgacggtcggcgaggtcggtcgtaggacagtactttcactccgtacacatcacgtcacgcctgcgaggctaggagagtggtagtactaggtttacttcgtagtacgagtacttaattatttaacgtacgttacccttcccggtaccggtaaccggttacgggacccggtaacggggtaccctaagggttaacggaaaaccgtacgaaaacccgtacggttcggtaccggtacgtacgacccgccgttaaccg

SEQ ID NO: 152708 - DNA, 545 bp, Homo sapiens
  misc_feature: GYAE6OF01AXCPP.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaccaggacagcctcctaagctgctcatttactggcatctaccgggaatccggggtcctgaccgattcagtgcagcggtctagggacagtatttcactcctacaccgatcagtcagtcctgccaggctgaagtagtgtcggctaggttttaacttactgtcacgtactaattacgttatacgtactcccgtccgtacgttcggacccgagggtacccaagggtacggtaaactacgaaaacgtacttcggtacggacttcggccaccgtac

SEQ ID NO: 152709 - DNA, 508 bp, Homo sapiens
  misc_feature: GYAE6OF01EBT18.25.83.H06.1.454.CMB.1.raw
  modified_base (500)..(500): a, c, t, g, unknown or other
  misc_feature (500)..(500): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttactgggcatctacccgggaatcccggggtcctgaccgattcagtggcagcggtctgggacagattcactctcaccatcagcagcctgcaggctgaagagtgtggctagtttattactgtcagcaatattaatagtactcctccgacgttcggccaggggaccaaggtggaaatacgaaagaacgtgtaggactcgnacctaacg

SEQ ID NO: 152710 - DNA, 517 bp, Homo sapiens
  misc_feature: GYAE6OF01B1XHB.25.83.H06.1.454.CMB.1.raw
  modified_base (319)..(319): a, c, t, g, unknown or other
  misc_feature (319)..(319): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
tcagactgtacagtcacgaccggtgctcgatttagatcacgtgcggttcgggcgggggagctacaacaggcaggcagggggcagcaagatggtgttgcagacccaggtcttcatttctctgttgctctggatctctggtgcctacggggacttcgtgatgacccagtctccagactcccgtggctgtgtctctgggcgagagggccaccatcaactgcaaggtccagccagagttgtttttacagctaccgacaataagaactacttagcttggccaccagacagaaaccaggacagcctcctaagctgctcatttacngggcatctaccggaatccgggtcctgaccgatcagtgcagcggtctgggacagattcactctcgacatcagcagcctgcagctgaanatgngctagtttatacgtgtcagctaattattatagtactcctccgtacgttcggtacgacggggacagggtacgaactacgaaagactaggtgaccgtcgccgacgtacg

SEQ ID NO: 152711 - DNA, 558 bp, Homo sapiens
  misc_feature: GYAE6OF01CWC9V.25.83.H06.1.454.CMB.1.raw
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcaagaaaccaggacagcctcctaagctgctcatttacnggcatctacccgggaatccgggtccctgaccgattcagtggcaggcggtcngggacaggtatttcactctacaccatcagcagcctgcaggctagaagatgtggtactagtttaattactgtacagtactaattattactaagttacctccctaccggtaccgtttccgggacccgaacgggggtaaccctaaagggtacggaaaacttaccgaaaacgtaacgttggtacggatcgccgtacctaacg

SEQ ID NO: 152712 - DNA, 490 bp, Homo sapiens
  misc_feature: GYAE6OF01ETPKT.25.83.H06.1.454.CMB.1.raw
tcagactgtacagtcacgaccggtgctcgatttagatcacgtgcgtcgcgggggagctacaacaggcatgcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttactggcatctacccgggatccggggtcctgaccgattcagtggcagcggtctgggacagatttcactctcaccatcagcagctgcagctgaagatgtgctagtttattactgtacagctaattattatagtactctccgacgtcgacgagggacaaggtgaaatcaaacgtactgtaggctgctac

SEQ ID NO: 152713 - DNA, 791 bp, Homo sapiens
  misc_feature: GYAE6OF01B5PT7.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaggagggccaccatcaactgcaagtccagccgagtagttgtttttacaggcctaccgaactaaactaaagaaccttacttagtcttaggccaaccagacaacgaaaccaaggacacgcctacctaagctgctctatttacgtgggcctaacgtacccgtaaccgggtaaacgttcccggggtccctacggtaacccgatttaccgacggttcgggccgtaacgggtcgggtacgtacgggactaaggtactttaccaaccgttcctaccaacctactccaacggaccacggtcccgtacggaccgacgggtaccgttaaggaaaggtacggttacgggttacggtaccgtttaacggtttttaaaccgtttaccggttacggttaacccgtaaagggtaaccttaaaagtttaacgttttaaacgttaaccgtttacccgtaaccccgtttaccccgggtaacccgggtttacccgggtacccggaacgggggtaaacccggttaaaaggggtaaccggtaaaaacgttacccggaaaaaaccggttacggtaccggggttacgtacccggtacggtaacccgaacccgtttaaaccg

SEQ ID NO: 152714 - DNA, 568 bp, Homo sapiens
  misc_feature: GYAE6OF01AWGLY.25.83.H06.1.454.CMB.1.raw
  modified_base (308)..(308): a, c, t, g, unknown or other
  misc_feature (308)..(308): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactactagcttggcaccagcagaaacccaggacagcctcctaagctgctcatttacnggcatctacccggaatccgggtcctgaccgattcagtggcagcgggtctgggacagtattcactctcaccatcagcacgcctgacaggcctaggaacgtagtgtcggtactaggttttaacttacgtcgtacagactaattattataacgttacctccgtaccggtacgttccggaccgtaacgggggtaccaaagggttaggtaaaactaccgaaaaccgtaacgttacgggtacggacttacgaccgtaaccttaacg

SEQ ID NO: 152715 - DNA, 693 bp, Homo sapiens
  misc_feature: GYAE6OF01B1U2I.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggcgagagggccaccatcaactgacaagtccagccagtagttagtttttacagtctaccgaacaaataaagaacttacttagtcgttaggcaccagacaacgaaaccaggacacgcctacctaagctcgactactagttacgtgggacacgttaccgtaacccgggtaacgtccccggggtaccctacggaacccgtattaccgaggtacggacgacgggtccgggttacgcgggtaactaggtactttaccaccttccgtaacctacccgaattccgaacgtccgaacggtccctacgggacgtaacgggtacttaggaaagtacggttggtaccggtacgttaagtttttaacgtaacgttcggtaactaacgtaacctaattaaactttaagtacgttaccctcccgtaccggtaccggttccggaccggtaacggggtaacctaagggacggtaaaatccgtaaaacgacgttacgacggactcgtaacccgcttaacg

SEQ ID NO: 152716 - DNA, 655 bp, Homo sapiens
  misc_feature: GYAE6OF01CXBLN.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactactagcttggcaccagcagaaaccaggacagccctactaagctgctcatttactgggcatcgtacccgggaatccgggtcctgaccgatcagtggcaggcgggtctgggacaggtatttacacttcctacaaccacttacgagccaacgtcccgtagcccgagggcctagaaacggagttggttacggaccttaaggtttttaactttaccgttggtaccgtaagtacccttaaagttaaatttaacgtttaacgttaccctttaccccgtacccggttaaccggtttcccgggacccggtaacgggggaaacccgtaaaggggttaacggtaaaaactcccggaaaaaaccggtacttcggggttaacggacccgttacggacccgtaacccgttaaccg

SEQ ID NO: 152717 - DNA, 565 bp, Homo sapiens
  misc_feature: GYAE6OF01AYASL.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcagaaaccaggacagcctcctaagctgctcatttactgggctatcctacccgggaactcccgggtccctgaccgtattcagtggcaggcggtcgtgggacagtacttcactctcacctatcagcagcctgcaggctaggaagacgtggtcggactagttttactacgtgtacagtactaaagttactttaagtacgttaacctcccgttaccgtaccggttcggacccggtaacggggaacctaagggtaggtaaacaccgaaaacgtactggtacggatcggccaacgtacg

SEQ ID NO: 152718 - DNA, 536 bp, Homo sapiens
  misc_feature: GYAE6OF01A4DLG.25.83.H06.1.454.CMB.1.raw
  modified_base (403)..(403): a, c, t, g, unknown or other
  misc_feature (403)..(403): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcattactggcatacgtacccgggaatccgggtcctgaccgatcagtgcagcggtcgtggacagtattcactctcaccatcagcacgcctgcaggctagaacgntagtcggtactagtttattactgtacagactaattattatacgtacctccgtccgtacgttcgaccggacggggacctaagggtacggtaaactacgaaaacgtacgtggtacggtcctcgaccgtaactacg

SEQ ID NO: 152719 - DNA, 567 bp, Homo sapiens
  misc_feature: GYAE6OF01EARXG.25.83.H06.1.454.CMB.1.raw
  modified_base (412)..(412): a, c, t, g, unknown or other
  misc_feature (412)..(412): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctcagactccctggctgtgtctctgggcgagagggccaccatcaactgcaagtccagccagagtgtttttacagctccgacaataagaactacttagcttggcaccagcagaaaccaggacagcctcctaagctgctcatttactgggcatcctaacccgggaatcccgggtcctgaccgattcagtggcaggcgggtctgggacaggtactttcgactcctcaccatcagcagcctgcaggctagaagntggtgactagtttattactgtacagactaattattatacgttacctcccgtcgtaccgttcgggaccgagggggtaaccctaaagggtacggtaaaactaccgaaaaacccggtaacgttacggtacgggtaccttacggccgtaaccgtaaccg

SEQ ID NO: 152720 - DNA, 559 bp, Homo sapiens
  misc_feature: GYAE6OF01AKFRM.25.83.H06.1.454.CMB.1.raw
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagactgtacagtcacgaccggtgctcgatttagatcacgtgcgtcgcgggggagctacaacaggcaggcaggggcagcaagatggtgttgcagaccccaggtcttcattttctctgttgctctggatctctggtgcctacggggacttcgtgatgaccccagtctccagactccctggctgtgtctctgggcgagagggccaccatcaactgcaagtccagccagagttgtttttacagctccgacaataagaactacttagcttggcaccagcagaaaccaggacagcctcctaagctgctcatttactgggcatccgtacccgggaatcccggggtcctggaccgattcgagtggcaggcggtctgggacagtatttcactcncacatcagcagcctgcagctagagngtgngctagtttatactgtacagacgtaattacttaattacggtaccttcccgtaccgtacggtttccggacccgtaacggggaccgtaaagggtacggtaaacgtaccgaaaacgtacgttacggtacgactcgacctaccctacg

SEQ ID NO: 152721 - DNA, 499 bp, Homo sapiens
  misc_feature: GYAE6OF01BASZ6.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgttttttacagctccgacaataagaactacttagcttggcaccagcagaaaccaggacagcctcctaagctgctcatttactggcatctacccgggaatccgggtcctgaccgattcagtggcagcggtctggacagatttcacgtctcaccatcagcagcctgcaggctgaagatgtgctagttattatgtcagcaaatattatagtactcctcgacgttcggaccaggggaccaaggttaggaaatcaaacgactgtcggatgcacgtac

SEQ ID NO: 152722 - DNA, 627 bp, Homo sapiens
  misc_feature: GYAE6OF01EJDAN.25.83.H06.1.454.CMB.1.raw
tcagactgtacagtcacgaccggtgctcgatttagatcacgtgcgtcgcgggggagctacaacaggcaggcaggggcagcaagattgtgttgcagacccaggtcttcatttctctgttgctctggatctctggtgcctacggggacttcgtgatgacccagtctccagactccctggctgtgtctcgtgggcgaggacgggccaccatcaactgacaagtccagccagtagttgtttttacagctaccgacaataagaactacttagcttggcacagacaagaaaccaggacacgcctactaagctagcctactatttacgtagggcctaatacccggtaacccgggaacgtccccggggtcctacgaaccgtacttcgaggtggcgaggtcgggtacgtagggactaggtactttcacgtctaccgaccactacacgacacgcctagccgaggactaggaacgtagtggtacgtattaagttttatacgtagtacgtaagtactaaattattaacgtacgtaacctccgtacggtaccggttccggaaccggtacggggaaccgtaagggtaacggaaaataccgaaaaggttaccgtaggttacggacttacgcctaaccgtacg

SEQ ID NO: 152723 - DNA, 544 bp, Homo sapiens
  misc_feature: GYAE6OF01BLU5Q.25.83.H06.1.454.CMB.1.raw
  modified_base (311)..(311): a, c, t, g, unknown or other
  misc_feature (311)..(311): n is a, c, g, or t
  modified_base (409)..(409): a, c, t, g, unknown or other
  misc_feature (409)..(409): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcaagaaaccaggacagcctcctaagctgctacatttacngggcatcgtacccgggaatcccggggtcctgaccgattcagtggcagcgggtctgggacagtattcactctcaccatcagcagcctgcaggctagaanagtgtgctagttttactactgtacagactaattattaattagtacctcgtccgtacgttcggacccgtaaggggacccgaaggtacggaaaactacgaaaacgtacgttaggtacggtacctacgccaccgtacg

SEQ ID NO: 152724 - DNA, 555 bp, Homo sapiens
  misc_feature: GYAE6OF01A5X7Y.25.83.H06.1.454.CMB.1.raw
  modified_base (183)..(183): a, c, t, g, unknown or other
  misc_feature (183)..(183): n is a, c, g, or t
  modified_base (316)..(316): a, c, t, g, unknown or other
  misc_feature (316)..(316): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (471)..(471): a, c, t, g, unknown or other
  misc_feature (471)..(471): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatgacccagtctccagactccctggctgtntctctgggcgagagggccaccatcaactgacaagtccagccagtagttgtttttacagctaccgacaataagactacttagcttggcacagcacgaaaccaggacagcctacctaagctgactctatttaccngggcagtcctaccgggtaactcccgggtacctcgaccgtattcacggtgcgaggtcgggtctaggggactaggtactttccgacttccacaacctatcacgcacgccgtgcgagtctagaacgtntcggngtacttagtttactacgtgtacagntaattattatacgtactccgtcgtacgttacggcggaggtacgaaggtcgaaatacgaaacgtagtcggagactcgctactacg

SEQ ID NO: 152725 - DNA, 549 bp, Homo sapiens
  misc_feature: GYAE6OF01BJGDM.25.83.H06.1.454.CMB.1.raw
  modified_base (308)..(308): a, c, t, g, unknown or other
  misc_feature (308)..(308): n is a, c, g, or t
  modified_base (443)..(443): a, c, t, g, unknown or other
  misc_feature (443)..(443): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagaggccaccatcaactgcaagtccagccagagtgtttttacagctccgacaataagaactacttaagcttggcaccagcagaaaccagacagcctacctaagctgctcatttacnggctatctaccgggaatcccgggtcctagaccgattcagtgcgagcggtctgggactagtactttcacgtctcaccataccagccagcctgcagctagaagctgcgtctagtttatacgtgtacagtacaagttnttaataggttacctacccgtccgacgtttcggacccgaaggggtacccgtaagggtacgaaacgtaccaaacgggtaacctggtacggtactggaccctcgtaacg

SEQ ID NO: 152726 - DNA, 593 bp, Homo sapiens
  misc_feature: GYAE6OF01BG20H.25.83.H06.1.454.CMB.1.raw
  modified_base (432)..(432): a, c, t, g, unknown or other
  misc_feature (432)..(432): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagacgggccaccatcaactgcaagtccagccagtagttgtttttacagctccgacaataagaactacttagcttggccacagcaagaaaccaggacagcctactaagctcgctctatttacgtggcactaccgtacccggagtcccgggtcctcgaccgtattcgaggtcgcgaggcggtcgtcgggacaggtactttcacgtctcaccatcacgcacgcctgacctaggcctagaagngtgtgacttagtttatacgtgtaccgagtactaaattagttaataccgtaccgttcccgtaccggttaccggttaccggaccggtaacggggaacccttaaagggaacgtaaacgtaaccgaaaccgttacgtcgttacggacttcggaacctaccgtacg

SEQ ID NO: 152727 - DNA, 728 bp, Homo sapiens
  misc_feature: GYAE6OF01BZRB3.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtctccagactccctggctgtcgtctcgtgggcgagacgggccacatcgaactgacaacgtccggccagtagttgtttttacagtctacgaacaaataacgaacttacttaagcttggacacacgcaacgaaacaggacacgcctacaagctgctctactttacgtgggactacgtaccgtaacccgggtaacgttcccgggtaccctacgacccgtagtttcgacggttcggacgtacgggtccgggttcgtacggggtaactaacggttactttacctaacgtaccttaccgaaccctcgttaaccacggacctaacggttcccgacgaccggtaacggtcttaacgggaaaggttagtcgggtaacggtacgtttaaagtttttaacgttaaccgtgtaccgttaagaccgttaaattaacgttaaagtttacgttacccgtacctaccggttaaccggttaccggggaccgtaacggggaaaccgttaacggggtaaacggaaaccttaaaccggaaacggtacgtacgggtcgtaacgtgaaccctaagtccgtttaccgg

SEQ ID NO: 152728 - DNA, 556 bp, Homo sapiens
  misc_feature: GYAE6OF01EH1J9.25.83.H06.1.454.CMB.1.raw
  modified_base (310)..(310): a, c, t, g, unknown or other
  misc_feature (310)..(310): n is a, c, g, or t
  modified_base (412)..(412): a, c, t, g, unknown or other
  misc_feature (412)..(412): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcaagaaaccaggacagcctcctaagctgctcatttacnggcatcctacccgggaatcccggggtcctgaccgtatcagtggcaggcgggtctgggacagtatttcactctacaccatcagcagcctgcgaggctagaagngtgtggactagtttattactgtacagtactaagttattatacgtaccttcctccggtacgttccggaccgtaaggggacctaagggtacggaaactacgaaaaccggtaacgttacggtacggaccgttcgacctaaccgtacg

SEQ ID NO: 152729 - DNA, 581 bp, Homo sapiens
  misc_feature: GYAE6OF01BOKTO.25.83.H06.1.454.CMB.1.raw
  modified_base (442)..(442): a, c, t, g, unknown or other
  misc_feature (442)..(442): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcgagtccagccagagttgtttttacagctccgacaataagaactacttagcttggcaccagcagaaaccagacacgcctacctaagctgctctatttacgtgggactagtccgtaaccccgggaattcccggggtcccctggaacccgtattccgaggtcggcacggcgggttctgggacagtactttcacttcctcacctatcgagcacgcctgacgacggctagaaagntggtcgacttagttttaatctgtacagtactaattagttactacgtacctccgttccgacggttccggaccggtagggaccgtaagggtacggaaactaccgaaaacgtacgtaggtacggacctagccctacgtaacg

SEQ ID NO: 152730 - DNA, 583 bp, Homo sapiens
  misc_feature: GYAE6OF01EXRN1.25.83.H06.1.454.CMB.1.raw
  modified_base (451)..(451): a, c, t, g, unknown or other
  misc_feature (451)..(451): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagagggccaccatcaactgcaagtccagccagagttgtttttacagctaccgacaataagaactacttagcttggcaccagacaagaaaccaggacagcctcctaagctgctctatttacgtgggctagtccgtaacccgggaacgtcccggggtccctacggaccgtattcgaggtcggacgacgggcgggtcgtggggaactagtactttccacttctaccaacctatccagccacgcctgcgaggctaggaagtntgtcggacttagtttatactgtacagactaattattaatacgtacctcccgtccggtacggttccggaccggtaaggggtacctaagggtacgaaacgtaccgaaaagtactgggtacgactcgacctctac

SEQ ID NO: 152731 - DNA, 550 bp, Homo sapiens
  misc_feature: GYAE6OF01B5ST8.25.83.H06.1.454.CMB.1.raw
  modified_base (399)..(399): a, c, t, g, unknown or other
  misc_feature (399)..(399): n is a, c, g, or t
tcagactgtacagtcacgaccggtgctcgatttagatcacgtgcgtcgcgggggagctacaacaggcaggcaggggcagcaagatggtgttgcagaccccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcacagcagaaaccaggacagcctcctaagctgctcattactggcatcaccggaatccgggtcctgaccgattcagtgcagcggtctgggacagtattcgactctcacatcagcagactgcaggcagaagatgnggctagtttatacgtgtacacgactaatattatacgtacctccgtaccggtaccgttccgggaccgtaacgggggaaccctaaggggttacggaaaaactaccgtaaaaaccggtacgttacgggtacggacgttcgaccgtaccttaacg

SEQ ID NO: 152732 - DNA, 675 bp, Homo sapiens
  misc_feature: GYAE6OF01BHECU.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtctccagacctcctggctgtgtctcgtcgggcgaggacgggccaccatacaactgacaacgtccacgcctaggtagtttagtttttacacgtctaccggtaaactaaagtaaacgtaaccttaacgttacgtaccgttacggaccaaccgacgacgaaacgaaaccgaggaccgtaacggtaccctaccgtaagcctacgtacctacttacgtttacggtacgggactaaccgtaccggtaacccggggtacgttcccggggtccacggtaccgtacttcgaggtcgcgaggtcggtcgaggactacgtacttacgactcaccactataccgacgactacgccgtcggaccggtagacgttaacgaacgtggttacgtcgggtaacttagttttaactacgtagacttacgaataacgtttatacgttactaccgtccgtacggttcgtacggacggacgggtaacgtaggaacgtaacgtacgaaagtcgtggtacgcttacacgtctacg

SEQ ID NO: 152733 - DNA, 691 bp, Homo sapiens
  misc_feature: GYAE6OF01EUL5P.25.83.H06.1.454.CMB.1.raw
  modified_base (315)..(315): a, c, t, g, unknown or other
  misc_feature (315)..(315): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctcgaacaataagaactacttagcttggcacagacaacgaaaccaggacagcctacctaagctgctacattttacgnggactagttaccgtaacccggggaacgtcccgggtcctacgtaccgtagttcgaggtggacgacggtcgggtacgttacggggactaggtactttacctaccttccgtaccaacctaacttaccgaacgtaccaacggtccctaggccgtaacgggtcctaaggaaacgtacgttcggttacgggtactttaacgggtttttaacttaccgttaggtaccaaggttaactaaatttagtttaactacggttacccttacccggtaccggtaccggtttaccgggaccgtaaacggggggtaaccctaaaggggtacgtaaaacgttaacgtaaaaccggtaacggttcgggtaggtacctacgacctaacttacgg

SEQ ID NO: 152734 - DNA, 650 bp, Homo sapiens
  misc_feature: GYAE6OF01BHRE8.25.83.H06.1.454.CMB.1.raw
  modified_base (337)..(337): a, c, t, g, unknown or other
  misc_feature (337)..(337): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaggacggccaccatcaactgacaagtccagccaggtagttgtttttacagtcctaccgaacaataacgaacttacttagtcttcggacacacgacaacgaaaccgaggacacgaccctaccgtaagctgacctactatttacgnggactacgtccgtaacccgggtaacgtcccggggtacctacggaccgtacgtacgaggtcggacgacggtccgggtcgtacgggactagtacttccaccttccgtaccacctataccagccgacgccgtagactacggcgtaggaacgtgttagtcggtacttagtttacttacgtgtactacgtataattagttacgtacgttaccctaccgttaccgtacggttccggaaccggacgggtaaccgtaagggtaacgtaaaccgtacgtaaaccggtacgtacggtacgtaccgtaccgacgtcccttaacg

SEQ ID NO: 152735 - DNA, 653 bp, Homo sapiens
  misc_feature: GYAE6OF01CGUNS.25.83.H06.1.454.CMB.1.raw
  modified_base (322)..(322): a, c, t, g, unknown or other
  misc_feature (322)..(322): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagaggccaccatcaactgcaagtccagccagtagttgtttttacagtctaccgacaataacgaactacttagcttaggcaccagacaacgaaaccaggacacgcctacctaagctgctactatttacgngggactacgtccgtacccgggaacgtcccgggtccctgaccgtattcgagtcggcgacggtcgggtcgtgggactaggtactttccgaccttcctaccgaacctactaccgaacgccgtaacggtcctacggtccgaaggtccgtaagggtaaacgtaggttacgggtacggtacgtttaagttttaacgttacgtgtacctaaggtacttaagtttaacttacgtacgttaccttcccggtacgtaccggttccgaacgggtacgggtaaccgtaagggtaacgtaaactaccgaaacgtacgtacggtacgtactacgcctaacgtacg

SEQ ID NO: 152736 - DNA, 575 bp, Homo sapiens
  misc_feature: GYAE6OF01BAIKX.25.83.H06.1.454.CMB.1.raw
  modified_base (320)..(320): a, c, t, g, unknown or other
  misc_feature (320)..(320): n is a, c, g, or t
tcagactgtacagtcacgaccggtgctcgatttagatcacgtgcgtcgcgggggagctacaacaggcaggcaggggcagcaagaagttaggtgttggccagacccaggttcttcactttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcaacgaaaccaggacagcctcctaagctgctacatttacngggacatccgtaacccgggaactcccggggtccctagaccgtattcgaggtggcgaggccgggtcgtgggacaggtactttcacgtctacgacctatcacgtcagcctgacaggctagaagagtgtaggtacttagtttaattcgtgtacagactaattattataacgttctacccgtccgtacgttccggaccggaacgggtaccgtaagggtaggaaactacgaaacgtacgtgtacgggatcgcctactacg

SEQ ID NO: 152737 - DNA, 598 bp, Homo sapiens
  misc_feature: GYAE6OF01BZ668.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggcgagagggccaccatcaactgcaagtccagccagtagttgtttttacagtctaccgacaataagaacttacttagcttcggaccaccagacaagaaaccaggaaccagcctacctaagctcgctactatttacgtgggactacgtaccggtaccccgggtaagttccccggggtccctggacccgtattcgacggtcggccgacggtcgggtcgtagggaactaggtactttccaccgttctaccaccatcgagtcagcctagcaggctagagtagtgtcgattagtttacttgtgtcagtataattattataccgtactacccgtccggtaacgttccggacgtacgggaacctaagggacggtaaactaccgaaacgtacgtcggacgtactcaccgacctacg

SEQ ID NO: 152738 - DNA, 542 bp, Homo sapiens
  misc_feature: GYAE6OF01E4SAN.25.83.H06.1.454.CMB.1.raw
tcagactgtacagtcacgaccggtgctcgatttagatcacgtgcgtcgcgggggagctacaacaggcaggcaggggcagcaagattgtgttgcagacccaggtcttcatttctctgttgctctggatctctggtgcctacggggacttcgtgatgacccagtctccagactccctggctgtgtctctgggcgagagggccaccatcaactgcaagtccagccagtagtgttttttacagctccgacaataagaactacttagcttggcaccagcagaaccaggacagcctcctaagctgctcatttactgggcatcctacccgggaatcccgggtcctgaccgattcagtggcaggcgggtctgggacagtatttcactctcaccatcagcagcctgcaggctgaagagtgtggcctagtttacttacgtgtacagtctaaattattattacgttacctccgtaccgtacgttccggaccgtaaggggaccaaagggtacggtaaatccgaaaacgtactaggtcggtactggccacctacg

SEQ ID NO: 152739 - DNA, 638 bp, Homo sapiens
  misc_feature: GYAE6OF01CVMM7.25.83.H06.1.454.CMB.1.raw
  modified_base (249)..(249): a, c, t, g, unknown or other
  misc_feature (249)..(249): n is a, c, g, or t
  modified_base (319)..(319): a, c, t, g, unknown or other
  misc_feature (319)..(319): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaggagggccaccatcaactgcaagtccagccagtagttgtttttacagctaccgaanaataagaactactagcttggcaccagacacgaaaccaggacacgcctactaacgctgctactatttacgnggcactccgtaaccgggacgtccgggtacctgaccgtattcagtcgcaggcggtacgtagggactaggtattcactctccacactacagcagtcctagacctagcctagtattgtactttcgacttaactttacttacgtacgaaccctaaacttaaacttaaacttaaacttaaactttaaccgttacccgtaaccgtttaaccgttttaccgggaaccggttaaaccgggggtaaccgtaaaggggtacggtaacggtaaacgtaaccgtaaaacgttacgtacggttacggtacctaacggaccctaacgttaccg

SEQ ID NO: 152740 - DNA, 681 bp, Homo sapiens
  misc_feature: GYAE6OF01CIR5E.25.83.H06.1.454.CMB.1.raw
tcagactgtacagtcacgaccggtgctcgatttagatcacgtgcgtcgcgggggatctacaacaggcaggcaggggcagcaagatggtgttgcagacccaggtcttcatttctctgttgctctggatctctggtgcctacggggacttcgtgatgacccagtctccagactccctggctgtcgtctctgggcgagacgggccaccatcaactgcaagtccagccagtagttcgtttttacagtctccgaactaataaagactacgttagcttggacaccgagacaacgaaccgagacagccctactaagctgcctatactttcgcggacactcgtaacccggacgtcccgggtcctaggacctagttcgaggtcgcgtaggccggtcgtaggacaggtactttcacgttcacgtaccatccgaacgtcacgtccctaggccgtagggtacctaggaacgtacgttacggtaccgtaacgtttacggtttaaactttcgtacggttaacctacggtaacttaacgtttaagtttaaccttaaccggttacccttaccccggtaccgggtttaccggtaccggaccccggtaaaggggacccttaaagggtaaccgggtaaaactaacccggtaaaacgtaccggttacggttaccgggactccggtaaccctaacgttaccg

SEQ ID NO: 152741 - DNA, 660 bp, Homo sapiens
  misc_feature: GYAE6OF01EUIB1.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctggcgagagggccaccatcaactgcaagtccagccagagttgtttttacagtcctccgacaataagaactacttagcttggcaccagcaagaaccaggacagcctcctaagctcgctctatttactggctactccgtaacccgggaactcccggggtacctaggacccgattcgagttggcgtacggcgggtctggggacctaggtactttccacgttcctaccaaccgtactccaagtccgacgtcccgttggacgacgggtccgtaaggaaacggtagtttcggttacggtactttaacggtttttaacttacgttcgttaccgtaaggtacctaaagttttaactttaacgttaaggttacccttcccgttccggtaaccggtttccgggaaccgtacggggtaacctaagggttacgaaacgttaccgaaaaccgtacgttacggttacgacttacggccaaccgttacg

SEQ ID NO: 152742 - DNA, 657 bp, Homo sapiens
  misc_feature: GYAE6OF01DXOEM.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatgacccagtctccagacctccctggctgtgtctctgggcgagacgggccaccatacaactgaccaacgtccacgccagtacgtttgttttttaacagtcctacccgaacaaataacgaacttacttagtcttggcaccagacaagaaaccaggacacgcctaccaagctgctactatttacgtgggactacgtccgtaaccccgggacgtcccgggtccctcggaccgtattcgaggtcggcgacgggtcggtacgtacgggactaagttactttccgacttccgtaccacccacgtaccaggtaccaccggtcctacggacgtacggctaaggaacgtgttgggtaggtacctttaggtttactacgtgtactagtactaagttacttaacgtaccgttacctccgtacccggttacggtccggaccggtacgggaaccgtaggtaacggtaaactaacggaacgttaacgttcggtagtaccgttacgcccgtaagtaccg

SEQ ID NO: 152743 - DNA, 705 bp, Homo sapiens
  misc_feature: GYAE6OF01DIF6K.25.83.H06.1.454.CMB.1.raw
  modified_base (691)..(691): a, c, t, g, unknown or other
  misc_feature (691)..(691): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctcgtggtcgccgtacggggtacttcgtgactcgaccctagtcctccacgtacctcccgtggtcttgtgtctcggtgggcgaggacggccactactacaactcgacaacgtccacgaccgtaaggttacgttttcgttttacgacggtccttaaccgaactaagtaacgtaacttacgtacgtctaggaccacgacgacgaacgaacgacgtactacgtcctacgtaacgtctacgtctacgttagttacgcggtacacgtacccggtaaccgggaccggttcccgggtacctacggtacgtaattcggacggttcgcgtacgggtccgggtacgtacggacgtaagttcttaccactacctaccactactcgacgcgtacgtcgtacgacgtagtacgtaaggacgtgttacgtacggttacttaggtttaaccgttcgtagttaacgaacgtattaaactttagttaaccgttacgttacccgtacccggttaccggttcggtaccgggacggaacgggtaacgtagggtaaacgtaacgtacgaaacggtccgtagcgtanacccgagtcctacg

SEQ ID NO: 152744 - DNA, 707 bp, Homo sapiens
  misc_feature: GYAE6OF01EKKVL.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggcgaggagggccaccatcaactgcaagtccagccagtagttgtttttacagctaccgaacaataagaactacttagcttggcaccagacaacgaaaccaggacacgcctacctaagctgctactagtttacgtggactatccgtaaccgggaacgtcccgggtcctacgaccgtagtacacggtggacgagggtcggtcgtacggggactaggtactttccacgttcctaccgaccactccacggtccaccgtcctcggacgacgggtaccgtaaggtaacgtagttgggtacggtactttaaggttttaacttacggttacgttacgaacgtaacgttaaatttaccgttaagttaccgttaaccccgttacccggttacccggttaacccgggtttaccgggaaaccccgggtaagggggtaacccgtaaaggggttaaccggtaaaacgttaacccgtaaaaacggttacggttagggtaccgggtacctaccgggtacccaacggttaaccg

SEQ ID NO: 152745 - DNA, 769 bp, Homo sapiens
  misc_feature: GYAE6OF01ACN9D.25.83.H06.1.454.CMB.1.raw
  modified_base (671)..(671): a, c, t, g, unknown or other
  misc_feature (671)..(671): n is a, c, g, or t
  modified_base (753)..(753): a, c, t, g, unknown or other
  misc_feature (753)..(753): n is a, c, g, or t
  modified_base (759)..(759): a, c, t, g, unknown or other
  misc_feature (759)..(759): n is a, c, g, or t
tcagactgtacagtcacgaccggtgctcgatttagatcacgtgcgtcgcgggggagctacaacaggcaggcaggggcagcaagatggtgttgcagacccaggtcttcattttctctgttgctctggatctctggtgccgtacggggacttcgtgatcgacccagtcctccagactcccgtggctgtgtctcgtgggcgaggacgggccacctatcaactgacacgtccgacgacctagtacgtttagtttttacacgtcctaccgaaactaaagtaaacgaaccgttaacgttaggtccttcggaccaccgacgacaaacggaaaccgcggtaaccaaccgtcccgtaacctaacgtccgtacggtaccttacgtaacttttaaccgggcggtacctaaccgttaccccggtaaacccccgggggttaaccgttcccccgggggttacccctaacgggtaaccccgtagtttacccggagggttccgggaaccgtaccggggtcggggtacccggtagggaacctaacggtttactttaccgtaccgttccaaccgttaccagttccgaacgccgtaaccgtccgtacggaccgtagggacctagggtaaagttccggtacggtcgttaaccggttatttttaccgacgttgaaccgtatacgttaacttnttaccgaacttccgtacccgtcggtaacggttcccgggaacgacgggtaacgtagtaacggaactacggaaactgtacggtnaccgtnaccctgtacg

SEQ ID NO: 152746 - DNA, 638 bp, Homo sapiens
  misc_feature: GYAE6OF01BLZ4V.25.83.H06.1.454.CMB.1.raw
tcagactgtacagtcacgaccggtgctcgatttagatcacgtgcgtcgcggggggagctacaacaggcaggcaggggcagcaagatggtgttgcagacccaggtcttcatttctctgttgctctggatctctggtgcctacggggacttcgtgatgaccagtctccagactccctggctgtgtctctgggcgagagggccaccatcaactgcaagtccagccagtagttgtttttacagtcctaccgaacaaataaacgaacttacttagcttcggacaccagacaacgaaaccaggacacgcctacctaagctcggctactattttacgcgggactactccgtaacccggggaacttcccggggtccctacgaccgtattcgaggtggcgacggcgggtcgtagggactagtactttccaacttcttaccacctactacgacgacctacgccgtcgacgacgggtctaggaacggtacgttaggtaggtacttaagttttacttacgtgtactagactaaattattaatacgtacctccgtaccggttaccgttaccggacggaacggggtaaccgtaaaggggtagaaacgtaacgaaacggtagtacgggtacgtaccgcgacctaaccgtaacg

SEQ ID NO: 152747 - DNA, 607 bp, Homo sapiens
  misc_feature: GYAE6OF01EHVYA.25.83.H06.1.454.CMB.1.raw
  modified_base (319)..(319): a, c, t, g, unknown or other
  misc_feature (319)..(319): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagagggccaccatcaactgacaagtccagccagtagttgtttttacagcctaccgaacaataagaactacttagcttggcacagacaagaaaccaggacacgcctacctaagctgctcattttacngggctacgtccgtacccgggaagtcccgggtacctcggaccgattcgaggtcggcacggcgggtacgtacggggactaagtactttccgactcctacacctatacagtaccagtccgtgacgacggactaggaagtacgtggtacggtacttacgtttatacgttcgtacagtacgtaattattacttacgtaccttccgtaccggtaccggttccggacccgtacggggaactaagggtacgtaaagaccgtaaacgtacgtcggtacgacctacgacctacgtacg

SEQ ID NO: 152748 - DNA, 626 bp, Homo sapiens
  misc_feature: GYAE6OF01CYJ3Z.25.83.H06.1.454.CMB.1.raw
tcagactgtacagtcacgaccggtgctcgatttagatcacgtgcgtcggcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagagggccaccatcaactgcaacgtccagccagtagttgtttttacagtctaccgacaaataacgaacttacttagcttggacaccagacaacgaaaccaggacacgcctactaacgctcgctctatttacgtgggctactccgtaacccgggtaacgtcccgggtcctcgaccgtattcgaggtcggcgagggccgggttacgtcgggactagtactttaccactcctacacctactcgaacgccacgtcccgtagaccgacggtctaaggaacgtagtcgggtacggtacttaagttttacttacgtacgtacaagtactaattagttacttacgtcctacccgtacggtacggtccggaccgaagggtacccgtaagggtaacgtaaactaaccgtaaacgtacgttcggtacggctacgcctactacg

SEQ ID NO: 152749 - DNA, 657 bp, Homo sapiens
  misc_feature: GYAE6OF01E0H3D.25.83.H06.1.454.CMB.1.raw
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttancttggcaccagcanaaaccgagaacccgacacctactagctcgtctctactttacgtggctactaccgtacccgggtaacgtccgggtcccgtcgaccgtacttcgtagtcggcgacggtcgggtcgtacgggtacgtacgtactttactacctactaccaccactacacgcgacgccgtcgactacggtacgtagaaggtacgttacggtacggtacgttaacgttttaacgttaacgttacgtacgtaacgtaacttaaacttaactttaacgttaaccgttacccgttacccgttacccggtaaccggaccggtaccgggtaaccggtaaccgggtaaccggtaaacggtaaacgtaaacgtaaaccgtaacgtaacgtacgtcgtacgtacg

SEQ ID NO: 152750 - DNA, 781 bp, Homo sapiens
  misc_feature: GYAE6OF01CJET1.25.83.H06.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (772)..(772): a, c, t, g, unknown or other
  misc_feature (772)..(772): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctcgtggtcgtccgtaacggggtccttgtagagtacgacccagtcctccacgtacctcccgtggctgtgtctcggngggacgaaggacggaccaactactacaacncgactaacgtaccgaagacctaaggtacgttttacgttttaacgacgtactaaccgaaacgtaaataaaacgtaaccttagttagacgtacggacaacgacgaacaacgaaacgtaacggacactaccgtaaccctaagtccgtactacctacgttaacgttaacgcgggtaactaccggtaaccggtaaccgggtaacggtcccgggttaccaaacgtcgtaaacgttcgaacggtcggtacggacggtccggtacgtaacggaacgtaacggtcctttaacgaccgttacaccctaaagtcgaccgagacgcgtcgaacgacggagtaccgtaaggaattacgtacgtacggttaaactttagtttaaaccttcggtagtaaacgtacgtaaaacttaaacggtttacttaaacgtaaccgttacgttaacccccgtaggtaacccgggttaccggggaaacgtaaccggggtaaaaccgtaaagggtaacgtaaaaactaacccggtaaagacgttacggggtaccagaccgtaanacctttacg

SEQ ID NO: 152751 - DNA, 567 bp, Homo sapiens
  misc_feature: GYAE6OF01EQNC0.25.83.H06.1.454.CMB.1.raw
  modified_base (312)..(312): a, c, t, g, unknown or other
  misc_feature (312)..(312): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttgcacagacaagaaaccagacagcctactaagctgcctactatttacgngggcaatccgtaaccccggggagtcccgggtccctagacccgtattcgaggtcgcgaggtccggtcgtaggggactaggtatttccgactcctacaccatcgacgcacgtcctgacaggctagagatggaggacttagtttagtactgtacagactaattattatactactcccgtacgtacgttccggaccgtaaggggacctaagggtacgtaaactaccgtaaacgtacggtgacggactcgaccacgtacg

SEQ ID NO: 152752 - DNA, 813 bp, Homo sapiens
  misc_feature: GYAE6OF01C803Z.25.83.H06.1.454.CMB.1.raw
  modified_base (178)..(178): a, c, t, g, unknown or other
  misc_feature (178)..(178): n is a, c, g, or t
tcagactgtacagtcacgaccggtgctcgatttagatcacgtgcgtcggtcgggggagctacaacaggcaggcaggggcagcaaggatcggtgttgcagaccctaggtcttcactttctctgttgctctcggatctcgtggtcgccgtacggggtacttcgtgatcgacctacgtccnccacgtaccttcccgtggtctggttcgtccgtcggtgggacgacggaccgggcccaccgtacttccgaacgtcggacctaaacggtcccacggtaccgtaaggttacgtttacgtttttaacacggtccttaccggaaactaaacgtaaacgtaaacttacggttacgtaccgtttccggaccaaccgacgtacctaaacgaaccgtacggaacctcgtaccctaccgtaacgtccgtcgtacctcgttacgtttaccggtacggtaccctaagttcccgggtaacccggggttacggtcccggggttacctacggtaacccggttacgtttacggacggttcggtaccgtacgggtaccggggttacgtacggggaactaacgggttactttacccggaaccttccgtaaccgtacccgtagttaccgtaagtaccggtacggtccgttacggtacgtcgtacgtaaggtagtacgttcggtaggttacgtacgtttacgtcgtgtacgtacgttacgtagttacgtacgttacgttccgtacgttccggtacggtaccggtacggtacgggtacgtaagggtactaaacgtccgtaaacgtcgttacggtaccggtctacggtcctccgtacg

SEQ ID NO: 152753 - DNA, 737 bp, Homo sapiens
  misc_feature: GYAE6OF01DE8I7.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtctccagacctccctggctgtgtctcgtgggcgaggacggcccaccatacaactcgcaacgtccagaccagtagttagtttttacacgctccgaacaataagaactactagtcgtaggcaccagacaacgaaaccacggacacgccctacgtaacgctgacctactactttacgaggctaacgtacccgtaacccgggtaacgtcccgggtcctacgaaccgtacgttacgaggttcggacgacggtcgggtacgtgggtactacggtactttaccaccttcaccctaacgtactaccgaacgtcccgtaacgtcccgttacggaccgtacggtacgtaagggtaaagtacggttcggtacggttaacgtttacgtttttaacgtacggttagtaaccgtaagtaaccgttaaatttaagttaaccgttaccgtttacccttccccgggtaaccggttaccgggttcccgggtaaaccgggaaccgggggtaaaacctaaggggtttaacggaaaaccgttaacggaaaacgttacgggttacgtacggtacccgttacgacccgtaacttccg

SEQ ID NO: 152754 - DNA, 574 bp, Homo sapiens
  misc_feature: GYAE6OF01COV4L.25.83.H06.1.454.CMB.1.raw
  modified_base (245)..(245): a, c, t, g, unknown or other
  misc_feature (245)..(245): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccganaataagaactacttagcttggcaaccagacaagaaaccaggacagacctcctaaagctgctcatttactgggcatctaacccgggaactccgggtccctgaccgtattcagtggctagcgggtctgggacagtaattcactctacacatcagcagcctgacaggctagaaagatgtggactagtttaatactgtccaagactaagttattatagttacctccgtccgtaaccgttcgggacccggaaggggaaaccctaaagggtagggaaaaattacccgaaaaaacggtaaaccttggtaacggaccttagccccgtaactaaaccg

SEQ ID NO: 152755 - DNA, 715 bp, Homo sapiens
  misc_feature: GYAE6OF01BSL4E.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatacgacccagtcctccagacctcccgtggctgtcgtcgtcgtgggcgaggacgggccaccatacactgacaagtccagcctagtagtttgtttttacgacgtcgtaccgaactaaataaacgaacttacgttagtcttacggaccacacgacgaacgaaaccgacggacacgcctaccgtaagctacgtctacttacgtttacggtggactacgtacccggtaacccgggtaaccggttcccgggtaccgtacgaccgtacgttacgcggtaggcgacgggtcggtcgtacgggactacgtactttaccgactcctaacacctagtccacgcgaacggtctcggacgaggtaccgtaaggaagtgttacggtacgttacgtttaacgtttacttacgtcggttaacacggtacttaaagttactttacgttaccgtacccttacccgttaccgggtacccggttacgggaacccgggtaacgggtaaacctaaggggtaaacggtacctaaacggtaaccggtacggttacggaccgtaccggtactacccgtaattcccg

SEQ ID NO: 152756 - DNA, 820 bp, Homo sapiens
  misc_feature: GYAE6OF01DA9ME.25.83.H06.1.454.CMB.1.raw
  modified_base (558)..(558): a, c, t, g, unknown or other
  misc_feature (558)..(558): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttcgctctggatctcgtggtcgccgtacggggtacttcgtgagtcgaccacgtcctccacgtaccctcccgtggtccttggttcgttccgttcggtcggggaccgagggaccggggcccaacctagtaccgaacgtcgacctaaacggtccacgaccgtaggttagttttacgtttttaaccacgtccgttaccgaactaaaacgtaaacgtaaaccttacgtacgtcgttacggaccaacgacggaacaaaccggaaaccgacggaccacggtacctaacgtacgtctacgtacctacttacgttacggtcggtactacggtacccggtaaccgggaccggttcccgggtacctacggtaaccttgtaccggaggtcggaacggtccggtcggttacgacggacgtacgttacgttaccgacttccaccgtaacagtaccncgtacgaccgtccgaacggtacgtacggtacgttaaggacgttacgtggttaaccggttatttaacgtttttacgttaacgtacgtacgtaacgtaacgtttaaatttaacgttacgttaacccgtccggttaacccggtaacccgggtttccggaacccgggtaaacgggtaaccggggttaaactaaaggggtaacgttaaacccgtacgtaaaaccggttcggttacggtacggaacgttccaaccgttaccgtttacg

SEQ ID NO: 152757 - DNA, 758 bp, Homo sapiens
  misc_feature: GYAE6OF01DSSTL.25.83.H06.1.454.CMB.1.raw
tcagactgtacagtcacgaccggtgctcgatttagatcacgtgcgtcgcgggggagctacaacaggcaggcaggggcagcaagatggtgtgcagacccaggtcttcatttctctgttgctctggatctcgtggtcgccgtaacggggtcttcgtagagtacgacccagtcctcgacgtacctccgtgtctgtcgtcgtcgcgggacgacggacggcccacactacaacgtcgacaacgtccacgtactaggtacgtttacgttttacgacgtaccgtaccaaataaaacgtaacggtaaccttagttaacgtccggttacggaacccaccagtaacgaaccgaaaaccgagggtaaccaccggtaccctaacgtaacgtcctacgcttaagttacgtttaacgcggtactacgtacccgtacccggtacggtcccgggtacctacggtacctaagtcgaggtacgcgacgggtcgtacggtagaccttagtcttaaccgtcctactcaacctaggaccacgtagtacccgtcgacggacgacggacgtaagtgtaccgtaggttaacgttacgtttaagtttacgtacgtaggtaacctagttaaacgttaacttaacgttaacttaacggttccctaccggtaaccccggttggttaacccgggaacggtaaacggggtaaacccggtaaaggtaacgtaaaacttaccggaaaacgttacggtaacgtacgggaactttccgggaccttacgtacg

SEQ ID NO: 152758 - DNA, 812 bp, Homo sapiens
  misc_feature: GYAE6OF01DPVHZ.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatcgacccagtctccacgacctccctggctgttcgtctcgtgggcgaggacgggccaccatcaactgacaacgtccacgccgtagtagtttacgttttttacacgtacctccgaactaaattaacgaaaccttaccttagtccttacggaccaaccaacgacaaacgaaaccgacggaccaacgcccttacctaaacgtctggaccttacttagttttaacggtcgggactaaccgtacccggttaaccccggggtaaccgttccccggggtaccctcggtaacccgttacgtttaccggacggttcggacggtacgggtaccggggttcggacggggtaacctacggttacgttttcccaccgttaccctaacccgtaaccccgtactacccgaacggtacctaccggtcccgtagggtaccggagtaccgtaggtaaagttcgggtacgttacggtactttaacggttttactacggttcgtacaacggttacttaaagtttactttaacgtttaccgttacccgttacccgttacccgggttacggtaccgggtaccggtaacgggggtaaaccgtaaggggttaaccggtaaaattaaacccgggaaacgttaacggttcggttaacgggtacctaccgaacccgtaaccttaccg

SEQ ID NO: 152759 - DNA, 835 bp, Homo sapiens
  misc_feature: GYAE6OF01BY566.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatcgacccagtctccagtacctccctggctgtgtctcgtgggcgagacgggccaccatcaactcgacaacgtccaacgccagtagttgtttttacagtcctaccgaactaataaacgtaacttaccttagtccgttacggaccaaccgaacgaccgaacggaaaaccccgaagggaaccctaacggtaccccctttaaccgttaaaaccggtccgttaacgtccgttaacccgttaacggtttttaaccggcgggtacctaaccgttaccccggtaaaccccggggtaaccggtttcccccgggtacccgtacggtaaccccggttaattacccggtacggttaaccgggccggtaacgggtccggggttaacgtacggggtaaccgtagttaccgtttccacttcctaccgaactacgtacgaccgactacggccctacggaccgtacggtacctaagggactacgttcgggtaggttacctttaagttttacgtaacttcggtactaaacggtataaaccgttagtttaacgtaaccggttacccttccggtacccggttacgggttacccgaaccggtaaggggtaaaccctaaggggtttaaaccggaaacgttaaaacccggtaaaccggtacggttcggtaacccgggacttacgtacccggtaaccgttaacccgg

SEQ ID NO: 152760 - DNA, 710 bp, Homo sapiens
  misc_feature: GYAE6OF01DFWIV.25.83.H06.1.454.CMB.1.raw
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagactgtacagtcacgaccggtgctcgatttagatcacgtgcgtcgcgggggagctacaacaggcaggcaggggcagcaagatggtgttgcagacccaggtcttcattttctcttgttgctctggatctctggtgccgtacggggtacttcgtgatcgacccagtctccagacctccctggctgtcgtctcgtgggcgaggacggccaccatcaactgacaacgtcacgccgagtagtttacgtttttacacgtacctaccgaactaaactaaacgtaacttacgttagtccgttaggaccaaccacgacgaaacgaaaccgaggaccacgcctaccgtacnctacgcttataacgtttacgnggactacgtacccggtaacccgggtaacgttcccgggtacctaccggtaccgtacgttacgacggtcgacggacgggttcgggtacgtacgggtactacggttaactttccgaccttacctaccgactacaccgaagccctacggcccgttagaccggtaggtacgaagtagtacgtggtacgtacttagtttacgtcgtacgtaacctagtaaccttaaattacttacgttaacgttccctacggtttacccggacggtttacccgacgggtaaaccgggtaaccgttaagggtaacgaaccgtaaacggtaaacgtcgtaaggtcgacgcaccgtacgttacg

SEQ ID NO: 152761 - DNA, 767 bp, Homo sapiens
  misc_feature: GYAE6OF01CWCL4.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtcgccgtacggggtacttcgtgatcgaccagtctccacgctccgtgtctgtgtctcgtgggcgagacggccactatcaactcgacaacgtccacgcagtagtttacgttttacacgcctaccgaactaaacgtaacgtaacttacgtacgtacgtacgaccacgacgaacgaaacgaaccgacggtaacctaccgtaccttaacgtacgtccgtacgtaccttacgttacgttacggtacggtacctaccggttaacccgggtaacccgggtaccggttcccgggtaccgtacggtaccgttacgttacgacggtacggacggtacgggtccgggtacggtacggtacgtacgttaccttaccgactaccaactacgtactaccgtacgaccgtacgtccgtacgacgggtcgtaacgtaggtaacgttggtacggttacgtaacgtttagtttaccgtacgtacgtaacgtaacgttaagttactttaacgtacgttaaccgttaccgttacccggtaccggttaaccggtaccgggtaaccggggtaaacggtaacggtaaacgggttaacgtaaaccgtaaacggttaaacgtacggttacggtacgtaccgtaaccgtaccgttacgtac

SEQ ID NO: 152762 - DNA, 696 bp, Homo sapiens
  misc_feature: GYAE6OF01EU089.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagacgggccaccatcaactgccaagtccagccagtagttgtttttacagtcctccgaacaaataaacgaacttacttagcttaggcaccagacaagaaaccgaggacacgcctacctaaagctgacctactagtttacgtcgggactacgtaccgtaccccggggaacgttccccggggtccctacggaccgtattcgaggtcggacgtacggtccggggtcgtacggggactacgtacgtttccacttccctcgaaccctatccgacgtccacgtaccgtgaccggtagccgtagaagtgttcggtagaccgtttaagttttacgttacgtcgtactacggacttaaagtttacttaagttaccgttacccttcccggttaacccggtaccggtttacccgggaacccgggttaacgggggtaacccgtaaagggtaacggaaaacttaaccggaaaaccgttacggtcggtacggtaccgtacgtaacccacgtttaaccg

SEQ ID NO: 152763 - DNA, 696 bp, Homo sapiens
  misc_feature: GYAE6OF01CORKZ.25.83.H06.1.454.CMB.1.raw
  modified_base (446)..(446): a, c, t, g, unknown or other
  misc_feature (446)..(446): n is a, c, g, or t
  modified_base (505)..(505): a, c, t, g, unknown or other
  misc_feature (505)..(505): n is a, c, g, or t
  modified_base (574)..(574): a, c, t, g, unknown or other
  misc_feature (574)..(574): n is a, c, g, or t
tcagactgtacagtcacgaccggtgctcgatttagatcacgtgcgtcgcgggggagctacaacaggcaggcaggggcagcaagatggtgttgcacgacccaggtcttctatttctcttgtgctctggatctcgtggtcgccgtacgggacttcgtgatcgacccagtctcaacgcctccctggctgtcgtctcgtcgggcgaggacggccaacactaccgaacgtcgactaacgtccagaccgaagtacgtttagtttttacagcctaccgtaacaaacgtaaacgtaaacttacgtaagtcgttacgaccaaccagacgaaacgaaaacccgaggaaccgacgtaccctaacccgtaagccttacggccttaactacgtttaccggtgggacctacgtacccggtaaaccgggaacgtcccggggttcctacgtacgaacgttanacggtggtacgagggtcggtaccgtaggaactagtactttacaccttctaccaacgtanaccagaacgtcgccgtagacgaccggataaggaagtaggtgtacggtactttagttaatcttacggaanaacgtactaatacgttaactaccgtacctccgaacgtccggaccggtaacggaaacgggaaacgtaaaggtaacgtaaacgtaaacgtaaagtacggttacggacgacgtacaacgtctacg

SEQ ID NO: 152764 - DNA, 680 bp, Homo sapiens
  misc_feature: GYAE6OF01BF7T1.25.83.H06.1.454.CMB.1.raw
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagtagttgtttttacagctccgaanaataagaactacttagcttggacaccagcagaaaccaggacacgcctctaacgctgctctatttacgnggcatcgtacccggatccgggcctgaccgattcacgtgcgagcggtcgtcgggacagtatttccgactctcgaaccctatcacgtcacgtccgtgaccgacggtcctaggaaacgtagtcggttacggaccgtttaagttttaactttacggtacgtaccgtaggtaacccttaaatttaaacgtttaaagtttaacccgttaacccgtttacccccgtaccgggttaaacccggttttcccggggaaaacccggtaccggggggtaaaccccttaaagggggtaccggtaaaaacggtaccgtaaaaaacccggtaagttcgggttacgggacccgttaacggaccgtaaccccgtttaaacgg

SEQ ID NO: 152765 - DNA, 621 bp, Homo sapiens
  misc_feature: GYAE6OF01B9MUT.25.83.H06.1.454.CMB.1.raw
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
  modified_base (414)..(414): a, c, t, g, unknown or other
  misc_feature (414)..(414): n is a, c, g, or t
  modified_base (475)..(475): a, c, t, g, unknown or other
  misc_feature (475)..(475): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaggacgggccaccatcaactgacaagtccagccagtagttgtttttacagtctaccgaanaagtaagaactacttagcttggacaccagacaagaaaccaggacacgcctacctaagctgctctattacgngggcacgtccgtacccgggaactccgggtcctgaccgtattcgaggtgcgacggcggtcgtcgggacagtacttaccactctacacctancagccagtcctgacacgggctagaagtactgggtacgtacttagttttaactacgttgtanaacgtacgttaattaacgtttaataccggttacctcccgttccggtaaccggttcgaaccggtaacggggtaacctaaggggttaacgtaaacgtaaccgaaaccggtaaggtaccggttaggaccctcgtacctaccgttaaccg

SEQ ID NO: 152766 - DNA, 862 bp, Homo sapiens
  misc_feature: GYAE6OF01B3LM2.25.83.H06.1.454.CMB.1.raw
  modified_base (606)..(606): a, c, t, g, unknown or other
  misc_feature (606)..(606): n is a, c, g, or t
tcagactgtacagtcacgaccggtgctcgatttagatcacgtgcgtcgcgggggagctacaacaggcaggcaggggcagcaagatggtgttgcagacccaggtctcatttctctgttgctctggatctctggtcgccgtacggggacttcgtgatcgacccagtctccagtacctccctggctgtcgtctcgtgggcgagcggccaccagtcaacgtgacaacgtccagccgagtagtttcgtttttacacgtcctaccgaactaaacgtaacgaaaccttacgttaacggcgtttacgggaccaccgacgtaccgtaacggaaacccgcggtaccgaccgtaccccgttacctaaacggtcctcggtacttacctaaggttttaccgagggtacctacgtacccggtaacccggggtaaccgttccccggggttacccgttacggaccccggttagttaccggtacgggtacggtacggtaccggggtcgggttacggtacggggtactaacggttacgtttacccaccgttcctacccgtacctacgttaccgacggtaccgtaaccgccgttcgaccggttaggtcccgtaaggtaaccggtnttacgggttcgtaactttaggtttaacctacgttcgggtaacctacgggtactttaaaacgttacgttttaacgaccggtttacccttcccgggttaacccgggttacccgttaccggggaaccccgggttaaaccgggggtaaacccggttaaggggttaaacccggtaaaacgtaacccgggtttaaaaacccgggttaccgtacgggggtttaaccgttacccggaccggttaacccgtaaccggtttacccg

SEQ ID NO: 152767 - DNA, 810 bp, Homo sapiens
  misc_feature: GYAE6OF01DNXQ4.25.83.H06.1.454.CMB.1.raw
  modified_base (177)..(177): a, c, t, g, unknown or other
  misc_feature (177)..(177): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatgacccagtctccagacctcccngctgtgtctcgtgggcgaggacggccacccatacaactgactaagccacgcctagtacgtttagttttttaacgacgccgtaccgaaacctaaattaaacgtaaaccgtttacccgttaagtccggtttaacgggaccaaacccgaacggaaccaaaacggtaaaaacccccgaggggaacctaaaccgggtaaccccttaacggtaaaacggtctacggtacctaccttagtttaacggtaccgggtactaaacgtcccccggttaaaccccggggtaacggttacccccggggtacccgttacggtaacccgttagtttacccgacggtacggacccgttaacggggtccgggttacgtcggggtaactaagtactttccgaacttcccaccgttacacctacgacggtaccacgtaccgagaccggacggtacctaaggaacgtagtcggagggtttaacccttagttttaacgttacgtacgtacggtaaccttagttaaactttaacggttattaaccgttacccttcccgggttaaccgtaccgggtaccggtaccggaacgggtaacggtaacgggagtaaaaccctaacgtaagaaaccggtgtacgacgtaccgataccgtacg

SEQ ID NO: 152768 - DNA, 910 bp, Homo sapiens
  misc_feature: GYAE6OF01E0AKZ.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtctccagacctccgtggctgtgtctcgtggcgagacggccaccactacgaactcgacaacgtccacgaccgagttacgttgtttttacacgtacctaccgaacaaagtaacgtaaccgttacgttagtccgttacggaccaaccgacgaaccaaacggaaaaccgtaacggaaccaccggtaccccttaccgtaaacgtcgtaccggtccttaccgtacgttttaccgtcggaccttaaccgtacccggtaaacccccgggtaccggtttcccccgggtaccccgtacggtaaccccgtacgtttaccgacgggtacggaccggtaccggggtccgggttaccggtacgggtaaaccgttaggtacccttttaccggtacccttacccgttaacccgaaccgtaacgttaaccccggacgtaccccgttaaccgggtcccgttacggaccggtaacgggtacgttaaccggggtaaagttcgttaccggggtaccggtttaacgttttaaaccggtttttacgttaaccgttacgggtaaccttaaacgtaaccgttttaaaacgtttaacgttttaacgttaaacccgttacccccgtttcccggttaaccccgggttacccggggttacccgggaaacccggggttaaccggggtaacccggttaaagggtaaacccggtaaacgtaaaccgtaaaccgggttaacgttacgggacgtaaccgtaccgaccgtaccgtttaaccg

SEQ ID NO: 152769 - DNA, 775 bp, Homo sapiens
  misc_feature: GYAE6OF01DPAYQ.25.83.H06.1.454.CMB.1.raw
  modified_base (521)..(521): a, c, t, g, unknown or other
  misc_feature (521)..(521): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctcgtggtgccgtacggggacttcgtgatcgaccagtctccagtactcccgtggctgtcgtctcgtgggcgaggacgggaccaccgatcaactgacaacgtccacgccgaggttagtttacgtttttacacgtcctaccgaactaaagtaaacgtaaccttacttaacgtcgttacggaccaaccgacgacgaaacgaaaccgaggaccaccgtacctacgtacgcctgacctacttacgttacgcggtacacgttacccggtaaccgggtaccgtcccgggtacctacggtaaccgtacgttcgaggtcggaccggacgggtcggtcggtacgggtaactacgttactttccgacgttacccgacctaccgtacgtcgacgccgtacgtccgnggaccgaggtaccgagtaacgtagtcgggtacggtactttaggtttacttacgtacgttaacgacgttacgttaaacgtttactttaacggtaacccgtttacccgtaacccgggttaccggttaacccgggtacccgggtaaccggggaaaccggggtttaaaacgtaccggggtaaacggttaaaaccgtacccggtaaaaccggtcggttaaccggtacggtaactacccggtactaacccggtttaaccg

SEQ ID NO: 152770 - DNA, 655 bp, Homo sapiens
  misc_feature: GYAE6OF01CCMKU.25.83.H06.1.454.CMB.1.raw
  modified_base (329)..(329): a, c, t, g, unknown or other
  misc_feature (329)..(329): n is a, c, g, or t
  modified_base (414)..(414): a, c, t, g, unknown or other
  misc_feature (414)..(414): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtcctccagacctccctggctgtgtctcgtgggcgaggacggccaccatacaaccgtgaccaacgtccacgccgagtagtttcgtttttacacgtcctaccgaataataaacgaacttacttagcttcggcaaccagacaacgaaccaggacacgcctaccgtacgntcgctactagttacgtcgggactacgtaccgtaccgggacgtcccgggtcctcgaccgcttacgacgtcggcgagggtcgtacgnggactagtattaccactcgtaccacagtaccacgcacgccttacggcaacggtcgtaaggtaaacgtcgtgttacgtacgtttaagtttaactacgtcggactaacgtactaaagttactttaatacccgttcccttacccgggtacgttaccgggtcccgaacgggacgggtaaccggtaacggtaagtaaccaaaccggtaaacgtacgggttcgacggtctacgacctacgttacccg

SEQ ID NO: 152771 - DNA, 670 bp, Homo sapiens
  misc_feature: GYAE6OF01EMVXI.25.83.H06.1.454.CMB.1.raw
tcagactgtacagtcacgaccggtgctcgatttagatcacgtgcgtcgcgggggagctacaacaggcaggcaggggcagcaagattgtgttgcagacccaggtcttcatttctctgttgctctggatctctggtgcctacggggacttcgtgatcgacccagtctccagacctccctggctgtgtctcgtgggcgaggacgggccaccatcaactgacaagtccagccagtagttgtttttacagcctaccgaactaaataaacgtaactacttagcttaggaccaaccagacaacgaaaccaggacacgcctacgtaagctgctactactttacgtggactacgtaccgtaacccgggaacgtcccggggtcctacgtaccgtattacgaggtcggcgacgggtcggtcgtacgggactaagtactttcaccttctaccaccgtatcgaacgcacgtcctgcgacggctaggtaagtgtggtacgtacgttaacgttttagtacgtcgtaacgacgtaataaagtttattacgtaacgttcccgtacccgttacgggtaaccggttccgggaaccggtaacgggggtaaaccgtaaacggggtaagtaaaccgtaaccggaaaaccggttaaccgtcggtaaccggacgttaccgaccgtaacgttacg

SEQ ID NO: 152772 - DNA, 906 bp, Homo sapiens
  misc_feature: GYAE6OF01DP92P.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggttcttctattttctcttgttgctctggatctcgtggtctccgtacggggtacttcgtgatcgacctagtcctaccagtacctcccgtggtctggtcgtctcggtgggacgaggacggaccactatccaactgaccgtaacgtccacgaccgtagttagttttactttttaccgacggtacctaaccgaaacgtaaattaaacgtaaacctttacgttaacgtcgttacggaccaaaccgaacgtacggaaacgaaaaccgacggtaaaccgtaaccgtaccccgtaacgttaacgtccttaccggttaccttacgtttaacgttttacggacgtaccgttaaccgttaaccccggtacccgggttaaccggtcccgggtaccgtacggtaccgttagtaccgaggtcggtaccgtacggggtaccggttcggtaacggaacgttaccggttacctttaccttaacccttcctaaacccgtacctacgtacccgaacggtcccgtaaccggtccgtaggaacccggtaggtacggtaaacggtaacggttcggttacggtttaaccggttaagtttttaacggtttaccgttaacgtttcgggaaacccttaaacgtttaagtttaaacccttaatttttaaacccgtccggtttaaccccgttcccgggttaaccccgggttaacggtaaccggggtaaccgggtaacccgggttaaaacggttaacgggaaaccgtttaaacgtaaccggtaaacggttacggtaccggtacgtaaccgtcctaaacccgtcggttttaaccc

SEQ ID NO: 152773 - DNA, 719 bp, Homo sapiens
  misc_feature: GYAE6OF01AHAAY.25.83.H06.1.454.CMB.1.raw
tcagactgtacagtcacgaccggtgctcgatttagatcacgtgcgtcgcgggggagctacaacaggcaggcaggggcagcaagatggtgttgcagaccccaggtcttcatttctctgttgctctggatctctggtgcctacggggacttcgtgatgacccagtctccagacctccctggctgtgtctcgtgggcgagagggccaccatcaactgcaagtccagccagagttgtttttacagctaccgaacaaataagaactacttagcttggcaccagcaagaaaccgaggcacgccctaccaagctgctactatttacgtgggacagtccgtacccgggaacgtcccgggtaccctcgaccgtattcgaaggtcggacgtacggtccgggtcgtcggggaactacggtactttaccacgttaccctaccgacctaacgttcgaacgtccgaacgtcccgttaggaccgtaaggtcttaacggaaaggtcgtacgggttacggtacgtttaacggttttaacttaccgttcgtaaccgtaacggtacgttaaatttaacgttaaacgtttacggttaaccccttccccggtttaccggtacccgggttacccgggtacccggtaaacgggggtaacccgtaaacggggttaagaaaacccgttaacggtaaaaccggtacggtttacggacgtaccgttacgaacccaacccgttacgg

SEQ ID NO: 152774 - DNA, 805 bp, Homo sapiens
  misc_feature: GYAE6OF01CATEA.25.83.H06.1.454.CMB.1.raw
  modified_base (127)..(127): a, c, t, g, unknown or other
  misc_feature (127)..(127): n is a, c, g, or t
  modified_base (569)..(569): a, c, t, g, unknown or other
  misc_feature (569)..(569): n is a, c, g, or t
tcagactgtacagtcacgaccggtgctcgatttagatcacgtgcgtcgcgggggagctacaacaggcaggcgaggggcagcaagatggtgtgcacgacccaggtcttcatttctcttgtgctctggntctcgtggtcgccgtacgggtacttgtgatcgaccagtcctaccacgcctcccgtggtcctggtcgtctcgggtcgggacggacggacgggaccctaaccgtactaccgaacgtcgaacctaacgtaccgaacggaccgtaggttaacggttttacgttttaccgaccggtacctaacccggaattaaaacggtaaaccgtaacgttacttacggtcgtacggaccaacggacgaaacgaaccgtaaacggacgacctaccgtaccgtacgtaagtcctacgtccttacgtacgttacggacggtactaccggttaaccccgggacccggtaccggttaccccgggtaccctaacgtccggtaacttccgggaggtaccggccgggtacgggaccggttacggtaacggcttaaccgtattacccgaccttacaccgtaacnctaacgacaccgtacgtacccgagtaaccggacgtacgggagttaacggtgtaacggttcggtttaacgtttagttacgttactaggtactaacgtaacgttattaacgtaccgttacgttacccgtaccgggttaaccgtccgggtaaccgtaacgggacgtaggtaaacgaacggttaaacgtaccggtaaacgttccgggtagaacggttacctaccgccgttaaccggtacc

SEQ ID NO: 152775 - DNA, 727 bp, Homo sapiens
  misc_feature: GYAE6OF01EVUE5.25.83.H06.1.454.CMB.1.raw
  modified_base (347)..(347): a, c, t, g, unknown or other
  misc_feature (347)..(347): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtctccagactccctggctgtgtctcgtgggcgagacgggccaccactcaactgacaacgtccacgaccagtacgtttgtttttaacagtcctaccgaactaagtaacgtaactacttagcgttcggacaccgagacaacgaaaccgaggtacacgtcctacgtaagctgtctactagtttacgnggactacgtccgtaaccgggacgtcccgggtcctacgacctagtcgaggtcgcgtacgggcggtacgtacgggactagtacgtttacaccgttctaccaacctacttaccgaacggtaccgtaacgtcccgttacggacggaacggttaccgtaagggtaaacgttacggttacgggttaccggtaacgtttttaacgtttaacgtttaaccgtcggtaactaacggtaacttaaagtttacgtttaacgttaccgttaacccgtttccggtaacccgggttaccggttacccgggaaccgggtaacggggtaaccgtaaagggtacgtaaaacggtaaccgtaaaacgtcgtacggtcgtaccgtcgaacctcgttacg

SEQ ID NO: 152776 - DNA, 651 bp, Homo sapiens
  misc_feature: GYAE6OF01ELQWB.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctcgtggtcgccgtacggggacttcgtgatcgaccctagtctccacgacctcctggctgtgtctcgtggcgagcggccacatcaactgacaacgtccagccagtacgtttgtttttacagtcctacgaactaattaacgaacttacttacgtcgttcggacaccagacaacgaaaccgacggacacgcctacgtaacggctagtccttactacgtttacgcggactacgtcccggtaaccggggtacgtccccgggtcctacggtaccgtacttcgaggtcggcgtacgggtcggtactagggactagtcttacacgtcctacgactacgtacgacgactcgtactcggagacgtacgtaggaacgtgtcggtacgtacgtttacgtttactagtccgtaataacgtattaacgtttattaacgtaccgttacctacccgtaccggtacggttcccggacggtaacgggtaacggtaaggtaagtaaccgaacgtaaacgtcgtaggacgtcacgactcgtacg

SEQ ID NO: 152777 - DNA, 589 bp, Homo sapiens
  misc_feature: GYAE6OF01ESEMR.25.83.H06.1.454.CMB.1.raw
  modified_base (380)..(380): a, c, t, g, unknown or other
  misc_feature (380)..(380): n is a, c, g, or t
  modified_base (474)..(474): a, c, t, g, unknown or other
  misc_feature (474)..(474): n is a, c, g, or t
tcagactgtacagtcacgaccggtgctcgatttagatcacgtgcgtcgcgggggagctacaacaggcaggcagggcagcaagatggtgttgcagacccaggtcttcatttctctgttgctctggatctctggtgcctacgggacttcgtgatgacccagtctccagactccctgctgtgtctctgggcgagagggccaccatcaactgcaagtccagccagagtgtttttacagctccgactaataagaactacttagcttggcaccagcagaaaccaggacagcctacctaagtcctgctactactttactgggactagtcctaacccgggaagtcccggggtacctcgaccgtattcgaagtggcgtaggaccgggtntcgggacaggtactttcgacctcgtaccacctatacagtcagccgtagcaggctaggaagtcgtgtaggacttagtttattacgtgtacgtaanctaagttactttagaacgttacctccgttccgtaccggtttaccggaccgtacggggacctaaagggtcgaaagtaccgtaaacgaacttcggacggtacttcggctaccctacg

SEQ ID NO: 152778 - DNA, 788 bp, Homo sapiens
  misc_feature: GYAE6OF01BVZOR.25.83.H06.1.454.CMB.1.raw
  modified_base (377)..(377): a, c, t, g, unknown or other
  misc_feature (377)..(377): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtcctccagacctccctggctgtcgtctcgtgggcgaggacggccaccatccaactcgacaacgtccacgccaagtacgtttgtttttacacgtcctaccgaactaataacgtaacttacttacgcttacggacctaaccgacgtaccaaacgaaacccgtaggacctaaccgtcccgtaaccgtaacgcctcgtaccttactaagttttaccgngggtacctacgtacccggtaacccgggtaacgtccccgggtaccctacggtaccgtacgtttcgacggttacggcgtacgggtccgggtacgtacgggactaacgtactttccaccttacctacctacctacgtaccgacgtacccgacgtccgtcgaccgacggtaccgtaagaacgtagtacggtacggtacgtttaagttttaccgttaacgtcgtaaccgtaacggtaacttaagtttaacgtttaacgttaaccgttacccgttaccccggttaaccggttacccggttacccggtaaaccgggtaaccggggtaaaccggtaaagggttaaccggtaaaacgtaaaccggtaaaacgtaccgggttacggaccggttaaccgtaccgaaccgttaaccgtaaccg

SEQ ID NO: 152779 - DNA, 967 bp, Homo sapiens
  misc_feature: GYAE6OF01ARXC7.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagacgggccaccatcaactgcaagtccagccagtagttgtttttacagtctaccgaacaataacgaacttacttagcttggaccaccagacaacgaaccaggacacgcctacaagctcgctactacgtttacgtcgggactacgtacccgtaacccgggtaacgtcccggggtaccctacggtaacccgtactttccgaaggtcggacgtaacgggtccggggttaccgtacggggtaacccgtaaggttactttacccgtaaccgtttacccgtacccgtaaacccgtaccgttaccggaacggtaccctaaccgggttccccggtttacgggaaccccggtttaacggggtaacccgttaacggggtaaaaccccggtaggttttacccgggggtaccgggtttaacgttttaacgggttttttaaaccttttaaacccgggtttccggttaaccgttaaaccgggttaaacccgtttaaaacggtttttaaccggttttaaacggtttttaaccccgggttacccccgtttaaacccccggtttacccggggtttaacccggggtttacccccggggtaaacccgggggttaaaaccccgggggggttaaaccggttaaaaaccggggggttaaaaccggttaaaaaaccccgggtttaaaccccggttaaaaaacccgggggtttaaacccggggtttaaccggggtacccgggtttaaaccccggttaccccgggttaacccgttaaacccccgggtttttaaacccgg

SEQ ID NO: 152780 - DNA, 662 bp, Homo sapiens
  misc_feature: GYAE6OF01BFU9Q.25.83.H06.1.454.CMB.1.raw
  modified_base (456)..(456): a, c, t, g, unknown or other
  misc_feature (456)..(456): n is a, c, g, or t
tcagactgtacagtcacgaccggtgctcgatttagatcacgtgcgtcgcgggggagctacaacaggcaggcaggggcagcaagatggtgttgcagacccaggtcttctattttctctgttgctctggatctctggtgccgtacggggacttcgtgatgacccagtctaccacgacctcctggctgtgtctcgtgggcgaggacggccaccatcaactgacaagtccagccagtacgtttgtttttacagcctaccgaacaaataagaacttacttagtccgttggacacgacgacaacgaaaccagaccagccctacaacgctcgtctataactttctaggactacgtaccgtacccgggtaacgttcccgggtccgtacgtaccgtagttacgtaggtcggcgtaacgggtcgggtcgtagggactacgtactttcaccgttcctaccacctacncgtacgcgacgcctggacgacggaccgtaggagtgtcgtcggaactttagtttatcggtctacgacgtacttaattaacttacgttaacgtaccctcgtaccgggtccgttaccggaccggtaacgggtaaaccgtaagggtaaccggtaaagtaccgtaaaacggtacggttaccgtagggaaccttcccggaaacctgtacccg

SEQ ID NO: 152781 - DNA, 778 bp, Homo sapiens
  misc_feature: GYAE6OF01A3DVZ.25.83.H06.1.454.CMB.1.raw
  modified_base (127)..(127): a, c, t, g, unknown or other
  misc_feature (127)..(127): n is a, c, g, or t
  modified_base (563)..(563): a, c, t, g, unknown or other
  misc_feature (563)..(563): n is a, c, g, or t
  modified_base (594)..(594): a, c, t, g, unknown or other
  misc_feature (594)..(594): n is a, c, g, or t
tcagactgtacagtcacgaccggtgctcgatttagatcacgtgcgtcgcgggggagctacaacaggcaggcgaggggcagcaagatggtgttgcagacccaggtcttcatttctctgttgctctggntctcgtggtgccgtacggggtacttgtgatccgaccctagttccgtccacgtaccgttccgtcgggtcttcggttcgttccgtcggtcggggacggaagggaccgggtacccaacctactaccgaaacgtcggaacctaacgtcccacggaccgtaaggtttacgttttaccgtttttaacgacgtaccgtaccggtaaactaaagttaaacgtaacttacgttaacgtcgttacggacctaaccgtagaaccgaaaccggtaaaccgacgtaccgacgtacccgttactaacggtctacgtcttacgttacgttacggcggtactacgtacccggtaaccgggtacggtccccggtaccgtacgtaccgtactacggaggtcgacggtcggtcgggtacgtacggcgtaagtacttaccgacctccactactacncgtacgacgtaccgtcgtacggacgtacgtnaacgttagtacgtggtacttactttagttactcgtatctagtactaacgtttagcttaaccgtctaccggttaccggtacggttacccggaacgggaacgtaaccggtaaaggtaaccgtaaacgtaacccggttaacgttagggtacccggttaggaccgttacgaaccccgtttcgtaccgg

SEQ ID NO: 152782 - DNA, 900 bp, Homo sapiens
  misc_feature: GYAE6OF01D8GJS.25.83.H06.1.454.CMB.1.raw
tcagactgtacagtcacgaccggtgctcgatttagatcacgtgcgtcggcgggggagctacaacaggcaggcgaggggcagcaagatggtgttgcagacccaggtcttcatttctctgttcgctctggatctcgtggtcgccgtacgggtacttcgtgactcgaccctacgtcctccgacgtacctccgtggtcgttggtcgtcgtcggtacgggacggacggaccggaccaccgactacacgtcgaccgtacgtaccgacgtaccgtagttacgttttacgttttacgacgttacccgtaaccggtaaactaaacgtaaaccgtaaccgtttaacgttaccggtaccgttaccggaacctaaccgaacgaaccgaaaccggaaaccgacggtacctaccgtaccctaacgtaaccgccgttacgtaccttacgttacgttacggtacgtacctaaccggttacccggtaaccgggtaccgtcccgggtaccgtacggtaccgttagtacggtacggtaccggtacggacgggttccggtacggtacggtaaccttacgttaccgttacctacggttaccctaccgtaacgtacgtaccgactaccggtaacccgtcggtaccgacggtacggtacgtaacgggtaggttcggttaacgggtcgtttaaacgtttacgtttaacgtcgttaacgtaactacgttaaacgttaactttaacgttaacccggttccggtttaaccccgtccgggtttaaaccggtacccgggttacccggggaaaccgggttaacggggtaaaacccgggttaaaggtaaacccgggttaaaacgtaaaccccggttaaaggttaccgggtacgtacccggttaaccggcccttaacggtccccgttaacgg

SEQ ID NO: 152783 - DNA, 864 bp, Homo sapiens
  misc_feature: GYAE6OF01CCIS9.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctgatctctggtgccgtacgggacttcgtgatcgacccagtctccagactccgtgctgtgtctcgtgggcgaggacggccaccatcaactgactacgtaccacgcctagtacgtttacgttttttacgacgccgttaccgaacaaacgttaaacgtaaaccttaacgttacgtaccgtttacggaccaaccgacgaaccaaaggaaaaccccgaaggaaccgaacgtaccccttaacctaacgtccgttagtcccttacgtaacttttacggtacggaccgtaacgttacccggtaaccccgggtaaaaccggttcccccggggttaccccgtacggtaaccccggtattacccggtacggttacgggacggtaacgggtccggggttaccggtacgggaaacgttagttacgtttccgtaaccgttccgttaaccaacccgtaacgtacctaacgaccgtaaacgtcccgtacggaccgaacgggtaccggtaaggtaacggtaacgttacggttaccggtaacgttttaacgtttaacgtttacgttacgtaaccgtagtaaccttaaacgtttaagtttaacgttaaccgttacccgtacccggttaccccgttacggttcccggggaaacgggttaaccgggtaaacccgggttaaacggtaaacggttaaacccggtaaacggtaaaacccgtacggttaacgggttccggacgttaccgaacgtaccgttaacccgg

SEQ ID NO: 152784 - DNA, 827 bp, Homo sapiens
  misc_feature: GYAE6OF01A1P41.25.83.H06.1.454.CMB.1.raw
tcagactgtacagtcacgaccggtgctcgatttagatcacgtgcgtcggcgggggagctacaacaggcacggcaggggcagcaagactggtgttgcagacccaggtcttcatttctctgttgctctggatctctggtgccgtacggggtacttcgtgtatcgaacccagtcctccaggtacctcccgtggcctggtcgtcgttcgtgggtcgaggtacgggtaccaccagtaccgaactcgaccgtaacgtccaggacctaacggtacggtttacgttttttacacggtccttacccggaactaaaacttaaacggaaaccttaacgtttacggaccgtttacggaccctaacccgaaggaacctaaacggtaaaaccccgagggtaacccgtacgtacccgttaaccgtaaacggccgttacggtaccttccgttaacttttaccggtacgggtaccttaaccggtacccggttaaccccgggtaacggttcccccggggtacccgttacggtaacccggtaacgtttcgaacggttcgggacgttaccggggtaccgggtcgtacgggtaacgtaacggtacttttccgacgttaccttccggtaaaccttagtaccgtacggtacgtacccggtaccgtacgtaccggtacgtaccgtaggaaacggttcgtacggtcggtattacggtttacttaacgtcgtaccgtataccgttaattacgttacttcggtaaccctccgtaacggtccgttacggaccggtaacggaccgttaaggtacgtaacgacgtaaacgtcgtcggtgtaccgtcgacaccgtacg

SEQ ID NO: 152785 - DNA, 488 bp, Homo sapiens
  misc_feature: GYAE6OF02HVSKG.25.83.H06.1.454.CMB.1.raw
tcagactgtacagtcacgaccggtgctcgatttagatcacgtgcgtcgcggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactggcatctacccgggaatccggggtccctgaccgattcagtggcagcggtctgggacagatttcactctcaccatcagcagcctgcaggctgaagatgtgcagtttatactgtcagcaatattatagtactcctcgacgttcggcaggggaccaaggtgaaatcaaacgactgtgctgcaca

SEQ ID NO: 152786 - DNA, 497 bp, Homo sapiens
  misc_feature: GYAE6OF02JRJPX.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccggggtcctgacccgattcagtggcagcggtctgggacagatttcactctcaccatcagcagcctgcaggctgaacgatgtggctagtttattactgtcagcaattattatagtactcctccgacgttcgcagggaccaaggtggaatcaacgactgtgctgacactacg

SEQ ID NO: 152787 - DNA, 562 bp, Homo sapiens
  misc_feature: GYAE6OF02IHQ6O.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactggcatctacccggatccgggtcctgaccgattcagtgcaggcggtctgggacagtactttcactctcaccatcagcagcctgcaggctagaagtatgtagctagtttattactgtacagtactaaattattaactagtacctcctaccggtaccgtttccggacccgaagggggaaccctaaaggggtacggtaaaacgtaccgtaaaaaccggtacgttaggttacggaccttacggaccctaacccgtaacg

SEQ ID NO: 152788 - DNA, 522 bp, Homo sapiens
  misc_feature: GYAE6OF02H2Y8H.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgttttttacagctcgacaataagaactacttagcttggcaccagcagaaaccaggacagcctcctaagctgctcatttactgggcatctacccgggaatccgggtcctgaccgattcagtggcagcggtctgggacagtattcactctcaccatcagcagcctgccaggctagaagatggtgctagtttattacgtgtcagtcaattattatagtactcctccgacgttcgccgaggggaacctaagggtacggaaatacgaaacggtacgtggtacggcttagcctacgtaacg

SEQ ID NO: 152789 - DNA, 498 bp, Homo sapiens
  misc_feature: GYAE6OF02IV9M1.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccgggtccctgaccgattcagtggcagcggtctgggacagatttcactctcaccatcagcagcctgcagctgaagatgtgctagtttatactgtcagcaatattatagtactcctcgtacgttcgaccagggacctaaggtggaaatcgaaacgactggtgctcgacactac

SEQ ID NO: 152790 - DNA, 523 bp, Homo sapiens
  misc_feature: GYAE6OF02HEKXL.25.83.H06.1.454.CMB.1.raw
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccgggtccctgaccgattcagtggcagcgggtcnggacagatttcactctcaccatcagcagcctgcaggctagaagntgtgctagtttattactgtacagtcaattattaatagtactccgttaccgacgttcggaccgaggggtaccaaggtacggaaataccgaaacgaacgttcgtggactcggacacctacg

SEQ ID NO: 152791 - DNA, 550 bp, Homo sapiens
  misc_feature: GYAE6OF02I6042.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccggggaatccggggtccctgaccgattcagtggcagcgggtctgggacagatttccactctcacccatcagcagcctagcaggcctagaacgatggtggctagttttacttactgtaccagtctaaagttatttaatacgttacctcccgtacgtaccgttcggaccgaggggtaccctaaagggtcggaaaactcgaaaacgtacgttgaacggtcacggtccacctacg

SEQ ID NO: 152792 - DNA, 513 bp, Homo sapiens
  misc_feature: GYAE6OF02HMAXB.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccggggtcctgaccgattcagtggcagcgggtctgggacagatttcgactctcaccatcagcagcctgcaggctgaagatgtgctagtttattactgtacagtactaatattatacgtactcctccgtacgttcgccgaggggaccaagggtacgaaatacgaaacgtactgtacggctcgcactac

SEQ ID NO: 152793 - DNA, 796 bp, Homo sapiens
  misc_feature: GYAE6OF02F6V5D.25.83.H06.1.454.CMB.1.raw
  modified_base (174)..(174): a, c, t, g, unknown or other
  misc_feature (174)..(174): n is a, c, g, or t
tcagactgtacagtcacgaccggtgctcgatttagatcacgtgcgtcgcggggagctacaacaggcaggcaggggcagcaagatggtgttgcagacccaggtcttcatttctctgttgctctggatctctggtgcctacgggacttcgtgatgacccagtctccagaccctcgngtctgtcgtctcggtcggacgagggacggacccaactactaacctaacgtcgacgtaaccgtaccgaccgaccgaagtagtttttacgttttaacgacgtcccgtaccgaaactaaaagtaaacgtaaaccttagttacgttcgttcggaccaaccggacacgaaaaccgaaaccggagtaacgacgtccccttaacgaacgtcgtcgtcctactttaacttttacggcggacctacgttaccccgggtaaacccggggtaaccggttcccccggggttccctaccggaaccgttacctttacggtacgggtccggacgacggggttccggttacgggtaaccggaaacgtaggtttactttacccgactttaccaccctaaccgtactacgacgtaccgtaccgtcctacgacgacggttcgaaaggaaacgtgttggtcgtaacgttttagtttaacttacgtcgtagacgtaacttaattaatttaagttaaccgtacccttacccgtaccggttaccggttccggaacgggtaccgggtaaacggtaagggtaaacgtaaacgtaaccggaaaaccgttcggttacggtccggtagtccgtaacccgtacttaaccgg

SEQ ID NO: 152794 - DNA, 526 bp, Homo sapiens
  misc_feature: GYAE6OF02GSO55.25.83.H06.1.454.CMB.1.raw
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacnggcatctacccgggaatccgggtcctgaccgattcagtggcagcgggtctgggacagattcactctcaccatcagcagcctgcaggctgaagntgngcagtttatactgtacagacaattattanacgttacctacctccgtacgttcggaccgtaacggggaacctaagggtacggaaacttacaaacggtaactcggtaggactacgccaactacg

SEQ ID NO: 152795 - DNA, 552 bp, Homo sapiens
  misc_feature: GYAE6OF02JBIK6.25.83.H06.1.454.CMB.1.raw
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactactagcttgcaccagcaagaaaccaggacagcctcctaacgctgctcattactggcatctaccggaatccgggtcctgaccgattcagtgacaggcggtcgtggacagatttcgactctcaccatcagcagcctagcagntagaagatgnggtctagtttattacgtgtacgtagtactaagttactttaatacgtacccttccttaccgtacgttccggaccgtaacggggtaaccaagggttacggaaactaccgaaaacgtacgtaggtacggtcgtacgtacctaaccgtacg

SEQ ID NO: 152796 - DNA, 519 bp, Homo sapiens
  misc_feature: GYAE6OF02ITPUD.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttactgggcatctacccgggaatccggggtccctgaccgattcagtggcagcgggtctgggacagatttcactctcaccatcagcagcctgcaggctgaagatgtggctagtttattactgtcagtacaattattattacgtacttccgtccgtacgttcgccgtaggggacctaaggtacggaaatacgaaacgactggtcggactgacacctacg

SEQ ID NO: 152797 - DNA, 497 bp, Homo sapiens
  misc_feature: GYAE6OF02GGZ1D.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccggggtccctgaccgattcagtggcagcggtctgggacagatttcactctcaccatcagcagcctgcaggctgaagatgtgcagtttattactgtcagcaatattatagtactcctccgacgttcggccagggaccaaggtggaaatcgaaacgactgtggctgcactac

SEQ ID NO: 152798 - DNA, 500 bp, Homo sapiens
  misc_feature: GYAE6OF02GL8OT.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactggcatctacccggaatccgggtccctgaccgattcagtggcagcgggtctgggacagatttcactctcaccatcagcagcctgcaggctgaagatgtgctagtttattactgtacagactaatattatagtactcctccgtacgttcgccagggaccaaggtgaaatacaaacgactgtggctgacactacg

SEQ ID NO: 152799 - DNA, 508 bp, Homo sapiens
  misc_feature: GYAE6OF02FO8CW.25.83.H06.1.454.CMB.1.raw
  modified_base (404)..(404): a, c, t, g, unknown or other
  misc_feature (404)..(404): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgttttttacagctccgacaataagaactacttagcttggcaccagcagaaaccaggacagcctcctaagctgctcatttactgggcatctacccgggaatccggggtccctgaccgattcagtgcagcggtctgggacagatttcactctcaccatcagcagcctgcaggctgaagntgtgctagtttatactgtcagcagcgtagctagttcggcctcggggtactaggtttcggccgaggggaccaaggcgtggacgatacgaaacgacgtgtggtacg

SEQ ID NO: 152800 - DNA, 499 bp, Homo sapiens
  misc_feature: GYAE6OF02IG1YP.25.83.H06.1.454.CMB.1.raw
  modified_base (308)..(308): a, c, t, g, unknown or other
  misc_feature (308)..(308): n is a, c, g, or t
  modified_base (395)..(395): a, c, t, g, unknown or other
  misc_feature (395)..(395): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacnggcatctaccggatccgggtcctgaccgattcagtgcagcggtctgggacagatttcactctcacatcagcagctgcaggctgaagntgtggctagtttatactgtacagcaatattatagtactcctacgacgttcgacgagggaccaaggtggaaactacgaaacgactaggtagacgtacgcactacg

SEQ ID NO: 152801 - DNA, 513 bp, Homo sapiens
  misc_feature: GYAE6OF02GGZX3.25.83.H06.1.454.CMB.1.raw
tcagactgtacagtcacgaccggtgctcgatttagatcacgtgcgtcgcgggggagctacaacaggcaggctaggggcagcaagaagttaggtgttgccagacccaggtcttcactttcctctgttgctctggatctctgggtgcctacggggacttcgtgatgacccagtctccagactccctggctgtgtctctgggcgagagggccaccatcaactgcaagtccagccagagtgttttttacagctccgacaataagaactacttagcttggcaccagcagaaaccaggacagcctcctaagctgctcatttactgggcatctacccgggaatccggggtccctgaccgattcagtgcagcgggtctgggacagatttcactctcaccatcagcagcctgcaggctgaagatgtggcagtttatactgtcagcaatattatagtactcctcgacgttcggcctagggaccaaggtgaaatacgaaacgactcggtaggctaggcactacg

SEQ ID NO: 152802 - DNA, 520 bp, Homo sapiens
  misc_feature: GYAE6OF02I4K7Y.25.83.H06.1.454.CMB.1.raw
  modified_base (308)..(308): a, c, t, g, unknown or other
  misc_feature (308)..(308): n is a, c, g, or t
  modified_base (403)..(403): a, c, t, g, unknown or other
  misc_feature (403)..(403): n is a, c, g, or t
tcagactgtacagtcacgaccggtgctcgatttagatcacgtgcgtcgcgggggagctacaacaggcaggcaggggcagcaagattgtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacnggcatcgtacccggaatccgggtccctgaccgattcagtgcagcggtcgtgggacagactttcactctcaccatcagcagcctgcaggctgaagntgtggctagtttatactgtacagactaatattagtagtacctcctccgtacgttcggaccgacggggtaaccaagggtacggaaactacgaaacgactggtaggctcgacacctacg

SEQ ID NO: 152803 - DNA, 503 bp, Homo sapiens
  misc_feature: GYAE6OF02HG2WO.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttactggcatctacccgggaatccgggtcctgaccgattcagtggcagcggtctgggacagatttcactctcacatcagcagcctgcaggctagaagatgtggtagtttatactgtcagcaatattatagtactcctcgacgttcggcgagggaccaaggtaggaaatacgaacgtaactgtacggctacgactaccatcg

SEQ ID NO: 152804 - DNA, 534 bp, Homo sapiens
  misc_feature: GYAE6OF02HN0L0.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccggggtcctgaccgattcagtggcagcggtctgggacagatttcactctcaccatcagcagctgcaggctagaagatgtggctagtttattactgtacagctaattattaatacgtacctccgtaccgtacgttccggaccgtaggggacctaagggtacggaaacgttacgaaacgtaactcggtacggctacggacctacctacg

SEQ ID NO: 152805 - DNA, 543 bp, Homo sapiens
  misc_feature: GYAE6OF02H07SA.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgttttttacagctccgacaataagaactacttagcttggcaccagcagaaaccaggacagcctcctaagctgctcatttactgggcatctacccggaatccgggtcctgaccgattcagtggctacggcggtcgtgggaccaggtatttcgactcgtcaccatcagcagcctgccaggtctagaacgatagtggactagtttattactgttacagtactaatattactaacgtactccctaccgtacgttcgaccgagggaaccaggttacggaaacttacgaaaccgaacttacggtgtacgtgtaccacctacg

SEQ ID NO: 152806 - DNA, 500 bp, Homo sapiens
  misc_feature: GYAE6OF02HLVQI.25.83.H06.1.454.CMB.1.raw
  modified_base (404)..(404): a, c, t, g, unknown or other
  misc_feature (404)..(404): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccgggtcctgaccgattcagtggcagcgggtctgggacagatttcacgtctcaccatcagcagcctgcaggctgaagntgtgcagtttatactgtcagcaatattatagtactcctacgacgttcggacctaggggaccaaggtgaaatcgaaacgactggtagctgcactacg

SEQ ID NO: 152807 - DNA, 528 bp, Homo sapiens
  misc_feature: GYAE6OF02IZN2B.25.83.H06.1.454.CMB.1.raw
  modified_base (359)..(359): a, c, t, g, unknown or other
  misc_feature (359)..(359): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatcgtacccggaatccggggtccctgaccgattcagtgcagcggtcngggacagatttcactctcaccatcagcagcctgcacggctagaagatgtggctaaggtttattacgtgtacagctaatattattagtactcctacgtacgttcggaccgtaggggaaccctaaaggtcggaaatacgaaaacgaacgttggaggtactgtaccactaac

SEQ ID NO: 152808 - DNA, 502 bp, Homo sapiens
  misc_feature: GYAE6OF02FLZMS.25.83.H06.1.454.CMB.1.raw
  modified_base (235)..(235): a, c, t, g, unknown or other
  misc_feature (235)..(235): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttanagctccgacaataagaactacttagcttggcaccagcagaaaccaggacagcctcctaagctgctcatttactgggcatctacccgggaatccggggtccctgaccgattcagtggcagcggtctgggacagatttcactctcaccatcagcagcctgcaggctgaagatgtgctagtttattacgtgtcagcaattattatagtactcctccgacgttcgccgagggaccaaggtagaaatacaacgactgtggctcgcacctacg

SEQ ID NO: 152809 - DNA, 526 bp, Homo sapiens
  misc_feature: GYAE6OF02IFQ6A.25.83.H06.1.454.CMB.1.raw
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactggcatctacccgggaatccggggtccctgaccgattcagtggcagcgggtcngggacagatttcactctcaccatcaagcagcctgcaggctgaagntgtgcagttttaattacgtgtacagacaaattattaatagtacctcctccgtacgttcggacctaaggggaccaaggtggaaaatccgaaaacggacttcggtaggactgaccgactaacg

SEQ ID NO: 152810 - DNA, 570 bp, Homo sapiens
  misc_feature: GYAE6OF02G699R.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactactagcttgcaccagcagaaaccaggacagcctcctaagctgctcatttactggcatccgtacccgggaatcccgggtcctgaccgattcgagtggcaggcggtctgggacagtatttcactctcaccatcagcacgctgctaggctaggaagtagtggtggactagttttattacgtgtacaagtactaaagttattaagtacgttacctccgtacgtaccgttccgggtaccgtaacggggtaacccgtaagggtacggtaaacgtaaccgaaaaggtaaccgtggtacggtacgtaccggactacccgtaacg

SEQ ID NO: 152811 - DNA, 533 bp, Homo sapiens
  misc_feature: GYAE6OF02I9LJV.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccgggtccctgaccgattcagtggcagcgggtctgggacagatttcactctcaccatcagcagcctgccaggcctagaagatgtggactagttttacttactgtccagcctaaattattaatacgtacttccctacgtacgttccggaccgacgggaccaaggtacggaaatacgaaacgtacgtggtacggactcgacctactacg

SEQ ID NO: 152812 - DNA, 497 bp, Homo sapiens
  misc_feature: GYAE6OF02IKRQR.25.83.H06.1.454.CMB.1.raw
  modified_base (485)..(485): a, c, t, g, unknown or other
  misc_feature (485)..(485): n is a, c, g, or t
tcagactgtacagtcacgaccggtgctcgatttagatcacgtgcgtcgcgggggagctacaacaggcaggcaggggcagcgaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccggggtcctgaccgattcagtggcagcgggtctgggacagatttcactctcaccatcagcagcctgcaggctgaagatgtgctagtttatactgtcagcaatattatagtactcctccgacgttcgccaggggaccaaggtgaaatcaaacgactgngctgacactacg

SEQ ID NO: 152813 - DNA, 517 bp, Homo sapiens
  misc_feature: GYAE6OF02HMNS6.25.83.H06.1.454.CMB.1.raw
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttaagcttggcaccagcagaaaccaggacagcctcctaagctgctcatttacngggcatctacccgggaatcccggggtccctgaccgattcagtggcaggcgggtctgggacaggatttcacttctcaccatcagcagcctgcaggctgaantgtggcagttttatactgtcagctaatattatagtactcctaccgtacgttcgccgaggggtaccaagggtaggaaatacgaaacgacgtgtaggctggaccactacg

SEQ ID NO: 152814 - DNA, 517 bp, Homo sapiens
  misc_feature: GYAE6OF02IWZCV.25.83.H06.1.454.CMB.1.raw
  modified_base (279)..(279): a, c, t, g, unknown or other
  misc_feature (279)..(279): n is a, c, g, or t
  modified_base (420)..(420): a, c, t, g, unknown or other
  misc_feature (420)..(420): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacgggacttcgtgatgacccagtctccagctccctggctgtgtctctgggcgagagggccaccatcaactgcaagtccagccagagtgtttttacagctccgacaataagaactacttagcttgcacagcagaaacagganagctctaagctgctcatttactggacatccgtaaccggaatcccggggtccctgacccgaatttcaagtcggcacggcgggtcctaggggaaccaggaacttcaacttcacaaccatccgaacacgcctgcaaggctgaanagtgtgctacttatactgtcagcaatacttatacgtactacgtactaactttgaccagggaccaagcgtgacgatacgacaactggtagctgcaccg

SEQ ID NO: 152815 - DNA, 559 bp, Homo sapiens
  misc_feature: GYAE6OF02I6KSM.25.83.H06.1.454.CMB.1.raw
  modified_base (308)..(308): a, c, t, g, unknown or other
  misc_feature (308)..(308): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactactagcttggcaccagcaagaaccaggacagcctcctaagctgctcatttacnggcatcgtacccggactccgggtcctgaccgatcagtggcaggcggtcgtgggacagtactttcactctcacctatcagcacgcctagcgacggctaggaagtagttggtcggtacttagttttaacttacgttcgtacagactaaattatttaattacgtacctccgttaccgtacggttccggaccgaacggggtaccgtaagggtacggaaactacgaaacgtacgtaggtcgactcgaccacgtacg

SEQ ID NO: 152816 - DNA, 503 bp, Homo sapiens
  misc_feature: GYAE6OF02GNKQZ.25.83.H06.1.454.CMB.1.raw
  modified_base (400)..(400): a, c, t, g, unknown or other
  misc_feature (400)..(400): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccgggtcctgaccgattcagtggcagcggtctggacagattcactctcaccatcagcagcctgcaggctgaagntgtgctagtttatactgtcagcaatattatagtactcctcgacgttcgccgaggggacctaaggtggaaactacgaaacgtactggtggtacctgcacctacg

SEQ ID NO: 152817 - DNA, 559 bp, Homo sapiens
  misc_feature: GYAE6OF02HVP68.25.83.H06.1.454.CMB.1.raw
tcagactgtacagtcacgaccggtgctcgatttagatcacgtgcgtcgcgggggagctacaacaggcaggcaggggcagcaagatggtgttgcagaccccaggtcttcatttctctgttgctctggatctctggtgcctacggggacttcgtgatgacccagtctccagactccctggctgtgtctctgggcgagagggccaccatcaactgcaagtccagccagagttgtttttacagcctccgaacaaataagaactacttagcttggcaccagcagaaaccaggacagcctcctaagctcgctcattttactgggacatccgtaaccccgggaatcccggggtccctgacccgtattcagtggcaggtcgggtctgggacagtactttcactctacaccatcagcagcctgcaggctagaagtatgtcggatagttttattacttgtacagtactaattatttaattacgtactccgtaccgtacggttccggacgacggggtaacctaaggtacggtaaactaccgaaacgactggtacggctcgactacctacg

SEQ ID NO: 152818 - DNA, 545 bp, Homo sapiens
  misc_feature: GYAE6OF02HCQMT.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagaggccaccatcaactgcaagtccagccagagttgtttttacagctccgacaataagaactacttagcttggcaccagcagaaaccaggacagcctcctaagctgctcatttactgggcatcctacccgggaatccggggtccctgaccgattcagtggcacggcgggtcgtgggacaggtatttccacgttctaccaccatcagcacgcctgcacggctaggaagtgtgtcggctagtttattacgtgtacagtactaattattacttacgtacctcccgtacgtacgtccggaccgacgggaaccaaggtagaaactacgaaacgtacgtggtacggctacgaccactac

SEQ ID NO: 152819 - DNA, 536 bp, Homo sapiens
  misc_feature: GYAE6OF02JYWPG.25.83.H06.1.454.CMB.1.raw
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcattactggcatctacccggaatccggggtccctgaccgattcagtggcagcggtctgggacagatttcactcgcaccatcagcagcctgcagntgaagatgngctagttattactgtnagtctaaatattaatagtacctccgtacctacggtttccgaccgtaacggggacctaagggtaacggaaacttaccgaaaacgtacgttaggtacggactcggtacaaccccgtaag

SEQ ID NO: 152820 - DNA, 540 bp, Homo sapiens
  misc_feature: GYAE6OF02HUOJ4.25.83.H06.1.454.CMB.1.raw
  modified_base (308)..(308): a, c, t, g, unknown or other
  misc_feature (308)..(308): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgttttttacagctccgacaataagaactacttagcttggcacagcagaaaccaggacagcctcctaagctgctcatttacnggcatctaccgggaatccgggtcctgaccgattcagtggcagcggtctgggacagatttcactctcaccatcagcagcctgcaggctagaagatgtggactagtttattactgtcagactaaatattacgtagtactccttaccgacgtttccgggaccgaagggggaaccctaaagggtaggaaaactaccgaaaaccgaacgttggtacggactaggaccgaacctaacg

SEQ ID NO: 152821 - DNA, 537 bp, Homo sapiens
  misc_feature: GYAE6OF02FV2C2.25.83.H06.1.454.CMB.1.raw
  modified_base (411)..(411): a, c, t, g, unknown or other
  misc_feature (411)..(411): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggctatcgtacccgggaatcccggggtccctgaccgtattcagtcggcaggcggtctgggacagtatttcactctcaccatcagcagcctgcaggctgaagntgtgctagtttatacgtgtcagtactaattattatagtccttcctaccgtacgttccggacgtacggggaaccaagggtacggtaaactaccgaaacggtacctggtacggactcgaccacctacg

SEQ ID NO: 152822 - DNA, 742 bp, Homo sapiens
  misc_feature: GYAE6OF02H6MA5.25.83.H06.1.454.CMB.1.raw
tcagactgtacagtcacgaccggtgctcgatttagatcacgtgcgtcggcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaggagggccaccatcaactgcaagtccagccagagttgtttttacagctcgacaataagaactacttagcttggcaccagacagaaaccaggacagccctaccgtaacgctgtcttacatttttacgtgggtctacgttccgtaaccccggggtaacgttcccgggggtccctcggaacccgtatttccgaaggtcgggacgtacgggccggggttacgtaggggacctacggtacttttccgaaccgttcctaccaacccgtacttaccgagccgaacgtcccgtaggaccgagggtacctaggaaacggttagtcgggttacgggacgtttaagttttaaccgtttacgttacgttaccgtaagtaaccgtaaatttaacgtttaaattttaaccggttaacccctttacccgttacccgggttaaccgttttcccggggaacccggtaaccggggggtaaccgttaaacggggtaaacgggtaaaccttaaccggaaaaccggttaaccgttacgggacggttaccgtacgtacccgaacttaccg

SEQ ID NO: 152823 - DNA, 548 bp, Homo sapiens
  misc_feature: GYAE6OF02F6QBU.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcaagaaccaggacagcctacctaagctgctcatttactgggcatccgtacccgggaatcccggggtccctggaccgattcgagtcggcaggcgggtctgggacagatttcactctacaccatcagcagcctgcagctagaagatgtagctagtttattacgtgtacagactaagttattactacgtaccttccgtccgtacgttccggaccgaggggtacccaagggtacgtaaactaccgaaacggacgttggtcggaccgtacgacctacgtacg

SEQ ID NO: 152824 - DNA, 540 bp, Homo sapiens
  misc_feature: GYAE6OF02F6TA6.25.83.H06.1.454.CMB.1.raw
  modified_base (308)..(308): a, c, t, g, unknown or other
  misc_feature (308)..(308): n is a, c, g, or t
  modified_base (405)..(405): a, c, t, g, unknown or other
  misc_feature (405)..(405): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttacngggcatctacccgggaatccggggtccctgaccgattcagtggcagcgggtctgggacagatttcactctcaccatcagcagcctgcaggctgaagntgtggcagttttatactgtacagctaaatattaatagtacctcctaccgtacgtttccggaccgtaaggggacccaagggtaggaaaacttaccgaaaacggtaacgttggtacggactcggtaccaccgtaacg

SEQ ID NO: 152825 - DNA, 608 bp, Homo sapiens
  misc_feature: GYAE6OF02I11WC.25.83.H06.1.454.CMB.1.raw
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
tcagactgtacagtcacgaccggtgctcgatttagatcacgtgcgtcggcgggggagctacaacaggcaggcaggggcagcaagatggtgttgcagacccaggtcttcatttctctgttgctctggatctctggtgcctacggggacttcgtgatgacccagtctccagactccctggctgtgtctcgtggcgagacgggccaccatcaactgcaagtccagccagagttgttttttacagtctccgacaataagaactactagcttggcaccagcaanaaaccaggacagcctactagctgctcatttacngggctagtacctacccggggaacttcccgggtccctacggaccgtactttacgacggtaggcgaggtcgggtacgtggggacaggtactttccgaactccgtaccaacctataccagacacgcctcgaccaggtccgtaggaaacgtgttacggtggaccgtttagtttacttacgtgttaccagtacgtaaatttcttaagttactaccttccgtacgtaccggttcggaccggtaacgggaacgtaacggtaggtaaactacgaaacgtacgtcggtacggctcgacaccgtta

SEQ ID NO: 152826 - DNA, 579 bp, Homo sapiens
  misc_feature: GYAE6OF02I2XFK.25.83.H06.1.454.CMB.1.raw
  modified_base (309)..(309): a, c, t, g, unknown or other
  misc_feature (309)..(309): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcaagaaaccaggacagcctcctaagctgctcatttacnggtcagtccgtaccggaactccggggtccctgaccgatttcagtggcagcgggtcngggacngattcactctcacctncagcagtcctgcaggctagaaacgtagtcggtgactagttttattacgtgtacctagactaattaagttatacgtaccttccgtaccgtacgggtttcccggccggaacgggggttacccgaaaggttaccgggaaaacttaccgaaaaccggtaacttcgggttacggccgttacgacccgtacccgtacg

SEQ ID NO: 152827 - DNA, 573 bp, Homo sapiens
  misc_feature: GYAE6OF02HZIRY.25.83.H06.1.454.CMB.1.raw
  modified_base (344)..(344): a, c, t, g, unknown or other
  misc_feature (344)..(344): n is a, c, g, or t
  modified_base (430)..(430): a, c, t, g, unknown or other
  misc_feature (430)..(430): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagtagttgtttttacagctccgacaataagaactacttagcttggcaccagcagaaacaggacagcctcctaagctgctcatttacgtggcagtcacccgggaagtccgggtcctgaccgtnttcgagtggcgaggcgggtctggggactaggtatttccacttcctacaccctatccgaacgcagcctaggcaggtctagaaacgtntcggtgggtactaggtttactacttgttacgagtactaattattaactaacgtacttacccgtaccgtacggttccggaccgtaacggggaacctaaagggagtaaactacgaaacgacgttggcggtactcggacactaacg

SEQ ID NO: 152828 - DNA, 590 bp, Homo sapiens
  misc_feature: GYAE6OF02I1ACF.25.83.H06.1.454.CMB.1.raw
tcagactgtacagtcacgaccggtgctcgatttagatcacgtgcgtcgtcgggggagctacaacaggctaggccaggggcacgcaagatcggtgttgcagacccaggtcttcatttctctgttgctctcggatctctggtgcctacggggacttcgtgatgacccagtctccagacctccctggctgtgtctcgtgggcgagacggcccaccatcaactgcaagtccagccagtagttgtttttacagtctccgacaagtaacgaactacttagacttggcacagcaagaacaggacagcctactaagctgctcacttacgtgcatcctaccggatccgggtcctcgaccgtatcgagttcggctaggcggtcgtggacgagtacttcacttcactacatcagtcacgtcctgacgaggtacctggaagtagtcgtggacttagtttactactgtaccagtactaagttactttaatcggtacctccggaacgtccgttacggtaccgtacggggaaccttaaacggtcggtaaaaacgtccgtaaacgaccgttacggtacggtaccgtcgtaaccgtacccgttaacg

SEQ ID NO: 152829 - DNA, 513 bp, Homo sapiens
  misc_feature: GYAE6OF02HLJKK.25.83.H06.1.454.CMB.1.raw
  modified_base (404)..(404): a, c, t, g, unknown or other
  misc_feature (404)..(404): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactgggcatctacccgggaatccggggtccctgaccgatcagtggcagcgggtctgggacagatttcactctcaccatcagcagcctgcaggctgaagntgtgactagtttatactgtcagactaagtatttatagtacctcctccgacgttcggacctacggggaccaaggtcggaaatcaaacgtactaggtcgctcgcacctacg

SEQ ID NO: 152830 - DNA, 575 bp, Homo sapiens
  misc_feature: GYAE6OF02H2DXT.25.83.H06.1.454.CMB.1.raw
  modified_base (425)..(425): a, c, t, g, unknown or other
  misc_feature (425)..(425): n is a, c, g, or t
tcagactgtacagtcacgaccggtgctcgatttagatcacgtgcgtcggcgggggagctacaacaggccaggcaggggcagcaagatggtgttgcagacccaggtcttcatttctctgtttgctctggatctctggtgcctacggggacttcgtgatgacccagtctccagactccctggctgtgtctctgggcgagagggccaccatcaactgcaagtccagccagagttgtttttacagctaccgacaataagaactacttagcttggcaccagcagaaaccaggacagcctcctaagctgctcatttacgtgggcatccgtacccgggaacgttccgggtccctgacccgatttcagtggcaggcgggtctgggacagtatttccactcctcaccatcagcacgcctgcaggtctagaagtntggtcggtctagtttacttactcgtactagaactaagttactttaattacgtaccttcccgttaccgtaccgtttcgggaccgtacggggtaaccaagggttacgaaataccgaaacgtacgttcggtacggacgtacgacctacctacg

SEQ ID NO: 152831 - DNA, 695 bp, Homo sapiens
  misc_feature: GYAE6OF02H8BWB.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaggagggccaccatcaactgcaagtccagccagagttgtttttacagctcgaacaataagaactacttagcttggcaccagcaagaaccagacagcctcctaagctagctcattttacgtgggcacgtccgtaacccggggaacgtcccggggtccctacggacccgtattcgaggttcggacgaggccgggttcgtacgggacaggtactttcaccttcgtaccaacctataccaggtccagtcccgtagggaccctaggggtccttaaggaaacggttactacgggtacggttaccgttaagttttactttacgtacgttacagtaacttaaattacgtttaaacttacggttaaaccctcccggttaaccggtacggtttacccggggaccggtaacgggggaaaccccgttaaaggggttaacggtaaaaccgtttaaccggaaaaacccggttacgttcgggtaaccgggtccgttacggtacccctaaccgttaacg

SEQ ID NO: 152832 - DNA, 638 bp, Homo sapiens
  misc_feature: GYAE6OF02G557P.25.83.H06.1.454.CMB.1.raw
tcagactgtacagtcacgaccggtgctcgatttagatcacgtgcgtcgcgggggagctacaaccaaggcaggcaggggcagcaagaatggtgttgcgagacccaggtcttcattttctactgttgtctctggatctctggtgccgtacgggacgttcgtaggatgacccagtctccagactccctggctgtgtctctggcgagaggccaccatcaactgcaagtccagccagagttgtttttacagctccgacaataagaactacttagcttggacaccagcaagaaaccaggacagcctctaagctgctactatttacgtggcacgtccgtaacccgggaacgttcccggggtccctaggacccgtactttcgacggtggacgaggtcggggtcgtaggggaactacggtatttccacttcctaccaacctataccaagcacgtcctagaccgaggaccgtaggaaagtgttcggtaggtaccttaaggttttacttaacgttggtaaccgtacgtaacttaagttaattacgttaacgttacctacctaccggtacgttccggaccggtacgggtaacctaagggtaagaaaccgtacgtaaacgaacgtggtacggactacggtaccacttaccg

SEQ ID NO: 152833 - DNA, 699 bp, Homo sapiens
  misc_feature: GYAE6OF02HKTPC.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgactacgcacgacagtagttttacgttttacgagtccgtaccgaactaaagtaaacgtaaccttacgtacgtcgttacggaccaacgacgacgaaacgaaaccgacggaactacctcccttaaccgtaacgtccgtcgtcctacttaacttttacggcggactacgtacccggtaaccggtaccggtccccgggtccacggaccgtactacgtaggtcgacgacgggtccggttgacggacagttacttacgaccttcacctaacctactacgacgacaccgtcgtcgacggacggtcgtaagaacgtagttggtacgtactttaagttttactacgtcgtacgagtaacttaagttattaacgttacgtacccttacccgtaccggttaccgggtaccggtaccgggtaaccgggtaacggtaagggtaaacgtaaacctaaccggtaaaacgtcgtacgggtacgtccggtacgaccctacttaccg

SEQ ID NO: 152834 - DNA, 753 bp, Homo sapiens
  misc_feature: GYAE6OF02GDC1K.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtcctcgtggcgaggacggcccaccatacaactcgacgaacgtccacgccaaggtagttttacgtttttaacacgtcctaccgaactaaataaacgaaacttacttacgtcgttcggaccaccgagacgaaacgaaaacccgaagggaaccacgtaccccttaaccgtaaacgccgttcgtaccttacttaacgttttacgtcgggtacctaaccgttacccgggtaaacccccgggggtaaaccggttcccccgggggttacccctacggtaacccgtactttaccggtacgggtcgggacgaacggggtccggggtacgtacggggaactaacggttactttccgtaaccgtcctacccaacctacgtaccgacgccaacgtccgtacgccgtacggacgtaggaagtacgttggtacggtacttaggttttattacgtgtacacgtactaagttattaacgttacgtacctaccgtaccggtacggttccgaccggtacgggtaaccgtaagggtaacgtaaacgtaacgaaaccgtacgtcggtaccgtacgtacgacctacgtaccg

SEQ ID NO: 152835 - DNA, 531 bp, Homo sapiens
  misc_feature: GYAE6OF02GY1HD.25.83.H06.1.454.CMB.1.raw
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactactagcttggcacagcagaaaccaggacagcctcctaagctgctcattactggcatcgtacccggatccgggtcctgaccgatcagtgcagcggtctgggacagtatttcactctcacctatcgaagccagcctgacagctagaagntgngctagtttactntgtcagtctaatattatagtactccgtccgtacgttccggacgacggggtaacctaaggtacggtaaactaccgaaaacgtacgtcggtaggaccgttaggaccctaccgtacg

SEQ ID NO: 152836 - DNA, 568 bp, Homo sapiens
  misc_feature: GYAE6OF02FLCFH.25.83.H06.1.454.CMB.1.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (382)..(382): a, c, t, g, unknown or other
  misc_feature (382)..(382): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctggcgagagggccacatcaactgcaagtccagccagagtgtttttacagctccgacaataagaactacttagcttggcaccagcagaaccaggacagcctacaagctgctctattacnggcatcgtacccgggaactccgggtccctgaccgattcgngtggcacggcggtctgggacagtattcactctcgaccntcagcacgcctgccgaggcctagaacgagtgtggactagtttatacgttcgactacgtactaaattatttaacgtagtacccttccgtacccgttaccggttaccggaccgtaacggggtaacccgtaagggtaacgaaacgttaccgaaaacgtacgttaggtccggacgtcgaccgtacctacg

SEQ ID NO: 152837 - DNA, 745 bp, Homo sapiens
  misc_feature: GYAE6OF02JBWLP.25.83.H06.1.454.CMB.1.raw
tcagactgtacagtcacgaccggtgctcgatttagatcacgtgcgtcgcggggagctacaacaggcaggcaggggcagcaagatggtgttgcagacccaggtcttcatttctctgttgctctggatctctggtgcctacgggacttcgtgatgaccagtctccagctccctggctgtgtctcgtgggcgaggacgggaccaccatacaaactacgacgtacgtaccgacgaccgtacgtagttacgtttacgtacgtaccgtaccgtaaacgtaaacgtaaacgtaaaccgttaacgttaacgttacgttcggtaaccgaaccgtaacggtaacgaaaccgtaaaccggtaaccggaacgaccgtacccgtaaccgtaacgtacgtacgtaccgtacttaacgttacgtacggtacgtaccgtaaccggtaaccggtaaccgggttacccggtacccggtaaccgtaaccgtacgtacgtacggtacggtacgtacggtacggtacggtacggtaacgtaacgttacgtacgtacctactacctacgtactacgtacgacgacgtacgtacgacgacgtacgtaacgtaacgtagtagtacgtacgttaacgttaacgttacgtacgtacgtacgtaataattatagtacgtacgtacgtacgtacgtacgtacggtaacggtaacgtgaaacgtacgtaaacggtaacgtaacggtaacggtacgtacggtaccgtaccgtacg

SEQ ID NO: 152838 - DNA, 736 bp, Homo sapiens
  misc_feature: GYAE6OF02IJ8JG.25.83.H06.1.454.CMB.1.raw
  modified_base (186)..(186): a, c, t, g, unknown or other
  misc_feature (186)..(186): n is a, c, g, or t
  modified_base (336)..(336): a, c, t, g, unknown or other
  misc_feature (336)..(336): n is a, c, g, or t
tcagactgtacagtcacgaccggtgctcgatttagatcacgtgcgtcgcgggggagctacaacaggcaggcaggggcagcaagatggtgttgcagacccaggtcttcattttctctgttgctctggatctctggtgcctacggggacttcgtgatgacccagtctccagactccctggcctgtgtntcgtggcgagagggccaccatacaactgcaagcagcagtagttgtttttacagctacgaacaaataacgaactacttagcgttaggaccaacagacaaacgaacccaggaacacgacctacctaagtctacgctacttaagttttaccgnggggacctaacgttaccgtaaccccgggggtaacgttccccggggttaccctagaacccgtatttccgaagggttcgggacgacgggtacccggggttcggaggggtaaccaggtacttttaccgacttaccgtacaccaagttccgacggaccgtaagcccgtacggacgtacgggtcgtaacggtaaagtagtacggtggtaacctttaaggtttacttacgttacgtaccgtaagtactaaattattaaaccgtttaccgttaccttaccccggttaccgggtaaccggtttaccgggacccggtaaacggggtaacccggtaaggggtaaacggtaaaccttaaaccgggaaaaccgttaacgtcgggtacggtactacggtacccacgttaacgg

SEQ ID NO: 152839 - DNA, 590 bp, Homo sapiens
  misc_feature: GYAE6OF02I44OR.25.83.H06.1.454.CMB.1.raw
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctcagactccctggctgtgtctctgggcgagagggccaccatcaactgcaagtccagccagagttgtttttacagctccgacaataagaactactagcttggcaccagcaagaaccaggacagcctcctaagctgctcatttacgtgggcatccgtacccgggaatccggggtccctaacgacttcagtggcagcgggtctggganagatttccactctcacctatcagcngcctgcaggcctgaagtntggtggtctagtttacttacgtgtcagactaatttattaacgtaagttacctcccgtaccgtacgggttccggacccgtaacggggaacccgtaaaggggttacggtaaaacttaaccgaaaaccggttaaccgttacgggtcggtaccggttacgaccgtaacccgtatttaccccgg

SEQ ID NO: 152840 - DNA, 559 bp, Homo sapiens
  misc_feature: GYAE6OF02IDV91.25.83.H06.1.454.CMB.1.raw
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcagaaaccaggacacgcctcctaagctgctcatttacnggcatctacccgggaatccgggtcctgaccgtnttcagtgcaggcgggtctggacagatttcactctcacatcagcagcctgcaggctagaagatggtgcgtagtttaattactgtacagactaattattaatacgtactcccgtaccgtaccgtttccgggaccgtaacggggtaaccgtaagggtacggtaaaacgttaccgaaaaccggtacgttcgggtacggacccgttaggacccacctaacg

SEQ ID NO: 152841 - DNA, 515 bp, Homo sapiens
  misc_feature: GYAE6OF02G0K38.25.83.H06.1.454.CMB.1.raw
  modified_base (307)..(307): a, c, t, g, unknown or other
  misc_feature (307)..(307): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttacngggcatctacccgggaatccggggtccctgaccgattcagtggcagcgggtctgggacagatttcactctcaccatcagcagcctgcaggctgaagatgtggctagtttattactgtacagcaattattatacgtacctcctaccgacgttcggaccgacggggaccaaggtaggaaatacgaaacgactggtaggctgaccactacg

SEQ ID NO: 152842 - DNA, 567 bp, Homo sapiens
  misc_feature: GYAE6OF02IWHIL.25.83.H06.1.454.CMB.1.raw
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacgggacttcgtgatgacccagtctccagactccctggctgtgtctctgggcgagagggccaccatcaactgcaagtccagccagagtgtttttacagctccgacaataagaactacttagcttggctaccagacagaaacaggacagcctcctaagctgctcatttactgggcatccgtaacccggaagtcccggggtcctagacccgattccgagtggaccagcggtntgggacaggntttcactctcaccatcagacngtcctgccgtaggctagaacgtagtggtacgtacgtagtttatacgtgtacagtacaaattattaagtacgtacctcctcggaccgttcggaccgtacgggaaccaagggtacggtaaactaaccgaaaacggtacctaggttacggaccttacggaccgacctacgg

SEQ ID NO: 152843 - DNA, 613 bp, Homo sapiens
  misc_feature: GYAE6OF02INB9T.25.83.H06.1.454.CMB.1.raw
  modified_base (318)..(318): a, c, t, g, unknown or other
  misc_feature (318)..(318): n is a, c, g, or t
  modified_base (416)..(416): a, c, t, g, unknown or other
  misc_feature (416)..(416): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagtagttgtttttacagctccgacaataagaactacttagcttggcaccagacaagaaaccaggaacacgtacctcctaagctgctccattttacngggcatccgtaaccggaacgtcccgggtcctcgacccgattcgagtggcacggcggtacgtcgggacaggtatttacgacttctcaaccctatcaacncgacgtcctgccaggccttaagaaggtatcggtaagcgttaaggttttactttaacgttcggtacacgtataaagtttatttaacgtaacgtacccttccgtaccgtacggtttccggaacgtaccggggtaactaacgggtacgtaaaccttaacgaaacgttacggtggtaaccggtcgaccgtacaccgttacg

SEQ ID NO: 152844 - DNA, 590 bp, Homo sapiens
  misc_feature: GYAE6OF02HIQU6.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcagaaaccaggacacgcctacctaagctgctcatttacgtgggcactccgtaaccccggggaagtcccgggggtccctacggacccgattcagttggcaggcgggtctgggactagtactttcactctaccaccatcgaagccacgcctgccgaggcctaggaaagtgtggtggctaggttttactacgtgtcagtactaattattacgtagttacctccgttaccggtacggttacgccggtaacgggggaaccgtaagggttacgggaaaactaccggaaaccgtacgttacggtaggacctacggcctacctacg

SEQ ID NO: 152845 - DNA, 551 bp, Homo sapiens
  misc_feature: GYAE6OF02FLO6S.25.83.H06.1.454.CMB.1.raw
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcaagctgctcatttactgggcactcgtacccgggaatccggggtccctcggaccgatttcgagtcggcaggtcggtcgtggactagactttccactctcaccactcacgcacgcctgcaggctagagagtgngtctagtttatactgtacagtanaattattatagtacctctaccgtacgttccggacgtacgggaaccgtaaggtaacggtaaactaccgtaaacgaaccgttaggtacggtcgacggtacaccgtaacg

SEQ ID NO: 152846 - DNA, 692 bp, Homo sapiens
  misc_feature: GYAE6OF02JAR5V.25.83.H06.1.454.CMB.1.raw
  modified_base (241)..(241): a, c, t, g, unknown or other
  misc_feature (241)..(241): n is a, c, g, or t
  modified_base (279)..(279): a, c, t, g, unknown or other
  misc_feature (279)..(279): n is a, c, g, or t
  modified_base (414)..(414): a, c, t, g, unknown or other
  misc_feature (414)..(414): n is a, c, g, or t
tcagactgtacagtcacgaccggtgctcgatttagatcacgtgcgtcgcgggggaggctacaacaggcaggcaggggcagcaagatggtgttgcagaccaggtcttcatttctctgttgctctggatctctggtgcctacggggacttcgtgatgacccagtctccagactccctggctgtgtctcgtgggcgagagggccaccatcaactgacaacgtccagccagagttcgtttttacngctaccgacaataagaactacttagcttgcaccagcanaaccaggacagcctacctaacgctgactctatttacgtgggacacgtaccgtacccgggaacgtcccggggtaccctcggtaccgacttcgagtcggcgacggtcgggtaccgtcgggactaacgtactttaccncctactacctacccgtactcgaacgtaccgacgcctcgaccgagtccgtaggaacgagttggtacggtctaaggtttacttacgttcggtactagtaacttaacgttaagtttaacgttaacgttacccttacccgttacccggttacggtttcccgggaaccgttaccggggggtaaaccttaacggggttaagggtaaaaccgttaacccggtaaaacggttaacccggttacgggttaaccggtaccgtaccggtaaccgtaccccggttaaccg

SEQ ID NO: 152847 - DNA, 566 bp, Homo sapiens
  misc_feature: GYAE6OF02IIVJR.25.83.H06.1.454.CMB.1.raw
  modified_base (323)..(323): a, c, t, g, unknown or other
  misc_feature (323)..(323): n is a, c, g, or t
  modified_base (454)..(454): a, c, t, g, unknown or other
  misc_feature (454)..(454): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagtagttgtttttacagtctaccgaacaaataaacgaactaacttaagcttggcaccagcaagaaaccaggacagcctaccctaaagctgctacatttacngggacatccgtacccggagtcccgggtaccctgacccgtattacagtggacaggcgggtcagggacagtatttcactctaccacatcagcagcctagacaggctagaagatggtgactagtttatatgtanagactaattattattacgtacctccctacggtaccgttacggccgtaacgggaaccgtaagggtacggaaagtaacgaaaacgtacgtacggtacggtactcgaccactacg

SEQ ID NO: 152848 - DNA, 521 bp, Homo sapiens
  misc_feature: GYAE6OF02IHE6B.25.83.H06.1.454.CMB.1.raw
  modified_base (307)..(307): a, c, t, g, unknown or other
  misc_feature (307)..(307): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctctaagctgctcatttacnggcagtctacccgggaatccgggtcctgaccgattcagtgcagcggtctggacngattcactctcacatcagcagctgcaggctagaacgtntgtgtctagttttattactgtacagactaattattagtagtacctccgtaccgacgttcggaccgtaggggaccaaggtaggaaactacgaaacgtacgtacggtcggctacgcctactacg

SEQ ID NO: 152849 - DNA, 607 bp, Homo sapiens
  misc_feature: GYAE6OF02H1VS3.25.83.H06.1.454.CMB.1.raw
  modified_base (252)..(252): a, c, t, g, unknown or other
  misc_feature (252)..(252): n is a, c, g, or t
  modified_base (326)..(326): a, c, t, g, unknown or other
  misc_feature (326)..(326): n is a, c, g, or t
tcagactgtacagtcacgaccggtgctcgatttagatcacgtgcgtcgcgggggagctacaacaggcaggcaggggcagcaagatggtgttgcagaccccaggtcttcattttctctgttgctctggatctctggtgcctacggggacttcgtgatgacccagtctccagactccctggctgtgtctcgtgggcgaggagggccaccatcaaactgcaagtccagccaagtagttgtttttacagctccganaaataaagaactaacttagcgttggcaaccagacaagaaaccaggacacgcctactaagctgctacatttacgnggacacgtccgtaaccgggtaacgtcccggggtcctaggacccgtattccgaggtggacaggcgggtcgtagggaccaggtacttccgacctcgtacaacccatcaagcgacgcctaggacagggtctaggaaagtacgtgtgtactagtttaatacgttagtacagtactaaatatttaactacgtacctccgtaccgtacgttaccggacggtaacgggaacgtaacgggtacgaaaactaccgaaaaccgtacgtaggtacggactacgacaacctag

SEQ ID NO: 152850 - DNA, 579 bp, Homo sapiens
  misc_feature: GYAE6OF02FK2VX.25.83.H06.1.454.CMB.1.raw
  modified_base (435)..(435): a, c, t, g, unknown or other
  misc_feature (435)..(435): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaggagggccaccatcaactgcaagtccagccagtagttgtttttacagctccgacaataagaactacttagcttggcaccagcaagaaccaggacagcctcctaagctgctctatttactgggctactccgtaccccggggaactcccggggtccctcggacccgtacttcgaggtggcgaggcgggtcgtgggacagtatttcactctccaccatcagcagtcctgcacggctaggaacgngttggtggtcttaagttttattacgtgtacagtactaattattaattacgtaccttccgtaccgtacggttaccggccggaacgggtaaccgtaaggtacggtaaactaccgaaacgtacgtcggtagctacgacctacctacg

SEQ ID NO: 152851 - DNA, 696 bp, Homo sapiens
  misc_feature: GYAE6OF02H5SYQ.25.83.H06.1.454.CMB.1.raw
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctggcgagaggccaccatcaactgcaagtcagccagagtgtttttacagctcgacaataagactacttagcttgtatcagcagaanccaggacagcctcctaagctgctcactttccgnggacatccgtaacccgggaatcccgggggtccctacggaccgtacttccgaggttcggaccaagggccgggttcgtacggggacgtacgtacttttaccgaccttcgtactacttaccgaattccgaaggtccgggtcccttacggacccgtaaacccttcggaaaccgtagttcggggttacggttacgggttttaactttaacgtacgttaccgaaaggtaccctaaaacgtaacccttaattaccccgtttaaacccttcccggttaaccggtaccgtttacccgggacccgtaaaccggggtaacccgtaaagggttaactaaacgtttaccgaaacgtaccggtaacgttagggtaccggtaccgtacggtaccctaacccttacgg

SEQ ID NO: 152852 - DNA, 636 bp, Homo sapiens
  misc_feature: GYAE6OF02FU2TL.25.83.H06.1.454.CMB.1.raw
  modified_base (274)..(274): a, c, t, g, unknown or other
  misc_feature (274)..(274): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacacgctccgacaataagaactaacttagcttggcaccancaagaaaccgaggacacgcctacctaagcctgctctatttacgtgggactataccgtacccgggaacgtcccggggtccctacggacccgtattcaaggttcggacgacggtcgggtacgtcgggacacggtatttccgactccgtaccaacctacgtcacgaccacgcctacggacaacgggtcctaagggaaacgtgttacggtaggtaccgttagttttaacttacgttcgtactagtacctaaattatttaacgttacgtaacccttccgtaccgtacggttccgaccggtaacggggtaacctaaggttacggaaacgttacgaaacggtacgtggtacggactcgaccacgttacg

SEQ ID NO: 152853 - DNA, 644 bp, Homo sapiens
  misc_feature: GYAE6OF02JKJOL.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttcgctctggatctctggtgcctacgggacttcgtgatgacccagtctccagacctccctggctgtgtctctggcgagagggccaccatcaactgcaagtccagccagagttcgtttttacagctccgacaataagactactagcttgcacagcagaaccagacagcctcctaagctgctcattactggcactcgtaacccggatacccgggtccctacggaccgtattcgaacgttcggacgacggtcgggtacgtggggaaccacggtactttccgaactccgttaccacccagttaccacggtccaacggtccttacggaccgacgggtactacggtaaaacggtcttacgggtacgggcttaacgtttttaaccgttacgttacggttacaggtaacctaaagtttaaccgtttagtaacgttaaccgtccttacccggtaccgttcggacccggtaagggtacccgtaaggtacggtaaacgtaacgaaacgtacgtaggtacgtcgtacgtaccgaacctcg

SEQ ID NO: 152854 - DNA, 903 bp, Homo sapiens
  misc_feature: GYAE6OF02I6Z55.25.83.H06.1.454.CMB.1.raw
tcagactgtacagtcacgaccggtgctcgatttagatcacgtgcgtcgcgggggagcgtacaacaggcaggcagggcagcaagatggtgttgcagacccaggtcgttcatttctctgttgtctctggatctctggtgccgtacgggacttcgtgatgaccctagtctccagactcctggctgtgtctcgtgggtcgaggacgggtccgaccacgtccaacgtgtacaaacggtccaacgccacggtagttcggttttttaacacggtccgtacccgaaccgtaaattaaacggtaaacctaacgttaacgtacgtttacggcccgttaaccaaggtaccgaaacgtaaaaaccccgaacggggtaaccaaacgggtacccccttaacccgtaaaacgggtccttaccgggtacctttaaccgtaaacggtttttaaccgtacgggggtacctaacgttacccggttaaaccccggggtaaaccggttccccgggggttaccccgtaccgggtaaccccggttaaacggtttcccgtaaccgggttaccggggacccgtaacggggttcccgggggttaccgtaacgggggtaaccctaacgggttacgtttacccgtaacgttacccggtttaccaaacccgtaaccgtcgtaaacccggtcgtaaacccggtccgttaacggaccgtaacgggcctttaggaaacggttcgtacggttacggacgtttaacgttcgttacgtcgtaccgtacgtaagtaaccgtttattacgtaaccgttaaccgtccgttaccggtacgttccccgggtacggaaaccgggtaccgggtaaacggttccggaaaacgttaaccgaaacggttaaccggtgttaccggacgtacgtacccgtacccgtaacg

SEQ ID NO: 152855 - DNA, 590 bp, Homo sapiens
  misc_feature: GYAE6OF02FW0VR.25.83.H06.1.454.CMB.1.raw
  modified_base (313)..(313): a, c, t, g, unknown or other
  misc_feature (313)..(313): n is a, c, g, or t
tcagactgtacagtcacgaccggtgctcgatttagatcacgtgcgtcgcgggggagctacaacaggcaggcaggggcagcaagatggtgttgcagaccccaggtcttcattttctctgttgctctggatctctggtgcctacggggacttcgtgatgacccagtctccagacctccctggctgtgtctctggcgagagggccaccatcaactgacagtccagccagtagttgtttttacagctccgacaataagaactacttagcttggcaccagcagaaaccagacagccctccaagctgactctatttacngggcatccgtacccgggtaacgtcccggggtccctcgacccgtattacgacgtggcaggtcgggtcgtagggacaggtctttcactcaccacctatcgagccagtccgtgaccaggtctagaagagttgtcggtacttagtttattactgtacagtactaaattcgttaatacttacctacctacccgtaccgttccggaccggtaacggggtacctaaaggtacggtaaactaccgtaaacgacgttacggtacggtcctacggacctaccgtacg

SEQ ID NO: 152856 - DNA, 709 bp, Homo sapiens
  misc_feature: GYAE6OF02HHQNB.25.83.H06.1.454.CMB.1.raw
  modified_base (259)..(259): a, c, t, g, unknown or other
  misc_feature (259)..(259): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagagggccaccatcaactgacaacgtccagccagtacgttgtttttacagtctaccgacaaataanaactacttagcttggcacagacagaaaccacgacagcctactaagctcgcctactactttacgtcgggactactaccgtaaccccgggaacgtcccggggttacctacgaccgtactttacggaacgtgggacgacggtccgggtcgtacggggaactaagttacgtttaccacgttcctaccgtaacccagttaccgaagaccgtaccgtaccgtacggccgtagggtacctaagggtaacgacgttgggtacggtacgtttacgttttaacgttcgtaccgttaagacgtaacttaatttaacgtttaagttaacgttaacccttcccgttaccgtaaccgggttcccggaaccgggtacgggtaaccgttaaagggtaacggtaaacgttaaccgaaaaccggtacggtttacggaccggtccggtaacgtacccgactttaaccgg

SEQ ID NO: 152857 - DNA, 634 bp, Homo sapiens
  misc_feature: GYAE6OF02INOLF.25.83.H06.1.454.CMB.1.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (323)..(323): a, c, t, g, unknown or other
  misc_feature (323)..(323): n is a, c, g, or t
  modified_base (450)..(450): a, c, t, g, unknown or other
  misc_feature (450)..(450): n is a, c, g, or t
  modified_base (518)..(518): a, c, t, g, unknown or other
  misc_feature (518)..(518): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggactctctggtcgcctacggggaccttcggtgtatcggacccagtcctccacgtacctccctggcctgtgtctcgtcgggcgagcgggccacctancaactgcaagccacgctagagttgttttacngtccnccgaanaactagaactactanacgttgcaaccagataacgaacacggaatacgtacctcgtaaacgntacgctaccagtttagcgggactaactaccggaaccggtacgccccggggtttactaccgaccgtaagttccgagttcgggaccagggtccgggttacaggactagtctttacacgtctacaacctnaccgacgtcacgtcgcacgtacgacgtaagacgtagtcggtactacgtaacttacgtactgacgtaanaactaattacttaacgtaccgtaactaccgtacgtgtaccgggacggtaacggaaccgtaggtaacgaaaccgttacgaaactacggttaccgtagtccggactaccgtaacgtac

SEQ ID NO: 152858 - DNA, 721 bp, Homo sapiens
  misc_feature: GYAE6OF02ITHGQ.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatgacccagtctccagacctccctggctgtgtctcgtggcgagacgggccaccatcaactgcaagtccagccgagtagttgtttttacagtcctaccgacaaataagaactacgtagtcgttcggacaccagaccaagaaaccgagacacgaccctactaacgctcgctactatttacgcggacacgtaccgtaacccggtaacgtcccgggtacctacgacgtattacgaggtcggacgtacggtcgggtcgtcgggactaaggtactttccacttccgtacctaacccgattaccgacgcgtaacgtcccgtagccgacggtacgtaagaacgttagtggtacggactttaaggtttactacgttacggtaccaacgtaccgttaattacgtttaacgtaacgttacccgttacccgttaacccggtaacggtttaccccgggtaccgggtaaacgggggtaacccgtaacgggggttaaacgaaaccgtttaaacccgggaaaccggtttaaccggtacggggttaccggtaaccgttaaccggtaccctaacccggttacccgg

SEQ ID NO: 152859 - DNA, 636 bp, Homo sapiens
  misc_feature: GYAE6OF02JYG4E.25.83.H06.1.454.CMB.1.raw
  modified_base (309)..(309): a, c, t, g, unknown or other
  misc_feature (309)..(309): n is a, c, g, or t
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcagaaccaggactagcctctaagctcgctctattacnggctatcgtacccggggtaatcccggggtaccctcggaccgtagttcgtaggtcggtacgacggtccgggtacgtcgggactagtacgtttcacttcgtacaccatcacgcncgacctgacacggcgtagaagtntcgtcggtacttaggtttaacttcgtacggtactagtaccttaaagttatttaacgttacgtacccgtttacccgtacccgttacgggttaccgtaccggtaacggggtaccgtaaacgggttaggtaaaaccgttacgaaaccggttaacgttacggtaccggtacgtttaccggaccgttacttaaccgg

SEQ ID NO: 152860 - DNA, 623 bp, Homo sapiens
  misc_feature: GYAE6OF02JC0QE.25.83.H06.1.454.CMB.1.raw
  modified_base (322)..(322): a, c, t, g, unknown or other
  misc_feature (322)..(322): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggatgtgtctcgtgggcgagacgggccaccatcaactgcaacgtccagccagtagttcgtttttacacgtctaccgacaataagaactacttagcttggcaccagcaacgaaccaggacagcctctaagctcgctactactttacgnggctacgtccgtaaccgggaacgtccgggtacctaggaccgtattcgaggtcggacgacggtcggtacgtgggaacaggtactttccgacgttctaccaaccactaccgacgcacgacctgacgacgggtactaggaaagtcgttcggtaggtacttaggtttactaacgtgtacaagtctaaagttattaacgtacgtaaccctccgtacccggttaacgtccggacggaacggggtaccgtaaagggtacgtaaacgtacgtaacggtaacgtcggtacgacgtaccgacctacttacg

SEQ ID NO: 152861 - DNA, 574 bp, Homo sapiens
  misc_feature: GYAE6OF02H3RHR.25.83.H06.1.454.CMB.1.raw
  modified_base (381)..(381): a, c, t, g, unknown or other
  misc_feature (381)..(381): n is a, c, g, or t
tcagactgtacagtcacgaccggtgctcgatttagatcacgtgcgtcgcgggggagctacaacaggcaggcaggggcagcaagatggtgttgcagaccccaggtcttcatttctctgttgctctggatctctggtgcctacggggacttcgtgatgacccagtctccagactccctggctgtgtctctggcgagagggccaccatcaactgcaagtccagccagagtgttttttacagctcgacaataaagaactacttagcttggcaccagcagaaaccaggacagcctcctaaagctagctcagtttactgggcaatctacccgggaatccggggtacctgaccgatttcaagtggccagcgggtctgggacagatttnaacgtctcacctatctaacgcaagcctgcaaggccttagaagatgtgggcaggtttaacttaacgtggtactaggccaaattacttaattacgtaactccgtcccaacgtttccggacctaggggaaccaacgggtaggaaacgttaaacgaaacggtaaactacggtcggtacgtacgtaccgacctaaccg

SEQ ID NO: 152862 - DNA, 735 bp, Homo sapiens
  misc_feature: GYAE6OF02G5FVJ.25.83.H06.1.454.CMB.1.raw
  modified_base (320)..(320): a, c, t, g, unknown or other
  misc_feature (320)..(320): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgagagggccaccatcaactgcaacgtccagccagtagttgtttttacagctaccgaacaataagaactacttagcttggacaccagacaagaaaccaggacacgcctactaagctgctacatttacgnggacagtaccgtaacccgggacgtcccgggtccctacgaccgtattcgagtcggtacgacggtcgggtcgtagggaactaggtactttaccaccttcgtacccaacccgtattaccaacggtaccgtacggtcccctaggaccgtaacggggtacttagggaaaacggttacggttacgggttaccgggaacttttaacggtttttaagttaaccgttaacggtaccgtaacgtaaccttaaagtttaacgtttaaagttaacccggtttacccttaacccggttacccggtaaccggtttacccggggaccggtaaaccgggggtaacccgttaaaggggttaacggtaaaacgttaacccgaaaacggtacggttacggtaccggtaccgtaccggtacccgtaaccttacgg

SEQ ID NO: 152863 - DNA, 643 bp, Homo sapiens
  misc_feature: GYAE6OF02FHZ5Q.25.83.H06.1.454.CMB.1.raw
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
  modified_base (401)..(401): a, c, t, g, unknown or other
  misc_feature (401)..(401): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgaanaataagaactattagcttggcacagcaagaaaccagacagcctcctaagctgctcatttacgnggcactcgtacccggggaatcccggggtcctaggaccgtattcgaggtcggcaggcgggtcgtcggggacaggtactttcgaactctcaacntcacgcacgccgtacgcgaggtctaggaagagttcgggtacgtcgtaaggtttttataaccgttggtaccacgtacgttaaatttaagttacgttaaacggttacccttacccggtaccccgggttaacgggtttcccggaacccgggtaaaccggggtaaccccgaaaggggttacggtaaaactaccggtaaaacccgtacgttacggtaccgggacgttacggacccgtaccgtaccgg

SEQ ID NO: 152864 - DNA, 532 bp, Homo sapiens
  misc_feature: GYAE6OF02HQ557.25.83.H06.1.454.CMB.1.raw
  modified_base (312)..(312): a, c, t, g, unknown or other
  misc_feature (312)..(312): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcatgatgacccagtctccagactccctggctgtgtctctgggcgagagggccaccatcaactgcaagtccagccagtagttgtttttacagctccgacaaataagaactactagcttggcaccagcagaaaccaggacagcctacctaagctgctcatttacgnggcagtcctacccgggaatccggggtccctgaccgattcagtcggcaggcggtcgtggacaggtatttaccacttctccactactcacgcagcctgcaggctagacagtgtgactagtttatactgacagacaattattatatacctcctacgacgttcggaccgtagggaacctaagggtacgtaatacgaaacgtactaggtcgacgtcgactaaccg

SEQ ID NO: 152865 - DNA, 711 bp, Homo sapiens
  misc_feature: GYAE6OF02HI7I2.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacgggacttcgtgatgacccagtctccagacctccctggctgtgtctcgtgggcgagacgggccaccatcaactgcaacgtccagccagagttgtttttacagcctacgacaataagactactagctgcacagacagaacaggacacgacctacaacgctacgctactactttacgtggactataccggtaacccggtaacgtcccgggtaccctacggtacccggtattacccgagttaccgggacgtacggccgggttccgagggacctaggtctttaccgaccttccgtacctaaccacttaccgagtacccgacggtcctacggacccgtacgggaccttaaggaacggtacgtaggttcggggtacttaaacggttttaagttaccgtggttaaccgtacgtacgtaaaatttaccgtttaagttaccgtaccgttacccgttaaccgggaccgtttaccgggacccggtacgggggtaaacccgttaacgggtaaacggtaaaaccgttaccgtaaaacgtaaccgttacggggtaccgttccgtaaggtacccctaagttaacccg

SEQ ID NO: 152866 - DNA, 587 bp, Homo sapiens
  misc_feature: GYAE6OF02JKSHQ.25.83.H06.1.454.CMB.1.raw
  modified_base (182)..(182): a, c, t, g, unknown or other
  misc_feature (182)..(182): n is a, c, g, or t
  modified_base (463)..(463): a, c, t, g, unknown or other
  misc_feature (463)..(463): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
tcagactgtacagtcacgaccggtgctcgatttagatcacgtgcgtcgcgggggagctacaacaggcaggcaggggcagcaagatggtgttgcagacccaggtcttcattttctctgttgctctggatctctggtgcctacggggacttcgtgatgacccagtctccagactcctggctgtntctcgtggcgagagggccacatcaactgcacgtccagccagtagttagtttttacacgtctaccgtacaaataacgtaaacttacttagtacctttacggacaaccgacgacaacgaaaccaaggaccacggcctacctaacgctcgctacctatttacgtgggacctataccgtaccggtaacgtcccgggtaccctcggaccgtactcgtacgtcggacgacggtcggtacgtagggacagtacgttacactctacacctacacgtacgcacgctgacncggctagagactgtcgacttacggttactacgntacganactaattatactacgtactccgtacgtacgtccgacgtacgggaacgagttacgaatacgaacgactgtcgacgtcgacactacg

SEQ ID NO: 152867 - DNA, 656 bp, Homo sapiens
  misc_feature: GYAE6OF02GTG46.25.83.H06.1.454.CMB.1.raw
  modified_base (321)..(321): a, c, t, g, unknown or other
  misc_feature (321)..(321): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgtttttacagctccgacaataagaactacttagcttggcaccagcaagaaacccaggacacgccctacctaacgctagcctctaattttacgngggacacttaccgtaaccccggggtaacgttccccgggggtccctcggaacccgtactttcacggttgggaccgagggtccggggtacgtacgggggacctaaggtacttttccgaaccgttaccgtaccctaacctacgtaccgagaccgtaacgccctacggcgtacggactaggtaagtacgtggtagggtacttaagttttactttacgtggtacgagtactaattattaacgtacgttacctccgtaccgtacgttccggaccggacgggtaaccgaaggtacggtaaactaccgaaacgtacgttcggtacggtctacgacctacgtac

SEQ ID NO: 152868 - DNA, 771 bp, Homo sapiens
  misc_feature: GYAE6OF02ITJI2.25.83.H06.1.454.CMB.1.raw
  modified_base (84)..(84): a, c, t, g, unknown or other
  misc_feature (84)..(84): n is a, c, g, or t
  modified_base (458)..(458): a, c, t, g, unknown or other
  misc_feature (458)..(458): n is a, c, g, or t
tcagactgtacagtcacgaccggtgctcgatttagatcacgtgcgtcgcgggggagctacaacaggcaggcagggcagcaaganggtgttgcagacccaggtcttcatttctctgttgctctggactctctggtgccgtacgggacttcgtgatcgacccagtctccagacctcccgtgctgtgtctcgtgggcgaggacgggcctaccactacaactcgactaacgtccacgcccgagtagtttgtttttacacgccgtaccgaactaattaaacggaaaccttaccgttaacgtcgtttacggctaaccgaggacaaaacgaaaccgtacggaaccgacgtacccctacttaacgcgttccgtacttacttacgtttacgtcgggactacgttacccggtaacccgggtaacgtcccgggttccctacgtacccgtactttcgaacggtgtaacgnggtccgggttacggtcgggtaaccaggtttaccttaccgtaccgtccgttaccaaccttacgtacctaaccgtacgcccgtacgtacgaccggtacggtacttacggaaacgttacggtcgggttcggtaactttacgtttaacgttccggttagtaccggtaaggtacttaaaggtttagttaaactttacggttaacccttcccgtaccgtaccggttaccgggaccggtaacgggtaccgttaagggtaacccgtaaagtacccggtaaaccgtacggtgttacccgggctacccggtacgacccttacg

SEQ ID NO: 152869 - DNA, 750 bp, Homo sapiens
  misc_feature: GYAE6OF02GSB66.25.83.H06.1.454.CMB.1.raw
  modified_base (190)..(190): a, c, t, g, unknown or other
  misc_feature (190)..(190): n is a, c, g, or t
tcagactgtacagtcacgaccggtgctcgatttagatcacgtgcgtcgcggggagctacaacaggcaggcagggcagcaagatgtgtgcagacccaggtcttcatttctctgttgctctggatctctgtcgcctacgggacttcgtgatgacccagtctccagacctccctgctgtgtctcgtggcaggnggccaccgtatcaactgcaagtccagtccagtacgttagttttacacggtctacccgaataaataaacggtaactaaccgttaagtccgttggtaccctacgaagtaccaaacgaaaaccagggaaccaacggtacccgtaccttaaacgcgtacgacctacctaactttaccgtacggactacttccgtaaccccggggtaactccggggttaccacggtacgacttacgaggttacgcgtaacggccggtgtacggacgtaagtacgtttacaccgttcgtaccgtaacgtactacgacgaccgtaaggccttcgacctagggacttacggaaagacgttcggttagggcttaacgtttacgtaaacgtcgttaacgacgttaagaaacttaacgtttagtaacggttaaccctacccgttaacccgggtcggttttacccggaccgggtaaacccggggtaaaccgggtaacggtaaacgggggttaaaacccgttaaccgtaaaaccggtaacgtacgggttccgaaacggttccggtaaccacccggtttaaccc

SEQ ID NO: 152870 - DNA, 821 bp, Homo sapiens
  misc_feature: GYAE6OF02IZ5RD.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttagtttttacagtctccgacaataagaactacttagcttggcaccagacaacgaaaccaggacacgcccttcctaagcctgctctaattttaccgtagggtccaagttccgtaaccccggggtaaacgtccccgggggttaccctaccggaaacccgtacgtttaccgacggtcgggtaccgaagggtcccggggttacgtacgggggtaaaccgtaacggtaacgtttttcccgaacccgtttacccgtcccgtaaacccttactaccgaaaccggtcgtaacggtccccgttcggaccgtaacgggtaccctagggaaaacgtttacgttgggtaaccgggtacgtttaggtttttaaccgttttaccgttacggttacccgtaaggtaccttaaaacgttttaaagtttaccggttaaactttaacccggtttaacccccgtaaccgggttaccgtttacccggggaacccgggtaaccgggggtaaacccgtaaaacgggggtacggggttaaaaaccttaaacccggtaaaaccggttaacgttccggggtaaggttacccggtccgtaaacccgtacccgtttaacgg

SEQ ID NO: 152871 - DNA, 701 bp, Homo sapiens
  misc_feature: GYAE6OF02HAYF7.25.83.H06.1.454.CMB.1.raw
  modified_base (371)..(371): a, c, t, g, unknown or other
  misc_feature (371)..(371): n is a, c, g, or t
  modified_base (693)..(693): a, c, t, g, unknown or other
  misc_feature (693)..(693): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcccgtacgggggccttgtgatcgacccagtctccagacctccctggctgtcgtcgtcgtgggcgaggacgggccaaccatcaacgtgacaacgtccaggcctaagtagttagtttttacagccgtaccgaactaataaacgaacttacttaagcgtttcggaccaaccagaccaaacggaaaacccacgggaacctacgtaccctacccaaggcttcgccttactacgttttacgnggacctatacccggtaacccggacggttaccccgggtccgaccgtaccgtacgttcgtaacggtcggacctacgggtccggggtctaggggactagtcttaacgctccgtccactacgacgtacgacgacgtcctcggacacgggtctaccggtaaagtcgttacggttggtccgtaagttttacgtaacttcggtaccaagtacctaaaggttaacttcgtaacttacccgccgttccgtacccgggttacgccggaccgggtaaccggtaaggtaaccggtaagtaacccaaccggtagttcgaaccggttggtaacccncgactacg

SEQ ID NO: 152872 - DNA, 641 bp, Homo sapiens
  misc_feature: GYAE6OF02I4TR9.25.83.H06.1.454.CMB.1.raw
  modified_base (326)..(326): a, c, t, g, unknown or other
  misc_feature (326)..(326): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggcgagacgggccaccatcaactgacaacgtccacgccagtagttgtttttacagtcctccgaacaataacgaactacttagcttggcaccagcaagaaaccaggacacgcctactaagctcgctactatttacgnggactacgtaccgtacccgggaacgtccccggggtccctacggaccgtagttcgacggtcggcgacggtccgggtacgtacgggaactagtactttaccgacttcctacaccactacgacgctacgcctgacgaggcgtacgaagtagtggtcgtacgttacgtttagtacgttgtacgtagtactaattattaacgttacgttaccttacccgtaccgtacggttaccgaccgggaacgggtaaccgtaagggtaacggtaaacgttaaccgaaacggtacgttcggtacgtacgtacgtacccgaccgttacg

SEQ ID NO: 152873 - DNA, 730 bp, Homo sapiens
  misc_feature: GYAE6OF02IG1OS.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtggcgagagggccaccatcaactgcaagtccagcagtagttgtttttacagctccgaacaataacgaactacttagtcttggcacctagacaacgaaaccaggaacacgccctaccgtaacgtctgctactactttaacgtcgggactataccgtaacccggggaacgttccccggggtacctcggtacccgtagttaccgacggtcgacgtacggtccggggttcgtacggggtacctagtactttccgacttccgtaccacctagtccgtaagcctacggtcctaggcctagggtcctaggaaacgtagtcgggttacggtacgttaagtttacgttacgttacggtaccgaacgtaacctaaagtttaactttagtaaccgttacccgtttacccgtaacccggttaccggtttacccgggaaccgggtaaccgggggtaaaccgttaacggggttaaacggtaaaaccggttacccgaaaaaccgggttacgtttcggggtaaccggttacccgttacgaccccgttaacggttacccg

SEQ ID NO: 152874 - DNA, 771 bp, Homo sapiens
  misc_feature: GYAE6OF02JTNRE.25.83.H06.1.454.CMB.1.raw
  modified_base (346)..(346): a, c, t, g, unknown or other
  misc_feature (346)..(346): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacgggacttcgtgatgacccagcctccagactccctggctgtgtctcgtgggcgagacgggccaccatcaactgcaagtccagccagtagttcgtttttacagcctaccgaactaataacgtaacctacttaagcttaggaccaccagcaacgaaaccgacggtacagtaccccttaccgaagtcctggtacctacttaactttacgngggtcctaacgttaccgtaacccccggggtaaagttccccgggggttaccctacggtaacccgtacgttttaccggagggttacgggacccgtaacggggtcccgggttacggtaacggggtacctaacgggttaacttttcccgaaccgtttccctaccgaaccccttaggttccaacggtaccgtaaccgtaccgtacggtaccgaacgggtccgtaagggtaaaccggttcgttacgggtcggttaacccgtttagggttttaacttaaccgttcgtaaccgtaggtaccttaaattacgtttaacgttaaccgttacttaccgtccggttaaccgttccggacggtaacgggtaaacccgtaagggtacgtaactaaacgaaccggtaacgtggtccgaccggtctacccggtaccttacg

SEQ ID NO: 152875 - DNA, 514 bp, Homo sapiens
  misc_feature: GYAE6OF02F0OBN.25.83.H06.1.454.CMB.1.raw
  modified_base (411)..(411): a, c, t, g, unknown or other
  misc_feature (411)..(411): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagttgttttttacagcctccgacaataaagaaacctacttagcttaggcaccagcagaaaacccaggacagcctcctaagctgctcatttactggcatcctacccggaatccggggtccctgaccattcagtggcagcggtctgggacagatttcactctcaccatcagcagcctgcaggctgaagntgtgctagtttactatgtcagcaatattatagtactctaccgtcgttcgccaggggaccaagggtaggaaatccgaaacgtactaggtggctgaccacctacg

SEQ ID NO: 152876 - DNA, 758 bp, Homo sapiens
  misc_feature: GYAE6OF02GD9K5.25.83.H06.1.454.CMB.1.raw
  modified_base (336)..(336): a, c, t, g, unknown or other
  misc_feature (336)..(336): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaggacgggccaccatcaactgcaacgtccagccgagtagttgtttttacagtctccgacaataacgaacttacttagcttggaccaccgagcaacgaaaccaggaccacgtccctcgtaagctgtaccttctaacttttacgnggggacctacgtaccggtaaccccggggtaacggttccccggggtcccctaggacccgtacttacgaggtcggacgacgggtccgggtacgtagggaccgtaggtactttaccgtaccgttctaaccacctacgtacgacgacgaccggtccgtacggaccgaccgggtacgttacgggaagttaacggtcgggtacggtaccgtttaacggttttaacgttaccgttacgttaccgaacgttaactaaattaagtttaacgttaaccggttacccttcccgttacccggggtacccggttaccgggaacccggtacgggggtaaacccgtaaggggttaaccggtaaaaccgttaacccggtaaaccgggttaacgttacgggtaccgggttaccgtacccggtacccgtaacccttacgg

SEQ ID NO: 152877 - DNA, 610 bp, Homo sapiens
  misc_feature: GYAE6OF02GM8M6.25.83.H06.1.454.CMB.1.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
tcagactgtacagtcacgaccggtgctcgatttagatcacgtgcgtcggcgggggagctacaacaggcaggcaggggcagcaagatggtgttgcagacccaggtcttcatttctctgttgctctggatctctggtagccgtacggggacttcgtgatgaccctagtctccagactccctggtctgtgtcgtcgtgggccgagacgggcccaccatcaactgcaagtccagccagtattgtttttacngtctaccgaataataagaaccttatacgcttcggcaccnacagaaaccagacagcctacaanctgtactagtacttacgcgggacactccgtaaccggtaactcccgggtcctcgacgtnttcgngtgcgagtcggtagtacggacagtacttcactcactacgatctagcncgtccgtgaccgaggtctaagaagcttaggccggtaatttagtttacgtacttacggtacataacgtaagttaatacgttaaacgtcccgtcgtacccgtacgggttacggaccggaacggggtaacgtaaaggtagttaaaccgtaacggtaacgaacgttacggcgtacgtccgtaaccacggtttacc

SEQ ID NO: 152878 - DNA, 752 bp, Homo sapiens
  misc_feature: GYAE6OF02GBNU1.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactcctggctgtgtctcgtggcgagacggccacatacaactgcaagtccacgccagtagttcgtttttacagctccgacaataagaacttactacgcttcgaccaccagacaacgaaaccgtacggacacgtccctaccgtaagtcctacgtaccttactaacgttttaacgtcgggtactaacgttacccggtaacccggggtaacggttccccggggttaccctacggtaaccgtactttacgaacggttcggaccgtaacgggtcgggtcgtaacggggacgtaacgttacgttttccaaccgttctacccgtaaccgacgttaccgacggtaccgtctaccggttcggaccgaggtaccgtaacggtaaacgtcggttacggtaccggtacgtttaagtttttaccgacgtttacgggacttacggtaacttaaacgttagttaaccttaccgttacttacccggtaaccgttaccgtttaccgggaaccggaacgggtaaccggtaaaggtaacggtaaacctaccggaaaacggttcgttacggttaccggtaccctacggtaaccaccgtttaacgg

SEQ ID NO: 152879 - DNA, 602 bp, Homo sapiens
  misc_feature: GYAE6OF02HF8ZC.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcattttctctgttgctctggatctctggtgcctacggggactttcgtgatgacccagtctccagactccctggctgtgtctcgtgggcgaggacgggccaccatcaactgacaagtccagccagtagttcgtttttaacacgtctccgaacaattaacgaacttacttagcttggccacacgacaagaaaccaggacacgcctacctaagctcgctacactttacgcgggtcactccggtaaccggactccggggtcctcggaccgtattcgaggtcgagcggtcgggtcgtagggaactacggtacttttaccgacttccgtaccaccctagtacacgtcacggtcctcgaccgtacggctacgaaaggtctggtacgtacttaagtttcttaacgtgtacagtactaattattacgtagtcctaccgtacgcgttacgacggtacgggaagacggtaagaacgtacgaagtactacggtcgactgactacctag

SEQ ID NO: 152880 - DNA, 726 bp, Homo sapiens
  misc_feature: GYAE6OF02F8ZZM.25.83.H06.1.454.CMB.1.raw
  modified_base (88)..(88): a, c, t, g, unknown or other
  misc_feature (88)..(88): n is a, c, g, or t
tcagactgtacagtcacgaccggtgctcgatttagatcacgtgcgtcgcgggggagctacaacaggcaggcaggggcagcaagatggngttgcagacccaggtcttcatttctctgttgctctggatctctggtgctacggggacttcgtgatgaccagtctccagactcctggctgtgtctcgtgggcgagagggccacatcaactgcaagtccagccacgagttcgtttttacagctccgactaataagaactacttagcttggcaccgagctaagaaccaggtacagcctactaagctacggctctagttactcgggacacgtctaccgggtaactccggggtaccctcggaccgtacttacgtaggtcggtacgaggtcgggtctcgggtactagggtacctttcgacttcgtacaaccgacttacgaagtccgtaacgccgttacgaccgtacggacgttaggaaaacggtctagggttacgggtacttaacggttttacttaacgttccgggttaacttaacggaccctttaaaagtttaaccgtttaacgttaaaccggttaaccgttccccggttaaccggtaaccgggttttacccgggaacccgggttaagggggtaaacccggttaaacgggttaaacgggaaaccgttaaaccgtaaaaccgggtaactttacgggtaccggaccggtttaccgacccgtaaccgtttaaccgg

SEQ ID NO: 152881 - DNA, 761 bp, Homo sapiens
  misc_feature: GYAE6OF02IEM00.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatgacccgagtctccagtacctccctggctgtcgtctgtcgggcgaggacggccaaccataccaactggactaaacggtccaggaccgaaggtacgttttagtttttacagtccgtaccgaaactaaagtaaacgtaaccttaacgttaggtcgttacggaccaaccgaagacaaacggaaaaccgacggtaaccaccggtacccttaccgtaaacggtcctcgtaccgttactaacgttttacccggagggtacctaaccgttacccggtaaccccgggggtaacggttccccggggttaccacggtaaccgtacgttacggaaggtcggacgtacggtaccgggttcgtacgggacgtaagttacgttcctaactcgtaccacgtactgtacgccgacggtcacggtccgaaggtccgtaagtaacggtgttcggtagtaccgttatttaccgttagtcggtaacacggttaataacgttaacttagttaaccgtcccgttaccgtaccggttccggttacggaccggtaacggggaaccttaacgggaattaaccgacggtaaacgttacggtcggttaaccggacgttacggacttacgtacgg

SEQ ID NO: 152882 - DNA, 662 bp, Homo sapiens
  misc_feature: GYAE6OF02FRA69.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagtagttgtttttacagctccgacaataagaactacttagcttggcacagcaagaaccaggacagcctacctaagctgcctactatttacgcgggacacgtccgtaaccccggggtaatccccggggtaccctcggtacccgtacgttcgtacggtcgccgtacggtccgggttcgtacggggactaggtacgttttccgaacttcctaccaccagtacgacgctacgccgtagccgacgggtctaaggaagtagttcgtacggtacgtaacgttttacttacgtcgtacgacgtaaccttattaacgttaactacgttacccttccgtacccggttacggttcccgggaccgtaacggggtaacccgttaagggtacgggtaaacgtaaccgtaaacgtacgttacgggtacggtccgtaacggtcctaaccgttaccg

SEQ ID NO: 152883 - DNA, 622 bp, Homo sapiens
  misc_feature: GYAE6OF02FX0CM.25.83.H06.1.454.CMB.1.raw
  modified_base (462)..(462): a, c, t, g, unknown or other
  misc_feature (462)..(462): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgacccagtctccagactccctggctgtgtctctggcgagagggccacatcaactgcaagtccagccagtagttgttttttacagtctccgacaataagaactacttagcttggccaccgagcaagaaaccaggacacgtcctacctaacgctcgctctatttacgtgggcatccgtaccgggaagtcccgggtccctgaccgtacttcgacggttcggacgacggcgggtacgtgggacaggtactttccacttcctcgaaccctatcgacgctacgcctgaccgacggtcttaaggagtgttacggngtacgttaaggttttacttacgtaggtaccagtactaaagttattacgtaacgttacctcccgtacccggttacgttccggaaccggtaggggtaacctaacgggttacgaaaccttacgaaaccgtacgtcggtacggctacggacctaccgttaacgg

SEQ ID NO: 152884 - DNA, 680 bp, Homo sapiens
  misc_feature: GYAE6OF02I17FG.25.83.H06.1.454.CMB.1.raw
tcagactgtacagtcacgaccggtgctcgattttagatcacgtgcgtcggcgggggaggctacgaacaggcacggcgaggggcaggcaagagtggtgttgcgagaccctaggttcttcatttctctagttgctctggatctcgtggtcgcgtacggggcttacggtagatagacctagtctccagtactcccgtgtctgtgtctgtggcgagacggccacctatacaactcgacgaacgtccgagcctaggtacgttacgttttttacaggtcctaccgaactaaactaagaacttacttagcgttaggccaccgagacaacgaaaccaggaacacgtacctacctaaggcctcgctactaatttacgtcgggactacgtaccggtaaccgggaacgtcccggggtacctcgacccgtagttccagggtcggcgaggtcgggtcgtaggctaagtacgttacatcgtacaccgtactcgacgtagaccgtcgttagccgtaggtccgtaggtaaagtcggttggtaccgttaacgttaggttttactacgttacgataggtacttaagttattaacgttagtaccttaccgtacgttaccgttacgaccggtagggtaactaaagggtacaaacgtaccgaaacggttatacggttcgaacgtacgtaccctagtaaccg

SEQ ID NO: 152885 - DNA, 709 bp, Homo sapiens
  misc_feature: GYAE6OF02HXMGN.25.83.H06.1.454.CMB.1.raw
  modified_base (468)..(468): a, c, t, g, unknown or other
  misc_feature (468)..(468): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgacccagtctccagacctccctggctgtgtctgtgggcgaggacggccacatacaacgtgcaacgtccagccagtgtttagtttttacgagtccgtacaataataaacgtaacttacgttagtcgttacggacacctacgacaacggaaacccagggtaaccacggtacctacccgtaagtccgtgtacctacgtacttttacgtcgggacctacgttaccggaaccggggtacgtcccggggtactcggacctagttcgagtcggagtacggtacggtcgaggactgtacttcactactcacctataccgnccgtacgacgtcgagtggtaccgtagaacgtaggttacggtcgtacgttagttttaaccgcgttacgtactacgaaccttaagtttacgttaaacgttacgttaccctaccgttacccgggttaaccggttaccgggttaaccggggtaccggggtaaaccgtaagggtaaccggttaaaacgtaaccggttaaaccgacggtggttacccggaccgtaccgtacggtaacccctttaagg

SEQ ID NO: 152886 - DNA, 735 bp, Homo sapiens
  misc_feature: GYAE6OF02G7RHY.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggcgagacgggtcaccatacaactgcaacgtccagccagtagttcgttttacacgctccgaacaagtaacgtaactacttagtccgttcggacaaccagacaacgaaaccgagaacacgtccctactaacgtctacgtcctacgtaacgtttacgtcgggacctaacgttacccgtaacccgggggtaaccgttcccggggtccctacggtacccgtagttacgtacggtcgggacgtacgggtccgggttaggtacgggaactaggttacgtttaccgaacttccgaccaaccgtaacttaccgagtacccggaccgttccgtacggaccggaacggttccgtaaggtaaaccggtagtttacgggtacgttaaaccgttttagtttaacctttaccggtacgttaacgtagtaacttaaacgtttaagttaacgttaccgtacccttccggtaaccggttaccggtacccggagggtaacccgggtaacgtaaccgggtaaagaacctacgaaacgtcgtagtccggtacacggactactacg

SEQ ID NO: 152887 - DNA, 888 bp, Homo sapiens
  misc_feature: GYAE6OF02IRXKZ.25.83.H06.1.454.CMB.1.raw
tcagactgtacagtcacgaccggtgctcgatttagatcacgtgcgtcgccgggggagctacaacaggcaggcgaggggcagcaagatggtgttgcagacccaggtcttctatttctcttgttcgctctaggatctcgtggtcgccgtacggggtacttcgtgatcgacccagtcctccacgtacctccgtggctgtcgtcgtcgtgggcgaggaccgggccaccactcaactgaccaacgtccgacgcctaaggttagttttacgtttttacgacgtcccgtaccgaaacaaaagttaaacgtaaaccgtttaacttaccgtacggtttaccggccaacccgtagacgaaacggtaaacccgacggaacctaccgtcccctacgtaaccgtcgttacgtaccttacttacgtttaacgtccgggtaccttacgtacccgggtaaaccccggggttaccgggttaccccggggtacccttaccggaacccgttacttccgtacgggtaccgtccggtaaccggggtccgggttacggacgggtaactaaccggttacctttccgaccgtccgtaacctaccgaacttcgaccgacgtaacccggccgttacgaccggtaacggtacgtaacggtaacgtagggttaacgggtcgttaaaccggtttagttttaaccgttacgggttaccgtaacggtaccgttaaagtttaacgttaaacgttttaaccccgtttaaacgttaccccgtttaccccgggtaaccgggtttaccccggggtttacgggaacccggggttaacgggtaaacccggttaaacgggtaaacggtaaccgtaaacccgtaacggtacgttacgggtacgtacccgaacgtaccgtaaccttacg

SEQ ID NO: 152888 - DNA, 226 bp, Homo sapiens
  misc_feature: GYAE6OF02HNM4F.25.83.H06.1.454.CMB.1.raw
  modified_base (113)..(113): a, c, t, g, unknown or other
  misc_feature (113)..(113): n is a, c, g, or t
  modified_base (162)..(162): a, c, t, g, unknown or other
  misc_feature (162)..(162): n is a, c, g, or t
  modified_base (167)..(226): a, c, t, g, unknown or other
  misc_feature (167)..(226): n is a, c, g, or t
tcagactgtacagtcacgaccggtgctcgatttagatcacgtgcgtcgcgggggagctacaacaggcaggcaggggcagcaagatggtgttgcagacccaggtcttcatttcnctgttgctctggatctctggtgcctaggggcttcgtgatgacccctatnccatnnnnnnnnnnnnnnnnnnnnnnnnnnnnnnnnnnnnnnnnnnnnnnnnnnnnnnnnnnnn

SEQ ID NO: 152889 - DNA, 742 bp, Homo sapiens
  misc_feature: GYAE6OF02JU5P5.25.83.H06.1.454.CMB.1.raw
  modified_base (120)..(120): a, c, t, g, unknown or other
  misc_feature (120)..(120): n is a, c, g, or t
  modified_base (452)..(452): a, c, t, g, unknown or other
  misc_feature (452)..(452): n is a, c, g, or t
  modified_base (607)..(607): a, c, t, g, unknown or other
  misc_feature (607)..(607): n is a, c, g, or t
  modified_base (737)..(737): a, c, t, g, unknown or other
  misc_feature (737)..(737): n is a, c, g, or t
tcagactgtacagtcacgaccggtgctcgatttagatcacgtgcgtcgcgggggagctacaacaggcaggcagggcagcaagatggtgttgcagacccaggtcttcagtttctctggttncctcgtggactctcgtggtacgccgtacggggacttcgtgatcgaccctagtcctcagtcctccgtggtctgtacgtctcgtcgggacgagcgggtaccaccgtactacaacgtcggacaaacggtccgacgaccgtaagttacggtttcttttaaccggacgccgttaccgaaaccgtaattaaacggtaaaccttacgtaccggagtttaccgaccgaaccgttacgaccgaaacgtaaccggacgacctacggcctaaccgtagtcgtacctccgtaatttcggccgtagtaccgtaccggtaccgggtaacgtcccggtaccgggtanaccgttagactaggtaccgggtctccgggttacggtcccggtaaggaacttcggttaacgtcctacgtacctcgactacgtctaacgcgtacgtaccggtcgtacgtacgacgtacgtagtccgttagtacggtaacgttacgttacgtacggtntacggttacgtacgtaattaacgttaacgtaccgttacgtccgtaccgttacgggtacgtaccgggtacggtaacggaacggtacgttaacgtacctaaggtaccttacgggactccgtacgtcgacttntacgg

SEQ ID NO: 152890 - DNA, 744 bp, Homo sapiens
  misc_feature: GYAE6OF02G087Y.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgatcgaccagtctccagacctccctggctgtgtctcgtgggcgaggacggccaccatacaactcgacaacgtccacgaccgagtagtttacgtttttaacacgtcctaccgaacaaataaacgtaaactaacttacgtacgttacggaccaccgacgactttttaacgaaaccgaacggaacgacgtaccctaccgtaacgtacgtacgtactactaacgtttacgtacggtacgtacgtaccggtaaccccggggtaaccggttacccggggtacccgtacggtaaccgtacgttacggtacggtacggacggtacgggtcgggtacggtacgggtaacgtaacggtacgtttaccgtacctcctacctaaccgtactaaccgacgacgacgtaccgtacgtacgtacggacgtaggtaagtacgtacggtacgtacgttacgttacttacgtacgtacacgtaactaattaattagttacgtacctaccgtaccgtacggtaccggtaccggtaacgggtaacggtaacggtaacggtaaacgtaacgtaaacgtaacgtacggtacggtacgtacgtaccgtacgtacg

SEQ ID NO: 152891 - DNA, 709 bp, Homo sapiens
  misc_feature: GYAE6OF02HP4YZ.25.83.H06.1.454.CMB.1.raw
  modified_base (182)..(182): a, c, t, g, unknown or other
  misc_feature (182)..(182): n is a, c, g, or t
tcagactgtacagtcacgaccggtgctcgatttagatcacgtgcggtcggcgggggagctacaacaggcaggcaggggcagcaagatggtgttgcagacccaggtcttcatttctctgttgctctggatctctggtcgccgtacggggacttcgtgagtcgacccagtcctcacgcctcccnggctgtgtcgtcgtgggcgaggcggccacatacaactgactaacgtccacgaccgtaagtagtttacgttttacgaggtcctaccgaacaaagtaaacgaacttacgtacgtcgttcggaccaacgacacgaacgaacgtacgacacgcctacgtaacgctacgctactaacgtttcgaggcctacgtaccgtaaccggtacggtcccggtaccgacgtaccgtacgttcgacggtacggaccgtcggtaccggtaccggtacgtaacgtacgttacgttaaccgtcccgtaccgtacggtaacctacgtaccggacacgtacggtccgacgtaccgtacggtacgtaaggaacggttacgtgggttacgtacgttaacgttttagccgtataccggtataactaaatttacgtaattaccgtaccgttacccgtaccgtacgggttaccggaacgtaacggggaccctaaaggggtacaaacgttaaacccgaagtaacggtccgtggcccctagtacccagttac

SEQ ID NO: 152892 - DNA, 696 bp, Homo sapiens
  misc_feature: GYAE6OF02FZNX4.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgcctacggggacttcgtgatgaccagtctccagactccctggctgtgtctcgtggcgagaggccaccatcaactgcaagtccagccagtagttgtttttacagtctccgaacaataagaactacttagcttaggcacagcaagaaaccagaccagtcctactaagctgactctactttacgtgggtctaactccggtaacccgggtaacgttcccggggtccctacggaccgtacgttacgaggtcggcgaggtcgggtacgtggggaacaggtacttttccgaacttccgtacaaccctacgttaaccgacggtaacctaaccggtccgtacgaccgtaaccggggtcttaaacgggaaagttcggttaacgggttcggtaaccgtttaaacgttttttaacggttaccttacggttaaccgacgtaaaccgttaattaacgtttaaacgtaacgttccttacccggttacccgtacgttcccgggtaacgaacgggtaacgtaaaggtacgaaaccgttaagaaacggtactacggtacggccttacgacgaccgttacg

SEQ ID NO: 152893 - DNA, 890 bp, Homo sapiens
  misc_feature: GYAE6OF02IRRP5.25.83.H06.1.454.CMB.1.raw
  modified_base (55)..(55): a, c, t, g, unknown or other
  misc_feature (55)..(55): n is a, c, g, or t
tcagactgtacagtcacgaccggtgctcgatttagatcacgtgcgtcgcgggggngctacaacaggcaggcaggggcagcaagattgtgttgcagacccaggtcttcatttctctgttgctctggatctctggtcgccgtacggggtacttcgtgatcgaaccctagtctccagacctcccgtggctggtgtctcgttggggcgaaggcggaccaccataccaactgacgtaacgtaccacgacctaacgtagtttcgtttttaacgacgtaccttaccgaactaaagttaaacgtaaaccgttaactttaacggtcctttaacggaccgaaccacggacgaaacgaaaaccccgaacgggaacctaccggaccccttaacccgttaacggaccttcggtacccttaaccgttaacgttttaaaccgtcggggtacctaagttacccggttaaacccggggtaacccggtttcccggggtacccttacgggaaccgtaaccgtttgaaacggtcgtcgtaacgggtacggggtaccgtacggggaaaccctagggttactttaccgtaccctaccgtacccttacccggaaacttacgacggtaacctacggccttacggaccggtaacggacgtaagggtaaaggtacgtacggttcgggtaacttacggtttttaacttgttacgtaacgtttaagtaaccgttaaaagtttagtttaaactttaacccggttaccgtttaaccggttacccgttaacccggggttaccgggtaacccgggaaccggggttaaacccgggttaaaagggttaaacggttaaaccggtaaacccggttaaaagtaaccggtccggttaacggtaccgtaccgtacctaaccggtttacg

SEQ ID NO: 152894 - DNA, 827 bp, Homo sapiens
  misc_feature: GYAE6OF02F40N6.25.83.H06.1.454.CMB.1.raw
  modified_base (398)..(398): a, c, t, g, unknown or other
  misc_feature (398)..(398): n is a, c, g, or t
  modified_base (801)..(801): a, c, t, g, unknown or other
  misc_feature (801)..(801): n is a, c, g, or t
  modified_base (814)..(814): a, c, t, g, unknown or other
  misc_feature (814)..(814): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctcgtggtcgccgtacggggtacttcggtgatcgacccagtctccagtacctcctggctgtcgtctcgtgggcgaggacgggccaaccatacctaactcgacaacgtccagccgtaagtcgtttagtttttacacggtcctaccgtaactaaataaacgtaaacccttagttaacgttcgttcgggaaccaaccgtacggaacctaaacggaaaacccgaagggacacggtacccctacctaacggtctacgtctacttaagttttacggnggacctacggttacccggtaaccccggtaccgggttcccgggtacccgtacgtaccggtactttacggtacggtcgggaccggtaagggtccgggtacgtacgggtaaacgtagtttacgtttacccacgttccgtacctaaaccgtcttaaccggacgtaccggtactacccggtacggtaccggtaacggtaaccgtaaggggtaaacgttcggttacggttcggttaaacccgttaagggttttttactaccgtttgggtaacccttgtaaaccgttaaatttaaccgtttaagtacgtttaccctacccgggttacggttacccggaccggttaaccgggaacgggttaacggtaacgggtaaacggtaactaaccggttaacggtcgttaccgggtanaccgggttaaccncgtaccgttaacg

SEQ ID NO: 152895 - DNA, 807 bp, Homo sapiens
  misc_feature: GYAE6OF02GO3JB.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtcgccgtacgggtacttcgtgtatcgaccctagtctaccacgtacctccgtggctgtcgtctcgtcgggacgaggacggaccacctataccaacgtggactaacgtaccacgaccgtagttagtttacgtttttacgacgtaccgtaacccggtaataaaacgttaaacgtaaaccgtttaacgttaacggtcgtttacgacctaacccggtaacgaaccaaacggaaacccgaacggaccgtaaccggacccttaaccggtaacgtccgttcggtaccttaacgttactttaccggtcggttactaccgtaaccgggttacccgggaacggttccccgggtcctaccgtaccgttatcgacggtacggacgtacgggtaccggtcgacggtacttacggtacgttcctaccgttactaccgtaactacgtacgaccgtcgaaccgttccgacgacggtacggaattaacgtaacgggtacgtacgggttctaacgtttaacgtttacggttactactaacggttcgaacttaacttacgttaacgtaccttaccgttcccgttaacgggtacccggttaccgaacgggacccggttaaggtaacggtaaaccgtaacttaaaccggttaaccgtacggtccggtaggttaccctcggtaaccgtccttaccgg

SEQ ID NO: 152896 - DNA, 719 bp, Homo sapiens
  misc_feature: GYAE6OF02JPYUG.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttctatttcctctgttgctcgtggatctcgtggtcggtccgtacggggtacttcgtgtacgtacgacccctagtcctaccgacgtcctcccgtggtctgtcgtcctcggtgggacgacggacggccacctactctacgtcgacacgtccacgacgaggtagttacttttacgacgtcctaccgaactaataacgtaacttacgttacgtcgttacgaccacgtagaccgaacgaacgacggactaccgaccctacgtaacgtccgtcgtactactacgttacgtacggtacctacgtacccggtaaccggaccggttcccgggtaccgtacgtaccgtacgtcgtacggccggtaggaccgggtcggtacggaaggtacctacgtacgttactaccgtacctacgtaccgtacgtacgacgtacgtacgtacgtcgtacgtacggtacgtacgtacgtacgtgtacgtacgttacgttacgttacgtacgtacgtacgtaataacgttacgttacgtacgtaccgtaccgtaccgtccgtacgtacggtacggtacgtaacgtacgtaacgtacgaacgttttttacgacgtacgtacgtacgtacgtacgtacg

SEQ ID NO: 152897 - DNA, 833 bp, Homo sapiens
  misc_feature: GYAE6OF02JOZXA.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggtacttcgtgatcgacccgagtcctccacgtacctccgtggctgtcgtcgtcgtcgggcgaggacgggacccacatccaactgacaacgtccacgaccgagtagtttacgttttacacgtaccgtaccgaactaacgtaacgtaacttacttagtacgttcggacaaccgagaccgaacgaaaccgacggaacgacgtcccgtaactaacggtccgtacgacctactaacgtttcgtacggtactaaccgtacccgtacccggggtaccggtccccgggtaccgtacggtacccgtacgttcgtacggtccggtacggtacgggtacgggttaccggacgggtaacccgtagttaaccctttcgtaaccgttacccgtcccgaaccgtacgtcggtaacgaccacgtccggtaacgggtcaaccggtcgtaaggtaacgttagttccgggttaacgggttaaccttaggttttaaccgtaaccggttacgtaaccggttacctaaacgtttaggttaacttttaaaccgggtacctttaacccgggttaccttaccccgggggttaaaccgtcccggggtaaaccgggtaccggggttaaaccggtaaacggttaacggtaacccgtaaccggtaaacggttaccggttcgggtaaccgtcccggtaacgtaccttaccgggttaaccg

SEQ ID NO: 152898 - DNA, 769 bp, Homo sapiens
  misc_feature: GYAE6OF02HX1H5.25.83.H06.1.454.CMB.1.raw
  modified_base (266)..(266): a, c, t, g, unknown or other
  misc_feature (266)..(266): n is a, c, g, or t
  modified_base (575)..(575): a, c, t, g, unknown or other
  misc_feature (575)..(575): n is a, c, g, or t
  modified_base (591)..(591): a, c, t, g, unknown or other
  misc_feature (591)..(591): n is a, c, g, or t
  modified_base (620)..(620): a, c, t, g, unknown or other
  misc_feature (620)..(620): n is a, c, g, or t
tcagactgtacagtcacgaccggtgctcgatttagatcacgtgcgtcgcgggggagctacaacaggcaggcaggggcagcaagatggtgttgcaggacccaggtcttcatttctctgttgctctggatctctggtcgccgtacggggcttcgtgatcggaccctagtcctaccacggtcctcccgtggctgtcgtcgtcgtgggcggagacggccaccatacactgacaacgttccacggaccagtacgttttcggttttttaacncggtaccttaccgaaagtaacgttaaaacgtaaccttaacgttacgtggttacgggacaacccctaagaccgaaacggaaaaccgtaacggaaccgaccggtacccttaaccgttaaacgcgttcaccgtttctaacgttttacgtacggacctacgttaacccggtacccggggtaccggtccccgggttccctaaccggtaacccgtagttacgggtacgtaggaaccgcgggttacggtcgtaacgggacctaggtaaccttcgaccttcgtacaccacgtcagaccacgtcgccggagaccggtnaggaaacgttgacggnggttactatttaacgtcgtagtacccganaaccgttaagttactacggttaaccgtaccgcccttacgggtacccgtcggtaccccgggtaacgtaaaccggcggttaaaaccggaagtttaaacccgaaccggttaaccggttgggtaccctacggtttacctaaccggcttacccg

SEQ ID NO: 152899 - DNA, 687 bp, Homo sapiens
  misc_feature: GYAE6OF02IRKUO.25.83.H06.1.454.CMB.1.raw
  modified_base (422)..(422): a, c, t, g, unknown or other
  misc_feature (422)..(422): n is a, c, g, or t
  modified_base (504)..(504): a, c, t, g, unknown or other
  misc_feature (504)..(504): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggtacttcgtgatcgacccagtctccagacctcctggctgtgtctcgtggtacgaggcgggaccaccatcaactgacaacgtccagaccgagtacgttttgtttttacagtcctaccgaacaaataaacgtaaccttaacttagcgttggacctaccgagacgtaaacgaaaaccgaacggacacgtacccttaccgtaacggctacgtctactactttacggcgggctacgtccggtaacccgggtacggtcccgggtcctcggaccgtacttaccgnggtacggacgtagggtcgggtcgtagggtactaacggttcttacgtacctccgtacccaaccgactacgacgtgacctccgngtcggacggtagaggtaagtagtcggtacgtcgttactttaaggttcgtcgtaacgtacgtactaaagttaactaaacgggttcgtacggttaacggtacggtttacgggaccgaacgggtaaccgacggtacgtaggaacgtacgtacgaacggtacgtaggttcgacggtcgaccgtaacg

SEQ ID NO: 152900 - DNA, 849 bp, Homo sapiens
  misc_feature: GYAE6OF02HRCW6.25.83.H06.1.454.CMB.1.raw
  modified_base (252)..(252): a, c, t, g, unknown or other
  misc_feature (252)..(252): n is a, c, g, or t
tcagactgtacagtcacgaccggtgctcgatttagatcacgtgcgtcgcgggggagctacaacaggcaggcaggggcagcaagatggtgttgcagacccaggtcttcatttctctgttgctctgatctctggtgccgtacggggtacttcgtgatcgacccagtctccagacctccctggctgtgtctcgtgggcgaggacgggcccaaccatccaactgacaacgtccacgccagtagtttagtttttacngtacctccgaacaataacgtaactacttagcttaggccaccgacgacaacgaaaccaggaccacgtccctacctaagtctacgtcctctaactttacggtcggtaccgtaactcccggtaaaccccggggtaacggttcccccgggggttacccctcggtaacccgttaacgttccgaaggttcgggacgaacgggtccggggttacgtacgggggtaacctaaggttacttttaccgaccgtttcccgtacctaaccccgttagtaacccgaacggtccgtaacgtcccgttacgacggtacggtacgtacgggtaaacgttacggtcgggttaaccggtcgtttaaggttttaaacccgtttaacgtcggttaaccgacgtaacttaaacggttactttttaaacggtaccgtttaaccccttaccgggtttaaccccgggttaacccgggtttcccggggtaaccccgggaaacggggggttaacccgtaaacgggggttaaacccgtaaacggtttaaaaccccggaaaccggtttaacgggtacgggttacccgggtaccgtttaaccggtacccgtaacccgtttaacccg

SEQ ID NO: 152901 - DNA, 753 bp, Homo sapiens
  misc_feature: GYAE6OF02JEAZB.25.83.H06.1.454.CMB.1.raw
  modified_base (187)..(187): a, c, t, g, unknown or other
  misc_feature (187)..(187): n is a, c, g, or t
tcagactgtacagtcacgaccggtgctcgatttagatcacgtgcgtcggcgggggagctacaacaggcaggcaggggcagcaagatggtgttgcagacccaggtcttcatttctctgttgctctggatctctggtgccgtacggggacttcgtgatcgacccacgtctccagacctccctggctgtntctcgtgggacgaggacgggccaccataccaacgtcgacgtaacgtccacggacccaaggtagtttacggttttttaacacggtccttaccggaacaaacttaaacggaaaccttacctttaggaccgtttacgggacctaaaccgaacgaccgaaaaccgggaaaacccaacgggtaaccaccggtaacccctaccgtaaacgtcgtcgccttaacgtactttacggtcggtacaccgttacccgtaacccggggtaaccgtccccggggtacccgtcggtaaccgtaactttcggaggttacggcgaccgggtcgggttcgacgggtactacggtacttacgtaaccttcctaccgtactacgttaccgaccgtacgtcgaccgtagaccgttaacggccttaaggacgtagtccggtagtaagtttacgtttaacgttcgtacgtatacgtaacgtaatttacgtaaccgttctaacccgttccgtacgtaccgggtccgtacgaccgggtaacgtaggaactaaacgtacaaacgtcgtaagtccggactacgtccactacg

SEQ ID NO: 152902 - DNA, 777 bp, Homo sapiens
  misc_feature: GYAE6OF02HEGMW.25.83.H06.1.454.CMB.1.raw
tcagactgtacagtcacgaccggtgctcgatttagatcacgtgcgtcggcgggggagctacaacaggcaggcaggggcagcaagatggtgttgcagacccaggtcttcatttctcttgttgctctggatctcgtggtcgccgtacgggacttcgtgatcgacccgagtctccagacctcccgtggctgtcgtcgtcgtggcgaggacggccaccagtacaactgacgaacgtccgacgccgagtagtttcgtttttacgacgtccgttaccgaaactaaacgtaaacgtaacttaccgttagtcgttcggaccaccgagaccgaaacgaaaccgaggaccgacgtaccctaccgtaacgtcgtacgtaccttactaacgtttaccggtacgggtcctaaccgttaccccggtaacccggggttaaccgggttccccgggttaccccgttaacgaacccggttacttccgtaaggtcggacgtcggtacgggtcgtacgggactacgtacgtttaccacttccaccgtacacgtaccgacgactaccggtacctcgggacgaacggtacgtaggtaaacgtcggttagtacggttaacgtttacttttaacggtaccgttacgtacgaagttaacctaaattaccgttaacgttaccgttacccgttcccgtaccggttcggtacccggtaccgggaaccggtaaccggtaacggtaacggttaaacgtaaacccgtaaccgtacttacgggaccgtttcgaccgtacgtacttacgg

SEQ ID NO: 152903 - DNA, 775 bp, Homo sapiens
  misc_feature: GYAE6OF02FI7YC.25.83.H06.1.454.CMB.1.raw
tcagactgtacagtcacgaccggtgctcgatttagatcacgtgcgtcgcgggggagctacaacaggcaggcaggggcagcaagatggtgttgcagacccaggtcttcatttctctgttgctctggatctctggtgccgtacggggacttcgtgactgacccagtctccagactccctggctgtgtctcgtgggcgaggacgggccaccgactcaactgcgaacgtccagccaagtgttagtttttacgagccttaccgacgtaaataacgaaccttacgttacgtcttcggaccaccgaagcgaacggtaaacccgaggaaccaacggtaccccttaccgtaaacgcgttacgccgttaccttaacgttttaccgcgggtactaccgttacccggtaacccggggtaaccgtccccggggttaccctacgtaacccggtacgtttacgacggttcgggtacggaacgggtccgggttaccgtcggggtaaactaacggttacgttttaccgtaccgttacctaccgttaccctagttacctaacggacccgtcggtaacccgtaggacccgtaggggaccttaacgggacgttaacggttggtacgggttacctttaacgggtttaacttaccggttagtacgtacgtaacttaagttacttttaacgacgtttacctcccgttacgaccggtttcgaccgggaacgggttaccaaagggtacgtaaccgtaaccgtaaccggtactcgggttacgactcggtacccactttacg

SEQ ID NO: 152904 - DNA, 825 bp, Homo sapiens
  misc_feature: GYAE6OF02HOSJN.25.83.H06.1.454.CMB.1.raw
tcagactgtacagtcacgaccggtgctcgatttagatcacgtgcgtcgcgggggagctacaacaggcaggcacgggcagcaagatggtgttgcagacccaggtcttcatttctctgttgctctggatctctggtgccgtacggggacttcgtgatcgacccagtctccagactccctggctgtgtctcgtgggcgaggacggccaccatacgaacctgacaacgtccacgccagtacgttacgtttttaacacgtcctaccgaactaaagtaaacgaacttacgttaacgtcgttacggactaaccgagaccgaaaggaaaacccgaacggaaaccaaccggtaccccgttacccgttaaaacggcctaggtacccttacctacgtttaaccgtcgggtaactaacgttaccccggtaaccccggggtaaccggttaccccggggttacccgtaccggtaacccggttacgtttaccggtaacggttcgggacgaacggggtccggggtacgttaacgggaccgtaacggttacttacctaccgtacctacgaaccttacgaccgaggtacccgacgtaccgtcgaccgtaacggtaccgtaaggaatcggtaaggttcgtacgtttaaagtttcgttaacgtgtaacctggtaaaccttaaagtttaacgtttacgttaaccgtaacccttacccggtacccgttaacggttcccgggtaaccggtaaccgggggtaacctaacgggttaaaccggtaaaccgtaaaccggtaaacccgttagtttaccggtaacggttaccttaccggaacttaccgtaacgg

SEQ ID NO: 152905 - DNA, 906 bp, Homo sapiens
  misc_feature: GYAE6OF02JWLSO.25.83.H06.1.454.CMB.1.raw
  modified_base (599)..(599): a, c, t, g, unknown or other
  misc_feature (599)..(599): n is a, c, g, or t
tcagactgtacagtcacgaccggtgctcgatttagatcacgtgcgtcgcgggggagctacaacaggcaggcaggggcagcaagatggtgttgcagacccaggtcttcattctctgttgctctggatctctggtcgccgtacggggacttcggtgatcgacccagtctccagacctccgtggctgtcgtctcgtgggcgaggacgggccaccagttccgaacgtcgactaacggtcccacgccgacgtagtttacgtttttacgaacgtccgtaccgaactaaattaacgaacttacgttacggcgtttaggaccctaaccagtacccgaaacgaaacccgtacgggaaccgaccgggtaccctaccggtaaacggtccctaacggtacctacgttaaccgtttttaacggccgggtacccgtaacggtaccccgggttaacccccggggtaaacggtttccccccgggggttacccgtaccggtaaccggttaaacgtttccgggtaacggttaccgggtacggtcgggggtaccggggtcccgggttaacggggaaccacgggtttaccttaccgtaacgttcccctaacgtaacccncgttaaccgccgggaaactaccggtccgttaaccgggcgtaaccggttaccggaacgggaattacgggttacccgttaagggtacgttttacggttaacggttttaccctaggttaaccgagttaacccgttaacgttaacgttaccgttaaacgtcccgttaacccgtaccgggttaacccggttacccgggtaacggtaaaccccggggtaaggttaaacgggtaacccggtaaaaggttaacccggtaaaccgtacggtttaaccgggccggttacggttaacccgaccgtttaaccctacggg

SEQ ID NO: 152906 - DNA, 363 bp, Homo sapiens
  misc_feature: GYAE6OF02F1IMZ.48.60.F05.1.454.CMB.1.raw
  modified_base (359)..(363): a, c, t, g, unknown or other
  misc_feature (359)..(363): n is a, c, g, or t
tcagagtatacatacacgaccggtgctcgatttagtacgtcatcagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttccccctggcaccctcctccaagagcacctctgggggcacagcggccctgggctgcctggtcaaggactacttcctatgtatactctgagcgggctggcaaggcgcatagnnnnn

SEQ ID NO: 152907 - DNA, 361 bp, Homo sapiens
  misc_feature: GYAE6OF02IZZQR.48.60.F05.1.454.CMB.1.raw
  modified_base (357)..(361): a, c, t, g, unknown or other
  misc_feature (357)..(361): n is a, c, g, or t
tcagagtatacatacacgaccggtgctcgatttagtacgtcatcagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggcccatcggtcttcccctggcaccctcctccaagagcacctctggggcacagcggccctgggctgcctggtcaaggactacttcctatgtatactctgagcgggctggcaaggcgcatagnnnnn

SEQ ID NO: 152908 - DNA, 388 bp, Homo sapiens
  misc_feature: GYAE6OF02JZ8PF.48.60.F05.1.454.CMB.1.raw
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (380)..(388): a, c, t, g, unknown or other
  misc_feature (380)..(388): n is a, c, g, or t
tcagagtatacatacacgaccggtgctcgatttagtacgtcatcagggaaagggccgattcaccatctccagagacaacgccaagcactcactgtatctccaaatgaacagcctgagagccgacgacacggctgtgtattactgtgcgagacttgggagagagtgggacctactgttccactttgactactggggccagggaaccctggtcaccgtctcctcagcctccaccaagggccccatccggtccttccccccgtggccacccctcctccaacgacgccacctctgggggccacacgccggccctggggcctcgcctcggtcaacggactacgttccncgtcctcgactctgagccggntaggcaaggcncatgnnnnnnnnn

SEQ ID NO: 152909 - DNA, 557 bp, Homo sapiens
  misc_feature: GYAE6OF01E0ANA.45.63.F08.1.454.CMB.1.raw
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
  modified_base (521)..(521): a, c, t, g, unknown or other
  misc_feature (521)..(521): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggagcttggtacaggccgtggggggtccctgagactctccgtgtgcagccttcgtggacttcccccttanaatgctatagcatgaactggtccnccagctcagggagggctggcgtggttcatacattagtactagtagtagacctatatactacgacagtactctgtcgaagtccgattcgacattcnccagngactaancgacgaatctacactgtatcngacaatcgaacngccctaggaacgnggaacgacgggactaacggtccgtaagttataactacgtggttacgcgtaggtacttacgtttggtaancgtaccaggtaccgtggttcccgaaccggtcggggg

SEQ ID NO: 152910 - DNA, 530 bp, Homo sapiens
  misc_feature: GYAE6OF01BVHWY.45.63.F08.1.454.CMB.1.raw
  modified_base (391)..(391): a, c, t, g, unknown or other
  misc_feature (391)..(391): n is a, c, g, or t
  modified_base (436)..(436): a, c, t, g, unknown or other
  misc_feature (436)..(436): n is a, c, g, or t
  modified_base (472)..(472): a, c, t, g, unknown or other
  misc_feature (472)..(472): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagacgttgggtacaggccgtggggggtccctggagactctcctgtgcagcctctggacttccccttcaatagctatagcatgaactgggtccgccaggctccgaggggaacggggctggcggtgggtttcatacattagtactagtagtagtacatatactcgcagactctgtgaggcgatcacntctcagagacatcgaccaagactcactgtatctagacaatgaacngcctagagagacgaggacacggctagtatattacgngtacgcgtagagttattttcgagtactccagacgtacggttaccgccccggtacgggg

SEQ ID NO: 152911 - DNA, 591 bp, Homo sapiens
  misc_feature: GYAE6OF01A9ZYX.45.63.F08.1.454.CMB.1.raw
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtcagtgtgaggtgcagctggtggagtcgtgggggaggcttggtacagccgtggggggtccctgagactctcctgtgcagcctcgtggattccccttnaatgctatagcatgaactgggtccnccgaggctccgagggaggggctggcgtgggtttcatacattagtactagtagtagtacatatactacgcagtactcgtagtacgaagggccgtattcacctactctccaaggagaacaagtcgacccaaagaacctcacgttgtactacgtgacaaatacgaaacacgcctaggagaacggtacgaagggaccacgggtctagttaattagttacctggacgtacggtaggtacgttacgtttttcgaggttactccgacgtccggtaacgggttccccggaccccgggtaccggggg

SEQ ID NO: 152912 - DNA, 570 bp, Homo sapiens
  misc_feature: GYAE6OF01BAIUS.45.63.F08.1.454.CMB.1.raw
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (457)..(457): a, c, t, g, unknown or other
  misc_feature (457)..(457): n is a, c, g, or t
  modified_base (502)..(502): a, c, t, g, unknown or other
  misc_feature (502)..(502): n is a, c, g, or t
tcagacgcgatcgacacgaccggtgctcgatttagcgatcgtataaggggagagaggtgccttagccctggattccaaggcatttccacttggtgatcagtcactgaacacagaggactcaccatggagttggggctggtgctgggttttccttgttgctattttagaaggtgtccagtgtgaggtgcagctggtggagttctgggggagcttggtacagccgttcggggggtccctggacgactctcctggtcgcagccgtcgtggactttcccccttnaatagctatagcatgaactgggtccncaggctccgaggggagggctggcgtgggtttcatacattagtactagtagtagtaaccattaatactacgcaagactctggtcgaagggccattcaccatcctcagacacaatgaccaagactcactgtatctacgactaaagtcgaaacncgccgtaggagagaacggacgggacacgggcctggtatacttcgngtcgcgtagtacgtacttttacggagttactccgagtacccgtagggttcccgaccccggtacggggg

SEQ ID NO: 152913 - DNA, 616 bp, Homo sapiens
  misc_feature: GYAE6OF01CPV0X.45.63.F08.1.454.CMB.1.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggagcttggtacagccgtggggggtccctgagactctcctgtgcagcctctggtacttccccttanaatagctatagcatgaactgggtccncaggcctccgagggagggctggcgtggttcagtcattagactagtagtagtacctatactactacgcaagtctcgtgtacggaagggtcccgtattaccgaacctatccgtacccgaagacgaacaagtcgtaaccaaagtaacctcaacgtgttaacncgtagaaccaaagtcgaaacncggtcctaggaggaacgacggacgacgacggcttaggtactttacgtacgtggtagccggtaaggacgttttacgttttcggaactttaccgtacccgacggtacgttacccggggttccccgaccccggttaccgggggg

SEQ ID NO: 152914 - DNA, 760 bp, Homo sapiens
  misc_feature: GYAE6OF01C0UR9.45.63.F08.1.454.CMB.1.raw
  modified_base (304)..(304): a, c, t, g, unknown or other
  misc_feature (304)..(304): n is a, c, g, or t
  modified_base (370)..(370): a, c, t, g, unknown or other
  misc_feature (370)..(370): n is a, c, g, or t
  modified_base (408)..(408): a, c, t, g, unknown or other
  misc_feature (408)..(408): n is a, c, g, or t
tcagacgcgatcgacacgaccggtgctcgatttagcgatcgtataagggggagagaggtgccttagccctggattccaaggcatttccacttggtgatcagcactgaacacagaggactcaccatggagttggggctgtgcttgggttttccttgttgctattttagaaggtgtccagtgtgaggtgcagctgggtggagtcgtgggggaggcttggtacagccggtggggggtccctgagactctcctgtgcacgcctctggtacttccccttacaatagctatagcagtgaacgtgggtccncgaggctacgagggagggcgtggcgtggttcatactatagtactagtagtactacatatactacgntacgactcgtagaggaacggtccgtaattccaaccgtntaccgtaccgaaggaacgaacaaacgttcgaaccgaaaacgtaaaccttaccgaacttaggttactaccgttacgaaacgtaaaaacgaccgtaaaaccgacggtaacccacggggtaaacggaacggggtaaccggaaacggggaaacccgttaccgggtaacgttaaggtttaaaacgtttaaccgtttaaacggtttcgggaacgggaacgggtttaaacgggttaaagggtttttaaaccgttttcccgggttttaaaggttaccccgttaacccggtaaaacgggttcccggtttaaaccccgggggttccccgggttaaccccccggggttaaaccccgggggggg

SEQ ID NO: 152915 - DNA, 699 bp, Homo sapiens
  misc_feature: GYAE6OF01B2FPJ.45.63.F08.1.454.CMB.1.raw
  modified_base (565)..(565): a, c, t, g, unknown or other
  misc_feature (565)..(565): n is a, c, g, or t
  modified_base (571)..(571): a, c, t, g, unknown or other
  misc_feature (571)..(571): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttcttgttgctatttagaggtgtccagtgtgaggtgcagctggtggagtcgtggggggagtcgttggtacaggcccgttgggggggttcccctggacgtaccttcctccgtggtcgcgacggcctcgtacggtactttcccccttactaaattacggtccttaacgtagcctaagttacgtaacggttcgggtaccccgtccgacgggtccgtccggaagggggacggggtcgtggggcggtttggggtttacagttacgtagttagtacgttaggtagtacgtacacttaactacgtacgactacgtaccttacgtggttacggaacggggtccctacgtttacccgacctattacccgtaccgaacggaagtaacaagtacgaaccaacgtaactcgacttcgtatctacgactaancgaacnggcctaggacgacgacggacgacgcggtacttagtactttatacgtaggtcgacggtaagtagttcggttttagtaccgtacgtcccgacgttacggtaccgggttccccggtacccggttaccgggg

SEQ ID NO: 152916 - DNA, 828 bp, Homo sapiens
  misc_feature: GYAE6OF01DC2F8.45.63.F08.1.454.CMB.1.raw
  modified_base (292)..(292): a, c, t, g, unknown or other
  misc_feature (292)..(292): n is a, c, g, or t
tcagacgcgatcgacacgaccggtgctcgatttagcgatcgtataagggagagaggtgccttagccctggattccaaggcatttccacttggtgatccagcactgaacacagaggactcaccatggagttgggctgtgcttggtttcctgttgcttattttagagtgtccagtgtgacgtgcagcgtggtggagtcgtgggggagcgttgtacacggccggtcgggggtccctggacgtactcgtccgtggtacgcgtacgtccgtcgtacggttacctttcccccgttaanaacgttcggtacttaacgtagccgtaatacggtaacgttcgggaccccgtcgaacggtcccttaaccgggacgggggtaacgggtccgttcgggtacccggtttagggttttaccaagtttaaccgttaacgtttacggttaaccgtaaggttaacgttaacgtaccctaagttacgttaaccgtacgaacgtacgtaacgtttcgtacgggttacgggaaacggtcccgttaacgtttccgaacccgtttagtttacccggaaccgtaacggtaaacgttaacgtaaaccgtacccggtaaccggaaacggttaaaccttcccgttaaggttacgtacgttaccgtaacggtaacgttaaacgaccgtaaacgacgtacccggtaaggaacgtaccgggaaacgtacgggaaccgtcgtacccttagtaaaccttacgttaaggtcgtacgggtaacgtaggtttaccgtttagttacccggtacgtactcccgaggttaccccggttaaggtaccccggcccggttaaccgggg

SEQ ID NO: 152917 - DNA, 883 bp, Homo sapiens
  misc_feature: GYAE6OF01BD9HQ.45.63.F08.1.454.CMB.1.raw
  modified_base (167)..(167): a, c, t, g, unknown or other
  misc_feature (167)..(167): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (588)..(588): a, c, t, g, unknown or other
  misc_feature (588)..(588): n is a, c, g, or t
tcagacgcgatcgacacgaccggtgctcgatttagcgatcgtataagggagagaggtgccttagccctggattccaaggcatttccacttggtgatcagcaactgaacacagaggactcaccagtggagttgggctgtgcttggttttctgttgcttatttagagtntccagtgtgagtgcagcgtggtggagtcggtggggagtcgttcggacgnggtccggtggggtccccnggacncctctccgtgtcgcacgtcctcgtgtaccttccctagatacgctatacgctagtgaaccggtcggtccccgccgaggtccgtacgggacggggtacggcgtcggtcggttgggttaccagtacgtagttacgtacttaacggttacgttaacggttaaccgtaacttaacgtaacgtaaccggtaccgtacggtaaccggtttaccgcggttttaacggggaaccgggaacggtttaccctaccggttaaccctaacggttacccttacccggtaaccggttaaacggaaaccccgtttaacgttaaacggtaaccccgaaaacggttaaaacccgtaaaccccgtttntttaacccgttagttacccgtaaccggtaaacgtaaacgttaaaccggtaccgaaggttaacccgtaccggtaaagaacggggttaaaccgggtaaaccgggaaaccgggttaccccgtaagggttaacccttttaaagggtttaaccccttaggttttaaaccgggtccggtaaacggtttaaccgggaacgttttttaagttacccggggttttacgtaccgtaacccccggttaggtaacccccggtttccgggttaacccccggggttacccggggtaaacccccgggggg

SEQ ID NO: 152918 - DNA, 867 bp, Homo sapiens
  misc_feature: GYAE6OF01AM1IZ.45.63.F08.1.454.CMB.1.raw
tcagacgcgatcgacacgaccggtgctcgatttagcgatcgtataagggagagaggtgccttagccctggattccaaggcatttccacttggtgatcagcactgaacacgagaggactcaccagtggtaggttggggctggtgtcgtttcgggtttttccgttgttcgtcgtttaagttttaaggaagggttcgttacccgtaaggttggttacggtagggttcgtaccgaggttccggttaggggtacgggttaacggttccggggtagggggggtaacggttcggttttacgggtaaccgtacgggtccccgggttcggggggttacccgtaggtacgtaccctccgttccgtggtcgccgacgtccttcgtacggtaccgtttccccttaataagttacgacgttagtacgtacgtaggttacgtaccggtccgggtaccccgtcgacggtaccggtaccgggaaggggtaaccgggtcggttcgggtcggttttacgggtttactaacgttacgttaagtttacgttaacgtaacggtaacttaaccgttaactaacgtaactaccgacgtcgtacgtacttcggtacgggtaggaccggtacgtccttactaccgtactcgtacgagtactacgtaactcgtaacgaacgttaactacgtacgtacgtacgacgttacgaacgttaacgacgtaacgacgtaccggaggtaacgacggtaacggacgtaccggccgttacgttaacgttaaggtttctacggttaggaccgggtacgttaggtaccgttttaaggtttaccggttacgttaccgttaccggtacgaaccgggttttcccggtccggtaccccgggtaaccgg

SEQ ID NO: 152919 - DNA, 914 bp, Homo sapiens
  misc_feature: GYAE6OF01BH0ZI.45.63.F08.1.454.CMB.1.raw
  modified_base (194)..(194): a, c, t, g, unknown or other
  misc_feature (194)..(194): n is a, c, g, or t
tcagacgcgatcgacacgaccggtgctcgatttagcgatcgtataaggggagagaggtgccttagccctggattccaaggcatttccacttggtgatcagcactgaacacagaggactcaccagtggaggttgggctgtgcgttcgggttttcttgttgtcttagttttaggaggtgtcctagtgtgaggtgcngtcgtggtggtaggtcggtgggggagtcgttggtacgacggtccgggtgggggtccctgacgtccgtctccgtgtcgcacgtccttcgtcgtacctttccccgtataacgtacgtactaatacgactacgttaacggtacccgggttcgggtaccccggccgaccggtccggtaaccgggggaacggggggtaaccggggttccggttacggggtttccgggttttccggggtttaacctaacggtttaactttaagggttttaacgttaaccggttttaacggttaacggttaaccgttaaccttaaagttaaaccgttaccgtaaccgaacgtaacccggttaccgtacgttacggggtacgggtaacccgggtacccgtttaacgttaccccggaaccgtttaccttacccgaccggttaacgaaacggtaacgttaaaccgaccggaaaccctaaaacggttaaaccccttcgtacgtttaacgtttaacgaaccgttaagtaaacctaaaacgtacccgaaaccgtcggaacgtaggaaaccgggaacgtaacggaacgggtcgtaaccggtagtttaaccggttataaaccggtttcggtacgggtacgtaacggttaacgggtttagttttacgtttacgggttaactaccccgggttaacggaccgttacccgggggttccttaccccgggggtacccgggtttaaccgggg

SEQ ID NO: 152920 - DNA, 855 bp, Homo sapiens
  misc_feature: GYAE6OF01B2Y2Y.45.63.F08.1.454.CMB.1.raw
  modified_base (251)..(251): a, c, t, g, unknown or other
  misc_feature (251)..(251): n is a, c, g, or t
tcagacgcgatcgacacgaccggtgctcgatttagcgatcgtataagggagagaggtgccttagccctggattccaaggcatttccacttggtgatcagcactgaacacagagactcaccatggagttggggctgtgtcttggttttccttgttgcttattttaggagtgtcagtgtgaggtgcagctggtggagtcgtgggggagcttggacaggccgtgggggtccctggacgacctctccgtgtcgcncgccgttcgtggtccttacccttactaaacgtcgtaccttaagtcggacctaagtacgtaaccggttccgggtcccgaccgtacgggcccggttaaccggacgggggtaaacgggtcggtacggtcggtttcgggttacctaagttaacctagtttaaccgtacgttaacggttaacgttaaccggacctaaagttaacctaacccgtacggtacccgtaacgttaaaccgtcgttaagggtacgggtaaccggggttaccccgtactttacccgaaaccccttacgtaccccgttaacgaacggtaaacgtaaccgtaacgtcccgtaaaccgtaaaacggtaccctaaccgtaaccgttcggttaaccttaccgtacggtaaacccttaaaaggttacccgtaaaccgggaaccgtaccccgttaaagggaagaacccgggtaaaccgggtaccgggaaccgggtacccgttaccggggttaattaaccggttttaacgtttcggaacgggtttaccgtaacggttaaggtaacgtttggtttacccgtagttacccgtaccgtacgttacggtaccggttacccggcccggttaccggggg

SEQ ID NO: 152921 - DNA, 688 bp, Homo sapiens
  misc_feature: GYAE6OF01DU8A4.45.63.F08.1.454.CMB.1.raw
  modified_base (282)..(282): a, c, t, g, unknown or other
  misc_feature (282)..(282): n is a, c, g, or t
  modified_base (324)..(324): a, c, t, g, unknown or other
  misc_feature (324)..(324): n is a, c, g, or t
  modified_base (599)..(599): a, c, t, g, unknown or other
  misc_feature (599)..(599): n is a, c, g, or t
tcagacgcgatcgacacgaccggtgctcgatttagcgatcgtataagggagagaggtgccttagccctggattccaaggcatttccacttggtgatcagcactgaacacagaggactcaccatggagttgggctgtgcttgggttttccttgttgcttagttttagaaggtgtccagtgtgaggtgcagcgtggtggagtcgtgggggagtcgttggacagccgtcgggggtccctgagtactctccgtgtcgcacgtcctcgtggtacctttcccccttanaacttagaccttaagtagctataggaaccgtcggggtccccnccgaggcctaccggagggggacgggcgttgggccggttggtttcaattacgattagtactagtacgtacgtacctagttactaacgtacgacgaagtaccttcgtaggtacgggaacgggtccctaatttacccaaccgtacttccgtaacccgaaggaacgtaaccgaaagttacccgaaccgaaaacgtaaccttacctaacgttagttacctacgtagaacctaaagtacgaaaccgacgtacctaggaacgaacgacgaacggacgacgtntataacttataccgtggtcgacggtaagttacgtttgtttcgtagtacgtcaagtccggttaaccgggttcccgtaccccgggtacggg

SEQ ID NO: 152922 - DNA, 950 bp, Homo sapiens
  misc_feature: GYAE6OF01DBR3R.45.63.F08.1.454.CMB.1.raw
  modified_base (226)..(226): a, c, t, g, unknown or other
  misc_feature (226)..(226): n is a, c, g, or t
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
  modified_base (666)..(666): a, c, t, g, unknown or other
  misc_feature (666)..(666): n is a, c, g, or t
tcagacgcgatcgacacgaccggtgctcgatttagcgatcgtataaggggagagaggtgccttagccctggattccaaggcatttccacttggtgatcagcactgaacacagagactcacagtggaggttgggctgtgtcgtttcgggttttccttgttgtcttagttttaggaggtgtctagtggtggaggtgcgaggtcgtgggtggtaggtcgggtagggggngtcgttaggacgcggtccgggtacgggggtccctggaacgtccttccgtcgtgcgctacgtctacgtcgtaccttccctataacgtntactagacgatacgtacgtcggtcgggtaccnccggacggtaccgtacggggaaggggtaccgggtcggttacgggttcggtttagttacgtaacgtttacgttaacgttaacggtaacgttaggttaacggttaacctaacgtaagttaaccgttaacgtaaccggtacgtaacggttacccgttggttaacgggaacgggttacccgggtacctttaaaccctaccgtaaacccttacgtaccccggtaacgaaacggtaaccaaaccggttacggttaaacccgaaacccgtaaaacggttaccttcgttaaaccgtttaggtaaaccctacggttaacccggtaaaaanaacccgttaacgggaacccgttaacgggtacgggtaaacggaacgggaacccggggtaaaccggaaccgggttacgttaaccgggttaacggttttaaggttaaaaccctttacggggttaccggttaacgggttaacgggttaaccgggttttaaaggttttacccgggtttttacggtttaaacccggttaccggttaaacccggtttccggtaaacccggggttcccccggggtttaaaccccggggttaaacccccggggtcccgggggtaaaacccggg

SEQ ID NO: 152923 - DNA, 526 bp, Homo sapiens
  misc_feature: GYAE6OF02IMD7O.45.63.F08.1.454.CMB.1.raw
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctggggggtccctgagactctcctgtgcagcctctggacttcccccttcaatagctatagcatgaactgggtccgccaggctccgaggggaggggctggcgtgggtttcatacattagtactagtagtagtaccatatactacgcagactctgtgaagggccgattcaccatctccagagacaatgaccaagaactcactgtatcngacaaatgaacngcctagagagacgagacacggctagtatattacgngtagcgagagtacttttcgngttacncgagtcgtacggttccgacccgtcgggg

SEQ ID NO: 152924 - DNA, 542 bp, Homo sapiens
  misc_feature: GYAE6OF02GINBT.45.63.F08.1.454.CMB.1.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagcctgggggggtccctgagactctcctgtgcagcctctggattccccttcaatagctatagcatgaactgggtccgccaggctccgagggaaggggctggcgtgggttcatacattagtactagtagtagtaccatatactacgcagactctgtgaagggccattccaccatcctccagacgacaatgaccaagaacctcactgtatctgacaaatcgaacagcctgagagacgaggacacggctagtatattacgtgtacgcggagtagttatttttcggtagttacgtccgagtccgtacgggtttccgacccccgtcggggg

SEQ ID NO: 152925 - DNA, 532 bp, Homo sapiens
  misc_feature: GYAE6OF02I68EQ.45.63.F08.1.454.CMB.1.raw
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
  modified_base (471)..(471): a, c, t, g, unknown or other
  misc_feature (471)..(471): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctgggtggagtctggggggaggcttggtacagccgtggggggtccctgagactctcctgtgcagcctctggattcccctcaatagctatagcatgaactgggtccnccaggctccgagggaggggctgggcgtgggtttcatacattagtactagtagtagtaccatatactacgnagactntgtgaaggccattcaccatctccaganacaatgaccaagactcactgtatctgacaaatgaacngcctagacgagacggacggacacggctagtatattcngtggcgtagattagttttcgagttactccgagtccgtacggttcccgaccccggttcgggg

SEQ ID NO: 152926 - DNA, 601 bp, Homo sapiens
  misc_feature: GYAE6OF02JCL1T.45.63.F08.1.454.CMB.1.raw
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
  modified_base (456)..(456): a, c, t, g, unknown or other
  misc_feature (456)..(456): n is a, c, g, or t
  modified_base (509)..(509): a, c, t, g, unknown or other
  misc_feature (509)..(509): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttgggtacagccgtggggggtccctggagactctcctgtgcagcctctggtacttcccccttcaatagctatagcatgaactgggtccgccaggctccgagggagggcgtggcgtgggtttcatacgattagtactagtagtagtaccatatactacgntacgactctgtagaacggcgtattccactatcctaccagagactaangaccaagaactcacgtntaactctagataaatcaaacgngtacctaggaagacgaacggaacggaacgcggtactagttataacgtttacgnggttacggaacggtaaggttaacgttagttttacccggtagttacctacggtacgtaccgggtacggtttcccggacccccggttacggggg

SEQ ID NO: 152927 - DNA, 542 bp, Homo sapiens
  misc_feature: GYAE6OF02GMCGN.45.63.F08.1.454.CMB.1.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtctgggggaggcttggtacagccgtgggggggtccctggagactctcctgtgcagcctctggacttcccccttcaatagctatagcatgaactgggtccgccaggctccaggggaggggctgggcgtgggtttcatacattagtactagtagtagtaccatatactacgcagactctgtgaagggccattcaccatctccagagacaatgaccaagactcactgttatctagacaaatcgaacacgcctagagagacgaggacacggctagtatattactggtgacggagtacgtattttcgagttactccgagtccgtacgggttccgaccccggttacggggg

SEQ ID NO: 152928 - DNA, 1075 bp, Homo sapiens
  misc_feature: GYAE6OF02HTW4S.45.63.F08.1.454.CMB.1.raw
tcagacgcgatcgacacgaccggtgctcgatttagcgatcgtataagggagagaggtgccttagcctggattccaagcatttccacttgtgatcagcactgaacacagaggactcaccatggagttggggcttgtgcgttggggtttttccttggtttgtcgttatttttaaggaaggttgttccgagttggttgacggttggcagcgttgggtggaggttcgttggggggaggtcgtttgggtacgaggtcccgtggggggggtttcccctggaagtcgttacctccgttgtgacgcgtccgttcgttggtacttaccccgtttctaacgttacgtacgttactaggtacctagttacggtaaccgttcggggttaccccggaccgtaacggtccgttaacccggaacggggggaaacggggtccgttacggggtccgggtttgggggtttttaccctaaggttaaacccgtagtttttaacgggtaaccgttttaagggtaacgggtttaaagtttaaccccggaagttttaaacgtttaaaccgttacccggttacgaacccggttaaaccgttttccggtttaaaggggttacgggtaaaacccggggtccggggtttaaaccttttacccggtaacccccgttaaactttacccggttacccgggtttaacggtaaacccgggtaaaactaaagtttaacccgggaacctaaaaaaccgggttaacccgttaaacccgttaaacgtttaaccggtttaacgttttacccgttaacggaaacccgtttaaaaactttaacgggaaacccttaaaccgggttacccccgttaaagggggaacccgaaaacggggtaaacccgggaaacgggttaaacccggaacccggggttaccgtttaaggttaaccggttttaaactttacccggggttattttaacggggaaccggttaaccgggaaaggttttttacggtttttttacccgggaaggtttttacgtaacccgtttacggggaacccggtttttaacgggttacccccggggttaccccgggtttaaacccggggggg

SEQ ID NO: 152929 - DNA, 581 bp, Homo sapiens
  misc_feature: GYAE6OF02HE19W.45.63.F08.1.454.CMB.1.raw
  modified_base (270)..(270): a, c, t, g, unknown or other
  misc_feature (270)..(270): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagacttggtacagccgtggggggtccctgagactctcctgtgcagcctcgtggacttccccttnaatagctatagcatgaactgggtccgccgaggcctccgaggggaacggggcgtgggcggttgggtttcatactattagtactagtagtagtaccatatactacgcagactctgtaggaagggccgattccacctatcctccgagaacgacaagtcgaccaaagaacctcacctagttactcgtacgacaaatcgaacacgcctagagaagacggaaggaccgaacggctagttaatagttactggtacgacggtaggtagttagttttcgtagttactcccgagccgtacggttcccgaccccgtcggggg

SEQ ID NO: 152930 - DNA, 829 bp, Homo sapiens
  misc_feature: GYAE6OF02HBIGD.45.63.F08.1.454.CMB.1.raw
tcagacgcgatcgacacgaccggtgctcgatttagcgatcgtataaggggagagaggtgccttagccctggattccaaggcatttccacttggtgatcagcactgaacacagaggactcaccatggagttgggctgtgctgggttttccttgttgctattttagaaggtgtccagtgtgaggtgcagctggtggagtcgtgggggaggcttggtacaggccgtgggggtccctgagactctcctgtgcacgcctcgtggtacctttcccccttacaattacgtaccttaagtacgcctaagtaggtaaccggtcggggtccccggcccgaacgggtcccgtaccccgggaaggggggaacgggggtccgtggggtccgggtttcggggttttccaacgttacgtaagttttaacggttaacgttaggttaagtaacgtaacctaattaacgtttaaccgaaccgtacaacgtaccgttacgtagggtacggaaacgggtcccgtaattacccaacccgtacttcccgtaccgtaaggaaccgtaaccgaaagttccgaaacccgtaaaagaacccttacgtaacccgttggtttaacctacgtaagtaaacctaaaagtacgaaacctcggtaaccgtaagggtaacggaacggtaacccgggaaccggtaaccgtaaccgggtaccttaaggttaaccttaacggtttaacgtggtaacggccggttaaggttaacgtttacgtttttaccgggtagtttaacccgtaccccgggtagttaccccgggtttaccggggttacccccggtaccccgggttacccggggg

SEQ ID NO: 152931 - DNA, 716 bp, Homo sapiens
  misc_feature: GYAE6OF02GZWCM.45.63.F08.1.454.CMB.1.raw
  modified_base (399)..(399): a, c, t, g, unknown or other
  misc_feature (399)..(399): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagacttggtacaggccgtggggggtccctgagactctcctgtgcagcctctggacttcccccttcaatagctatagcatcgaactcgggtccgccgacgggctacccgaaggggtaaggggcctgggaccggttgggttttccaataactatttaacgtactaaggtagtaagtaccaattaactactacganaacgacttcgtagtacggaaaggtcccgtaagtttccaaccgatcctacccgaaggaacgaacaaagtcgacctaaaacggaacctcctaaccgttggtaacttaccgagaaactaaactacgaaaccgagacccgttaggaaagaacggtaacggaaggaccaaccggggtcttaagtaatttaacgtttacgtacggtacgggtaaccgtaaaggttacggttaacgttttttaccgggttagtaaccttaccccggaaggttacccggttaaacggggttttccccggaacccccccgggtttaaccggggggg

SEQ ID NO: 152932 - DNA, 605 bp, Homo sapiens
  misc_feature: GYAE6OF02GLHHW.45.63.F08.1.454.CMB.1.raw
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtggggggaggcttggtacaggccgtggggggtccctgagactctcctgtgcagcctctggacttcccctcaatagctatagcatgaactgggtccgccaggctccgagggagggctgggcggtgggtttcatacagttagtactagtagtagtaccatatactacgcagactcgtgtagaacgggtcctattccaaccatcctaccaaggaacgacaacgtgaccctaaagaacctccaacttgtaactctagaactaaaatcgaaaccagtcccgtagacggaagaaccggtaggaaccgacggtcgttagtaacttataccgtggtacggcggtaaggttagtacgttttcgtagttactacccgtaggtcccgttaggttccccggacccggttaccggggg

SEQ ID NO: 152933 - DNA, 525 bp, Homo sapiens
  misc_feature: GYAE6OF02HGYQ1.45.63.F08.1.454.CMB.1.raw
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (479)..(479): a, c, t, g, unknown or other
  misc_feature (479)..(479): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcttggtacagccgtggggggtccctgagactctcctgtgcagcctctggattcccctnaatagctatagcatgaactgggtccncaggctccgagggagggctggcgtggttcatacattagtactagtagtagtacatactactacgcagactntgngaagggctatcacatccacagacanaatcacaagactcactgtatctagacaaatcgaagacgctacgagacgaccgagaacgacgcgtagtatacttagtgtcgacggtaanacggtatttcgtagtactccagcgtacggttccgacccgtacgggg

SEQ ID NO: 152934 - DNA, 591 bp, Homo sapiens
  misc_feature: GYAE6OF02GI1XO.45.63.F08.1.454.CMB.1.raw
  modified_base (271)..(271): a, c, t, g, unknown or other
  misc_feature (271)..(271): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcgttggtacagccgtggggggtccctgagactctcctgtgcagcctctggtacttccccttnaatagctatagcatgaacgtgggtccgccaggctccgagggagggctggcgttgggttcatactattagtactagtagtacgtaccatactactacgcagactctgtgacggcctatcacactctacagacgactaagtgaccaaagacctcattatactcgtnactaaagtgaacngtaccgagagagacgaacgtacgacggtctagtattacgttacgtgtacggacggtaagtaacggttacgtttttccgtaggttaccgttaccgtaacggtacccggttaccgggtttaccccggacccccggttacgggggg

SEQ ID NO: 152935 - DNA, 641 bp, Homo sapiens
  misc_feature: GYAE6OF02IBEKK.45.63.F08.1.454.CMB.1.raw
  modified_base (439)..(439): a, c, t, g, unknown or other
  misc_feature (439)..(439): n is a, c, g, or t
  modified_base (543)..(543): a, c, t, g, unknown or other
  misc_feature (543)..(543): n is a, c, g, or t
  modified_base (565)..(565): a, c, t, g, unknown or other
  misc_feature (565)..(565): n is a, c, g, or t
tcagacgcgatcgacacgaccggtgctcgatttagcgatcgtataaggggagagaggtgccttagccctggattccaaggcatttccacttggtgatcagcactgaacacagaggactcaccatggagttggggctgtgctgggtttttccttgttgcttattttagaggtgtccagtgtgaggtgcagctggtggagtcgtgggggaggcttggtacaggcgtggggggtccctggagacctcgtccgtgtgccgagtcctcgtcggtactttccccttcaaagtacgctatacgctatagaccgtgggtcccgccgtacggctaccgggaggggaagggtcgtgggtacggttcgggtttacagtacgtattacgtataggtagtagtaaccattactacacgcagctagttggagacgggtccgtaattccaactntactcgaagactaacacttgaacctaagtaacctcgtactgtagtctagaaccaaagttacaactaagccctagacggtagaaccgggaggaacctacgggtanatttacgtacttcgacgtcggngtaaagtcgtttaagttttccgaggttaactccggttagccggtttacccgggttacccgacccggggttaccggg

SEQ ID NO: 152936 - DNA, 241 bp, Homo sapiens
  misc_feature: GYAE6OF01C28XI.49.14.B03.1.454.CMB.1.raw
  modified_base (239)..(241): a, c, t, g, unknown or other
  misc_feature (239)..(241): n is a, c, g, or t
tcagagtcgagagacacgaccggtgctcgatttagtgtgagtagttccgcgggcacgaccggtgctcgatttagtgtgagtacttccgcgggcacgaccggtgctcgatttagctctacgctcagggcacgaccggtgctcgatttagtcacgcgagaaagggaaggggctggccctgacgtgtttctgttcccaccctcctctctctcgactctgagcgggctggcaaggcgcatagnnn

SEQ ID NO: 152937 - DNA, 316 bp, Homo sapiens
  misc_feature: GYAE6OF01C6N8C.49.14.B03.1.454.CMB.1.raw
  modified_base (313)..(316): a, c, t, g, unknown or other
  misc_feature (313)..(316): n is a, c, g, or t
tcagagtcgagagacacgaccggtgctcgatttagtgtgagtagttccgcgggcgacgaccggtgctcgatttagtgtgagtagttccgcggcgacgaccggtgctcgatttagctctacgctcaggcacgaccggtgctcgatttagctctacgctcagggcacgaccggtgctcgatttagagagagtgtgttgggttggggaagaggaagactgacggtcccccaggagttcaggtgctggcacagcgcctgggctgcctggtcaaggactacttctcgtagcactctgagcgggctgcaagcgcatagnnnn

SEQ ID NO: 152938 - DNA, 240 bp, Homo sapiens
  misc_feature: GYAE6OF01DZBW8.49.14.B03.1.454.CMB.1.raw
  modified_base (240)..(240): a, c, t, g, unknown or other
  misc_feature (240)..(240): n is a, c, g, or t
tcagagtcgagagacacgaccggtgctcgatttagtgtgagtagttccgcgggcacgaccggtgctcgatttagtgtgagtacttccgcgggcacgaccggtgctcgatttagctctacgctcagggcacgaccggtgctcgatttagtcacgcgagaaagggaaaggggctggccctgacgtgtttctgttcccaccctcctctctctcgactctgagcgggctggcaaggcgcatagn

SEQ ID NO: 152939 - DNA, 330 bp, Homo sapiens
  misc_feature: GYAE6OF01AN5GS.49.14.B03.1.454.CMB.1.raw
  modified_base (280)..(280): a, c, t, g, unknown or other
  misc_feature (280)..(280): n is a, c, g, or t
  modified_base (301)..(302): a, c, t, g, unknown or other
  misc_feature (301)..(302): n is a, c, g, or t
  modified_base (304)..(330): a, c, t, g, unknown or other
  misc_feature (304)..(330): n is a, c, g, or t
tcagagtcgagagacacgaccggtgctcgatttagtgtgagtagttccgtcgggtcggacgaccggtgctcgatttacgacagtatatatccgcgggcacgaccggtgcctcgatttagaccagtatatatccgcgggcacgaccggtgctcgatttacgagagagtgtgttgggtttgggggaagaggaagacctgacggtccccccaggagttccaggtgctgggcacagcggccctgggctgcctggtcaaggactacttcctcgtagcactctgancgggctggcaaggcgcatagnncnnnnnnnnnnnnnnnnnnnnnnnnnnn

SEQ ID NO: 152940 - DNA, 109 bp, Homo sapiens
  misc_feature: GYAE6OF01D9IYU.49.14.B03.1.454.CMB.1.raw
  modified_base (109)..(109): a, c, t, g, unknown or other
  misc_feature (109)..(109): n is a, c, g, or t
tcagagtcgagagacacgaccggtgctcgatttagtgtgagtagttccgcgggcacgaccggtgctcgatttagtgtgagtagctgagcgggctggcaaggcgcatagn

SEQ ID NO: 152941 - DNA, 213 bp, Homo sapiens
  misc_feature: GYAE6OF01A1AWQ.49.14.B03.1.454.CMB.1.raw
  modified_base (212)..(213): a, c, t, g, unknown or other
  misc_feature (212)..(213): n is a, c, g, or t
tcagagtcgagagacacgaccggtgctcgatttagtgtgagtagttccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 152942 - DNA, 163 bp, Homo sapiens
  misc_feature: GYAE6OF01COK5H.49.14.B03.1.454.CMB.1.raw
  modified_base (163)..(163): a, c, t, g, unknown or other
  misc_feature (163)..(163): n is a, c, g, or t
tcagagtcgagagacacgaccggtgctcgatttagtgtgagtagttccgcgggcacgaccggtgctcgatttagtcacgcgagaaagggaagggctggccctgacgtgtttctgttcccgcctcctctctctcgactctgagcgggctggcaaggcgcatagn

SEQ ID NO: 152943 - DNA, 325 bp, Homo sapiens
  misc_feature: GYAE6OF01DAXW8.49.14.B03.1.454.CMB.1.raw
  modified_base (324)..(325): a, c, t, g, unknown or other
  misc_feature (324)..(325): n is a, c, g, or t
tcagagtcgagagacacgaccggtgctcgatttagtgtgagtagttccgcgggcacgaccggtgctcgatttagtgtgagtagttccgcgggcgacgaccggtgctcgatttagctctacgctcagggcacgaccggtgctcgatttagctctacgctcagggcgacgaccggtgctcgatttacgagagagtgtgttgggtttgggggaagaggaagactgacggtcccccaggagttcaggtgctgggcacagcggccctgggctgcctggtcaaggactacttcctcgtagcactctgagcgggctggcaaggcgcatagnn

SEQ ID NO: 152944 - DNA, 166 bp, Homo sapiens
  misc_feature: GYAE6OF01B5CDP.49.14.B03.1.454.CMB.1.raw
  modified_base (166)..(166): a, c, t, g, unknown or other
  misc_feature (166)..(166): n is a, c, g, or t
tcagagtcgagagacacgaccggtgctcgatttagtgtgagtagttccgcgggcacgaccggtgctcgatttagtcacgcgagaaagggaaaggggctggccctgacgtgtttctgttcccaccctcctctctctcgactctgagcgggctggcaaggcgcatagn

SEQ ID NO: 152945 - DNA, 205 bp, Homo sapiens
  misc_feature: GYAE6OF01EIUIE.49.14.B03.1.454.CMB.1.raw
  modified_base (167)..(205): a, c, t, g, unknown or other
  misc_feature (167)..(205): n is a, c, g, or t
tcagagtcgagagacacgaccggtgctcgattttagtgtgagtagttccggcgggcgacgaccggtgctcgatttagcacgcgagaagggaaggggctggccctgacgtgttctcgttcccacctcctctctctcgactctggagcggctggcaagggcgctatagnnnnnnnnnnnnnnnnnnnnnnnnnnnnnnnnnnnnnnn

SEQ ID NO: 152946 - DNA, 251 bp, Homo sapiens
  misc_feature: GYAE6OF01CQ3TG.49.14.B03.1.454.CMB.1.raw
  modified_base (248)..(251): a, c, t, g, unknown or other
  misc_feature (248)..(251): n is a, c, g, or t
tcagagtcgagagacacgaccggtgctcgatttagtgtgagtagttccgcgggcacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnn

SEQ ID NO: 152947 - DNA, 141 bp, Homo sapiens
  misc_feature: GYAE6OF01ARI9O.49.14.B03.1.454.CMB.1.raw
  modified_base (128)..(141): a, c, t, g, unknown or other
  misc_feature (128)..(141): n is a, c, g, or t
tcagagtcgagagacacgaccggtgctcgatttagtgtgagtagttccgcgggctggcaaggcgcatagctgcctggtcaaggactacttcccgagcgacgactgagcgggctggcaaggcgcatagnnnnnnnnnnnnnn

SEQ ID NO: 152948 - DNA, 191 bp, Homo sapiens
  misc_feature: GYAE6OF01BPJM0.49.14.B03.1.454.CMB.1.raw
  modified_base (167)..(191): a, c, t, g, unknown or other
  misc_feature (167)..(191): n is a, c, g, or t
tcagagtcgagagacacgaccggtgctcgatttagtgtgagtagttccgcgggtcgacgaccggtgctcgatttagtcacgcgagaaaggaaggggctggccctgacgtgtttcctgttcccgcctcctctcgtctcgactctgagcgggctggcaaggcgcatagnnnnnnnnnnnnnnnnnnnnnnnnn

SEQ ID NO: 152949 - DNA, 217 bp, Homo sapiens
  misc_feature: GYAE6OF01EU2N3.49.14.B03.1.454.CMB.1.raw
  modified_base (216)..(217): a, c, t, g, unknown or other
  misc_feature (216)..(217): n is a, c, g, or t
tcagagtcgagagacacgaccggtgctcgatttagtgtgagtagttccgcgggcacgaccggtgctcgatttagagagagtgtggttgggtttggggggaagaggaagactgaccggtccccccaggagttcaggtgctgggcacagcggccctgggctgcctggtcaaggactacttcctctctcgactctgagcgggctggcaaggcgcatagnn

SEQ ID NO: 152950 - DNA, 114 bp, Homo sapiens
  misc_feature: GYAE6OF01BEZ25.49.14.B03.1.454.CMB.1.raw
  modified_base (111)..(114): a, c, t, g, unknown or other
  misc_feature (111)..(114): n is a, c, g, or t
tcagagtcgagagacacgaccggtgctcgatttagtgtgagtagttccgcgggcacgaccggtgctcgattttagtgtgagtagttccgcgggcgtggcaaggcgcatagnnnn

SEQ ID NO: 152951 - DNA, 332 bp, Homo sapiens
  misc_feature: GYAE6OF01BDFFY.49.14.B03.1.454.CMB.1.raw
  modified_base (244)..(244): a, c, t, g, unknown or other
  misc_feature (244)..(244): n is a, c, g, or t
  modified_base (258)..(259): a, c, t, g, unknown or other
  misc_feature (258)..(259): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(266): a, c, t, g, unknown or other
  misc_feature (265)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(275): a, c, t, g, unknown or other
  misc_feature (273)..(275): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (283)..(285): a, c, t, g, unknown or other
  misc_feature (283)..(285): n is a, c, g, or t
  modified_base (287)..(290): a, c, t, g, unknown or other
  misc_feature (287)..(290): n is a, c, g, or t
  modified_base (292)..(332): a, c, t, g, unknown or other
  misc_feature (292)..(332): n is a, c, g, or t
tcagagtcgagagacacgaccggtgctcgatttagtgtgagtagttccgcgggcacgaccggtgctcgatttagtagtgtagattccgcgggcacgaccggtgctcgatttagtcgagctctctcgcgggcacgaccggtgctcgatttagtcgagctctctcgcgggctggcaaggcgcatagcggctggcaggcgcatagcggctggcaaggcgcagtacgcgggctggcaaggcgcagtgnggctggcaaggcgnngngngnngnagngnnngngngngnnngnnnngnnnnnnnnnnnnnnnnnnnnnnnnnnnnnnnnnnnnnnnnn

SEQ ID NO: 152952 - DNA, 319 bp, Homo sapiens
  misc_feature: GYAE6OF01C2GAT.49.14.B03.1.454.CMB.1.raw
  modified_base (124)..(124): a, c, t, g, unknown or other
  misc_feature (124)..(124): n is a, c, g, or t
  modified_base (178)..(178): a, c, t, g, unknown or other
  misc_feature (178)..(178): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (273)..(319): a, c, t, g, unknown or other
  misc_feature (273)..(319): n is a, c, g, or t
tcagagtcgagagacacgaccggtgctcgatttagtgtgagtagttccgcgggcgacgaccggtgctcgatttagtcgagctctctcgcgggcacgaccggtgctcgatttagcgatctctcgngggcacgccggtgctcgattttagcgagctctcgtcgacggggcacggccggtnctcgtatttagcgagctctcgcggcggcacgccggtgctcggtatttcgcggancctcgtcgaggccggntagggacagggcacagngnctgnannnnnnnnnnnnnnnnnnnnnnnnnnnnnnnnnnnnnnnnnnnnnnn

SEQ ID NO: 152953 - DNA, 249 bp, Homo sapiens
  misc_feature: GYAE6OF01BL7GY.49.14.B03.1.454.CMB.1.raw
  modified_base (240)..(249): a, c, t, g, unknown or other
  misc_feature (240)..(249): n is a, c, g, or t
tcagagtcgagagacacgaccggtgctcgatttagtgtgagtagttccgcgggcacgaccggtgctcgatttagtgtgagtacttccgcgggcacgaccggtgctcgatttagctctacgctcagggcacgaccggtgctcgatttagtcacgcgagaaagggaaggggctggccctgacgtgtttctgttcccaccctcctctctctcgactctgagcgggctggacaaggcgcatagnnnnnnnnnn

SEQ ID NO: 152954 - DNA, 212 bp, Homo sapiens
  misc_feature: GYAE6OF02HBDE2.49.14.B03.1.454.CMB.1.raw
  modified_base (212)..(212): a, c, t, g, unknown or other
  misc_feature (212)..(212): n is a, c, g, or t
tcagagtcgagagacacgaccggtgctcgatttagtgtgagtagttccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 152955 - DNA, 113 bp, Homo sapiens
  misc_feature: GYAE6OF02F1T5Y.49.14.B03.1.454.CMB.1.raw
  modified_base (112)..(113): a, c, t, g, unknown or other
  misc_feature (112)..(113): n is a, c, g, or t
tcagagtcgagagacacgaccggtgctcgatttagtgtgagtagttccgcgggcacgaccggtgctcgatttagcacacgatagttgggagcgggctggcaaggcgcatagnn

SEQ ID NO: 152956 - DNA, 166 bp, Homo sapiens
  misc_feature: GYAE6OF02HOPCB.49.14.B03.1.454.CMB.1.raw
  modified_base (166)..(166): a, c, t, g, unknown or other
  misc_feature (166)..(166): n is a, c, g, or t
tcagagtcgagagacacgaccggtgctcgatttagtgtgagtagttccgcgggcacgaccggtgctcgatttagtcacgcgagaaagggaaaggggctggccctgacgtgtttctgttcccgccctcctctctctcgactctgagcgggctggcaaggcgcatagn

SEQ ID NO: 152957 - DNA, 167 bp, Homo sapiens
  misc_feature: GYAE6OF02G2Y7I.49.14.B03.1.454.CMB.1.raw
  modified_base (166)..(167): a, c, t, g, unknown or other
  misc_feature (166)..(167): n is a, c, g, or t
tcagagtcgagagacacgaccggtgctcgatttagtgtgagtagttccgcgggcacgaccggtgctcgatttagtcacgcgagaaagggaaaggggctggccctgacgtgtttctgttcccaccctcctctctctcgactctgagcgggctggcaaggcgcatagnn

SEQ ID NO: 152958 - DNA, 295 bp, Homo sapiens
  misc_feature: GYAE6OF02HAULN.49.14.B03.1.454.CMB.1.raw
  modified_base (290)..(295): a, c, t, g, unknown or other
  misc_feature (290)..(295): n is a, c, g, or t
tcagagtcgagagacacgaccggtgctcgatttagtgtgagtagttccgcgggcgacgaccggtgctcgatttagacagtatatatccgcgggcacgaccggtgctcgatttagacagtatatatccgcgggcacgaccggtgctcgatttagagagagtgtgttgggttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 152959 - DNA, 212 bp, Homo sapiens; identical to SEQ ID NO: 152954
  misc_feature: GYAE6OF02HPND4.49.14.B03.1.454.CMB.1.raw
  modified_base (212)..(212): a, c, t, g, unknown or other
  misc_feature (212)..(212): n is a, c, g, or t

SEQ ID NO: 152960 - DNA, 166 bp, Homo sapiens; identical to SEQ ID NO: 152956
  misc_feature: GYAE6OF02GNSKP.49.14.B03.1.454.CMB.1.raw
  modified_base (166)..(166): a, c, t, g, unknown or other
  misc_feature (166)..(166): n is a, c, g, or t

SEQ ID NO: 152961 - DNA, 106 bp, Homo sapiens
  misc_feature: GYAE6OF02IJZ6Q.49.14.B03.1.454.CMB.1.raw
  modified_base (106)..(106): a, c, t, g, unknown or other
  misc_feature (106)..(106): n is a, c, g, or t
tcagagtcgagagacacgaccggtgctcgatttagtgtgagtagttccgcgggcacgaccggtgctcgatgtgtgagtagttcagcgggctggcaaggcgcatagn

SEQ ID NO: 152962 - DNA, 213 bp, Homo sapiens
  misc_feature: GYAE6OF02HY2F2.49.14.B03.1.454.CMB.1.raw
  modified_base (213)..(213): a, c, t, g, unknown or other
  misc_feature (213)..(213): n is a, c, g, or t
tcagagtcgagagacacgaccggtgctcgatttagtgtgagtagttccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 152963 - DNA, 221 bp, Homo sapiens
  misc_feature: GYAE6OF02GS2L8.49.14.B03.1.454.CMB.1.raw
  modified_base (213)..(221): a, c, t, g, unknown or other
  misc_feature (213)..(221): n is a, c, g, or t
tcagagtcgagagacacgaccggtgctcgatttagtgtgagtagttccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnnnnn

SEQ ID NO: 152964 - DNA, 160 bp, Homo sapiens
  misc_feature: GYAE6OF02FFZBF.49.14.B03.1.454.CMB.1.raw
  modified_base (126)..(126): a, c, t, g, unknown or other
  misc_feature (126)..(126): n is a, c, g, or t
  modified_base (149)..(160): a, c, t, g, unknown or other
  misc_feature (149)..(160): n is a, c, g, or t
tcagagtcgagagacacgaccggtgctcgatttagtgtgagtagttccgcgggcacgaccggtgctcgatttagctctacgctcagggcacgaccggtgctcgatttagtcacgcgagaaaggganagcgggctggcaaggcgcatagnnnnnnnnnnnn

SEQ ID NO: 152965 - DNA, 644 bp, Homo sapiens
  misc_feature: GYAE6OF01DGYT4.22.20.B09.1.454.CMB.1.raw
  modified_base (231)..(231): a, c, t, g, unknown or other
  misc_feature (231)..(231): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagtttcagataccactggagaaatagtgatgacgcagtctccagccaccctgtctgtgtctccgaggggaaagagccacactctcctgcagggccagtcaggngtgtagcagcagtcttagccgtaggtaccagacaacgaaccgtggaccaggcctcccgaggcctcctacatctagtggtcgactatcgtacggacggcctacgtggtactcccgagccgtagggttcaggtcggactagggttcgggtcgtaggggactagggtacgttaccactcctaccacctactacgacgcacgtcctgacgtagtcgtagtaagttagtttcgtactttagttttacttacgttgtacgtacgtactaacttaattaaacgttaacgtccgtaccgttaccggttaacgttacgggtttacggaccggtaacggggtaacccgtaacggtcggttacgggtaacgtaacgtaaaccgaaaacggtaacggttacggtacggtactcggaccgtaaccg

SEQ ID NO: 152966 - DNA, 124 bp, Homo sapiens
  misc_feature: GYAE6OF01DOSOS.22.20.B09.1.454.CMB.1.raw
  modified_base (123)..(124): a, c, t, g, unknown or other
  misc_feature (123)..(124): n is a, c, g, or t
tcagacatacgcgtcacgaccggtgctcgatttagtgtagtgtgaagggcacagcggccctgggctgcctggtcaaggactacttccacgcgtatgtctgagcgggctggcaaggcgcatagnn

SEQ ID NO: 152967 - DNA, 523 bp, Homo sapiens
  misc_feature: GYAE6OF01BBGN1.22.20.B09.1.454.CMB.1.raw
  modified_base (194)..(194): a, c, t, g, unknown or other
  misc_feature (194)..(194): n is a, c, g, or t
  modified_base (387)..(387): a, c, t, g, unknown or other
  misc_feature (387)..(387): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaangccaccctctcgtgtaaggccagtcagaatgttaacaacagatatgtagcctggtatcagcagagacctggccagtctcccgttctcctcgtctttggtgcggccgacagggccacgggcatccctgacagattcgagtggcagtggggtccggtcagactatctgctcacatcggcgtctggaacctgaagnttctgcactatattactgttcagtctttatgtttaattctacctcgtcgtactacttctttcggccgtacggggacctaagcgtaggagtactacgaaacgtacgtgtggctgcacctatctgttcttctagtccc

SEQ ID NO: 152968 - DNA, 509 bp, Homo sapiens
  misc_feature: GYAE6OF01AS7K1.22.20.B09.1.454.CMB.1.raw
  modified_base (350)..(350): a, c, t, g, unknown or other
  misc_feature (350)..(350): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccttgacagattcagtggcagtgggtccgggtnagactatctgctcacatcggcgtctggaacctgaagattctgcactatattactgtcagtcttttatgtttaattcaccttcgtcgtactattctttggcctaggggaccagctggacgatacaaacgactgtaggctgcactntctgtcttcnttccc

SEQ ID NO: 152969 - DNA, 510 bp, Homo sapiens
  misc_feature: GYAE6OF01DNR2B.22.20.B09.1.454.CMB.1.raw
  modified_base (194)..(194): a, c, t, g, unknown or other
  misc_feature (194)..(194): n is a, c, g, or t
  modified_base (349)..(349): a, c, t, g, unknown or other
  misc_feature (349)..(349): n is a, c, g, or t
  modified_base (503)..(504): a, c, t, g, unknown or other
  misc_feature (503)..(504): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaangccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtnagactatctgctcacatcggcgtctggaacctgaagattctgcactatattactgtcagtctttatgtttaattcaccttcgtcgtacattctttggccgtaggggaccagctggaagatacgaaacgtaactggtggctgcacatctgtcttnnttcccg

SEQ ID NO: 152970 - DNA, 576 bp, Homo sapiens
  misc_feature: GYAE6OF01CG6WS.22.20.B09.1.454.CMB.1.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
  modified_base (414)..(414): a, c, t, g, unknown or other
  misc_feature (414)..(414): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaagngcccaccctctcgtgtaaggccagtcagaatgttaacaacagatatgtagcctggtatcagcagagacctggccagtctcccgttctcctcgtctttggtgcggccgacacgggccacgggcatccctgacagattcaggtggcaggtgggtccgggtnagactatctgctcaccagtcggcggtctggaacctgaagattctgcacttatatttacngtcagtctttatgtttaattcaccttccgtcgtactattcctttggaccgaaggggtacccaaggcgttagggagtacgtaaccgaaaacggtaacgttggtacggtccttcggaccctaacccgtactttccgttaggtttccctttcgtactttcccccg

SEQ ID NO: 152971 - DNA, 523 bp, Homo sapiens
  misc_feature: GYAE6OF01ASSM7.22.20.B09.1.454.CMB.1.raw
  modified_base (390)..(390): a, c, t, g, unknown or other
  misc_feature (390)..(390): n is a, c, g, or t
  modified_base (447)..(447): a, c, t, g, unknown or other
  misc_feature (447)..(447): n is a, c, g, or t
  modified_base (517)..(517): a, c, t, g, unknown or other
  misc_feature (517)..(517): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacggggcatccctgacagattcagtggcaggtgggtccggtcagactatctgctcaccagtcggcgtctggacctgaagtnttctgctactatattactgtctagtctttatgtttaacttcaccttccgtcgtactnttcgtttcggccgtaggggaccaagcgtggagatacgaaacgtactgtcggctgcacctatctgtcttcnttcccg

SEQ ID NO: 152972 - DNA, 526 bp, Homo sapiens
  misc_feature: GYAE6OF01D63CI.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagaaaccaccggagaagttgtgttgacacagtctccagccaccctgtctgtgtctccgaggggaaangccacactctcctgcagggccagtcagagtgttagcagcagcttagcctggtaccagcagaaacctggccaggcctcccaggctcctcatctatggtgcatctacggagggcccacgtggtaatcccagccaggttcaggtggcaggtgggtctgggacagagttcactctcaccatcagcagcctgcagtctagtaagtattttgcttagttttattactgtcagctactataaataactggtcctaccgtacttaggttttcggccgtagggaccaagtcgtaggaagagtacaaacgactgtcggcgtagcaactatctgttcttacc

SEQ ID NO: 152973 - DNA, 513 bp, Homo sapiens
  misc_feature: GYAE6OF01BE3BT.22.20.B09.1.454.CMB.1.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggngcggccgacngggccacgggcatccctgacagattcagtggcagtgggtccgggtnagactatctgctcaccntccggcgtctggaacctgaagattctgcactatattactgtcagtctttatgttaattcacctcgtcgtacattctttggcctagggacctagctaggagtacgtacaaacgtactgtcggctgcactntctntcttcngttcccg

SEQ ID NO: 152974 - DNA, 516 bp, Homo sapiens
  misc_feature: GYAE6OF01ATE24.22.20.B09.1.454.CMB.1.raw
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (511)..(511): a, c, t, g, unknown or other
  misc_feature (511)..(511): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcaggtgggtccgggtcagactatctgctcaccatcggcggtctggacctgaagnttcngcactatattactgtcagtctttatgtttaattcaccttccgtcgtactattcgtttggccgaggggaccagcgtggagatacaaacgactggtaggctcgcactacttctgtcttcnttccc

SEQ ID NO: 152975 - DNA, 569 bp, Homo sapiens
  misc_feature: GYAE6OF01B9LJA.22.20.B09.1.454.CMB.1.raw
  modified_base (196)..(196): a, c, t, g, unknown or other
  misc_feature (196)..(196): n is a, c, g, or t
tcagacatacgcgtcacgaccggtgctcgatttagtgtagtgtgaaggggagatctgctcagttaggacccagagggaaccatggaaaccccagcgcagcttctcttcctcctgctactctggctcccagatattactggagacgttgtcttgacgcagtctccaggcaccctgtcgctgtctccgagggggaaangccaccctctcgtgtaaggccagtcaagaatgttaacaacagatatgtagcctggtatcagcagagacctggccagtcctcccgttctcctcgttctttggtgcggccgacagggcccacgggcactccctgacagtattcagtggctaggtgggtccggtcagactatctgctcaccagtccggcggtctcggaacctgaagtattctgactacgtatattactgtctagtctttatgtttaacttctaccgttcgttcgtactacttcgtttcggaccgtaggggtaacctaaggcgttagggatacgtaacgaaacgtacgttggtacggcgtacgaccacctattcctagttccttctacgtttccccg

SEQ ID NO: 152976 - DNA, 577 bp, Homo sapiens
  misc_feature: GYAE6OF01B42N4.22.20.B09.1.454.CMB.1.raw
  modified_base (195)..(195): a, c, t, g, unknown or other
  misc_feature (195)..(195): n is a, c, g, or t
  modified_base (360)..(360): a, c, t, g, unknown or other
  misc_feature (360)..(360): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagngccaccctctcgtgtaaggccagtcagaatgttaacaacagatatgtagcctggtatcagcagagacctggccagtctcccgttctcctcgtctttggtgccggccgacgacgggccacggggcactcccctgacagacttcaggtggcaggtggggtccgggtnagactatctgctcaccagtccgggcggttctagggaacctgaagtattcgtgctaactatattactgtctagtctttatgtttaattctaccttccgttcgtactacttcgtttcggaccgtaacggggtacctaacggtcgtagggtacgtactacgaaaacgtacgtggtcggtcctcgaccacctattccgttgttcctttcgtactttccccg

SEQ ID NO: 152977 - DNA, 560 bp, Homo sapiens
  misc_feature: GYAE6OF01DJWEQ.22.20.B09.1.454.CMB.1.raw
  modified_base (195)..(195): a, c, t, g, unknown or other
  misc_feature (195)..(195): n is a, c, g, or t
  modified_base (354)..(354): a, c, t, g, unknown or other
  misc_feature (354)..(354): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagngccaccctctcgtgtaaggccagtcagaatgttaacaacagatatgtagcctggtatcagcagagacctggccagtcctcccgttctcctcgtctttggtgcggccgacgagggccacgggcatccctgacagattcagtggcaggtggggtccgggtnagactatctgcctcacagtcgggcggtctggaacctgaagtattctgctactatattactgtctagtctttattgtttaacttccaccttccgttcgtactactttcgtttcggaccgtaggggaccaaggtcgtagggaacgtacgtaccgaaaacggtaactggtacggctacggccaccgtattctgttccttctcttccccg

SEQ ID NO: 152978 - DNA, 612 bp, Homo sapiens
  misc_feature: GYAE6OF01A7S2E.22.20.B09.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
  modified_base (529)..(529): a, c, t, g, unknown or other
  misc_feature (529)..(529): n is a, c, g, or t
tcagacatacgcgtcacgaccggtgctcgatttagtgtagtgtgaaggggagagctgctcagttaggacccagagggaaccatggaaaccccagcgcagcttctccttcctcctgctactctggctcccagatattactggagacgttgtcttgacgcagtctccaggcaccctgtcgctgtctccaggggaangccaccctctcgtgtaaggccagtcagaatgtaacaacagatatgtagcctggtatcagcagagacctggcccagtcctcccgttctcctcgtctttggngccggccgacngggccacgggcatccctgacagtattcaggtggctaggtgggtccggtnaggtactatcgtgctcgacctagtccgggcgtctacggaacctggtaacgtcttcgtgactacgttattacgttactgtactagtcttttatcgtttaacttcctaacccgttccgttacgttacctacgtttcgtttacggaccgtacggggtaacccaaggtcgtagggtaanaacgttaaccgaaaacggtacgttggtacgggtccttacggacccaaccgtacttccgttacgttccttccaacgtttccccg

SEQ ID NO: 152979 - DNA, 747 bp, Homo sapiens
  misc_feature: GYAE6OF01DW6T9.22.20.B09.1.454.CMB.1.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
  modified_base (586)..(586): a, c, t, g, unknown or other
  misc_feature (586)..(586): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattacgtggagtacgttgtcttgacgcagtctccaggcaccctgtcgctgtctccgaagggaaancgccctaccctcgtcgtgtaacgccagtcaagatagtaacaanagatagtgtacgcctggtatcgagcgaagacgtaccgtcggacctacgtcccttcccgttcttccgttccgttcgttttcggcgccggccgacgtaccgggcccacgggtcactcccgtagaccagtacttcgagtggcgtacggttcgggtccgggtacaacggtacttacgtccgtcgtacgtaccaccgtacggttcccgggtacgggttctaacgggtaaccctaaggtaaggttctttaccgtctacttaacttaatttaacgttacgttagttaccgtaagtttaccttttaagttaccgttttaaacttcccgttaacccgttccgtttacgttaaccncgtttttacccggtacggacccggtaaggggtacccaacggttcgtacgggtaacgaaacccgttaaacgttaaaccgggtaacgttagggtaccgtacccgtcgtaacccctaccgttacgttccgtttaccgttaaccgttcttaacccgtttcccccg

SEQ ID NO: 152980 - DNA, 538 bp, Homo sapiens
  misc_feature: GYAE6OF01ES3VW.22.20.B09.1.454.CMB.1.raw
  modified_base (194)..(194): a, c, t, g, unknown or other
  misc_feature (194)..(194): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
tcagacatacgcgtcacgaccggtgctcgatttagtgtagtgtgaaggggagagctgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaccaacagaaacctggccaggctcccaggctcctcatctatgatgcatcttacacgggccactggcactcccagccaggttcagtggcaggtggtcgtgggacagacttcactctcacatcagcagcctagcgcctgaagtattttgactagtttacttacgtgttacacgtcaggtcgtagactacctccctcgtaccggttccggacggacgggaccgagggtaggagacgtacgaacgtacgtgtcggcgtcgcacctgtctgttcttctactccttcccnctntaccg

SEQ ID NO: 152981 - DNA, 743 bp, Homo sapiens
  misc_feature: GYAE6OF01CHLK8.22.20.B09.1.454.CMB.1.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (375)..(375): a, c, t, g, unknown or other
  misc_feature (375)..(375): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaaggggaanacgccacctctcgtgtaacggccagtcaagaatgttaaacaacagatatgtagctggtancagcagacgacctggccagttcctcccgttctcccttcgttcgtttggtcgccggccgacgacgggccacgggcactccctgacagtcttcgaggtgacgtaggttcggggtaccgggtnaacggtacttagtcgtcgaccttaccgaccgtacggtccggggtaccggttcgtaacgggtaaacccgttaggaaacgttacgtttacgtacggtaaccttaaacttaaagtttaacgtttaacgttacgggtttaacctaaggtttaaccgtttttaagtttacgtttttaaacttccctaacccgttttccggttaacgttaacctacggttttccgttttaccgggaccggttaacgggggaaccttaagggcggttaacggtaacgtaacgttaaccgtaaaaaccggtacggttacggtacgggtaccgtcgaacccgaccttaacgtaccctttgttacctttacccgtaacgtttcccccg

SEQ ID NO: 152982 - DNA, 706 bp, Homo sapiens
  misc_feature: GYAE6OF01CILCF.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaanagccaccctctcgtgtaaggccagtcagaatgtaacaacagatatgtagcctggtatcagcagagacctggccagtcctcccgttctccttcgtctttgggtcgccggccgacgacgggcccacggggctaactccccgtagaccagtactttcgaggtcggacctaggttcgggggtacccgggtacaggtaccttagttccttacggccttaccgaccctaggttcccgggtacgggttccgtaacggggtaaccccttaggtaaacggttaactttccgttaggaccctaacgtttaactttaactttaccgtagttacctaacggttactttttaagttacgttttaaactttacctaacccgtttccgttaccgttaacgttactttcgtttacgggaccgtacggggtaaccacggtacgtacgggtagtaacgtaaccgaaacgtaccgttaggtcggtcttacgaccctaccgtacttccgtacgtttcttccgtcttccccg

SEQ ID NO: 152983 - DNA, 538 bp, Homo sapiens
  misc_feature: GYAE6OF01DLQBQ.22.20.B09.1.454.CMB.1.raw
  modified_base (194)..(194): a, c, t, g, unknown or other
  misc_feature (194)..(194): n is a, c, g, or t
  modified_base (251)..(252): a, c, t, g, unknown or other
  misc_feature (251)..(252): n is a, c, g, or t
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
  modified_base (519)..(519): a, c, t, g, unknown or other
  misc_feature (519)..(519): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaangccaccctctcgtgtaaggccagtcagaatgttaacaacagatatgtagcctggtannagcagagacctggccagtctcccgttctcctcgtctttggtgcggccgacgagggccacgggcatccctgacagattcgagtggcaggtcgggtccgggtnaggactatctgctcacatcggcgtctggaacctgagtnttcgtgctatatattacgtgtcagtctttatacgtttaattccaccgtttccgtacgttactactttcgtttcggaccgtacgggaccagtcgtagagactacgaaacgtagtgtggtctgccaactntctgttctcgtattccccg

SEQ ID NO: 152984 - DNA, 952 bp, Homo sapiens
  misc_feature: GYAE6OF01E11KW.22.20.B09.1.454.CMB.1.raw
  modified_base (196)..(196): a, c, t, g, unknown or other
  misc_feature (196)..(196): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgtttgtcttgacgcagtctccaggcaccctgtcgctgtctccgaggggaaangccacctctcgtgtaagccagtcagaatgttaacaacagatatgtagcctggtatcagcagagacctggccagtcctcccgttctcctcgttctttgggtcgccggccgacgacggggcccgacgggccacgtcccctgaccgagtacttcgaggtcgggccgtagggttcgggggtcccggggtacaaggtacctttaagttccgttacggaccctttaccccgaaacccgtaacggtttcccgggggacccgggtttacccggttaaccgggggttaaaccccgttagggtaaaaacggttacgtttttacccgttacgggtaacccttaaaaccgtttaaactttaaacgttttttaaccgttcggtttacccgttaaacggttttaccttttttttaaacgttttaaccggttttttaaaacctttttaccccccgttaacccccgtttttacccccgggtttaacccgttttaaaccgttaaccggttttttaccccgggtttttaccgggggtaacccccgggttaaaaccggggggggttaacccctaaacgggttccccgggtttaaaggggtaaccggttaaacgttaaaccccgtaaaaaaacccgggggttaaaccgttttcgggggttaaccgggttacccgtttaccgggtaacccccgtaaaacccccgtttaacggtttaccccggttttaaccggttttccccggtttttaacccctaacccggtttttcccccccccgg

SEQ ID NO: 152985 - DNA, 538 bp, Homo sapiens
  misc_feature: GYAE6OF01EEI1G.22.20.B09.1.454.CMB.1.raw
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccacctctcgtgtaaggccagtcagaatgttaacaacagatatgtagcctggtatcagcagagactgccagtctccgtctctcgtctttggtgcggccgacgagggccacggggcactccctgacagattcagtggcgagtgggtccgggtcagactatctgctcacagtcggngtctggacctgaagnttntgcactatattactgtcagtctttatgtttaattcaccttcgtcgtactattcgttggaccgaggggaccaacggtctaggagactacgtaaaacgtacgtggtacggtcgtcgacctacccgtacttcgtagttcttctacgttccccg

SEQ ID NO: 152986 - DNA, 538 bp, Homo sapiens
  misc_feature: GYAE6OF01A28O7.22.20.B09.1.454.CMB.1.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (453)..(453): a, c, t, g, unknown or other
  misc_feature (453)..(453): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
  modified_base (530)..(530): a, c, t, g, unknown or other
  misc_feature (530)..(530): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaangccaccctctcgtgtaaggccagtcagaatgttaacaacagatatgtagcctggtatcagcagagacctggccagtcctcccgttctcctcgttctttggngccggccgacgagggccacgggcactccctgacagtattcgaggtggcaggtcggggtccggtnagactatctgctcaccngtccggcgtctggaacctgaagtcttctgctactatattactgtctagtctttatgttaacttcacctcgtctactnttcgtttcggccgtagggaccagcgtaggatacgtacgaaacgtactggtggtctcgacacctnttactnttccttntcgttccc

SEQ ID NO: 152987 - DNA, 617 bp, Homo sapiens
  misc_feature: GYAE6OF01CMPEU.22.20.B09.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaagngccaccctctcgtgtaaggccagtcagaatgttaaacanagatatgtagcctggtatcagcagacgacctggccagtcctcccgttctccttcgtctttgggtgccggccgacgacgggcccacgggccactccctagacagattcgaggtgctaggtcgggtccggtnagactatctgctcacngtcggcgtctacggaactgaagtcttntcgactactattacttacngtactagttctttatacgtttaattcctaccgttcgtacgttactacgtttccgtttcgggaccgtaacggggacctaggtacgtagggaacgtacgtaaccgtaaaacggtaccgttagggtaccggtccgtacggtacccaacccgttacgttccgttagtttaccctttcgttaccctttcccccgg

SEQ ID NO: 152988 - DNA, 662 bp, Homo sapiens
  misc_feature: GYAE6OF01B38FZ.22.20.B09.1.454.CMB.1.raw
  modified_base (207)..(207): a, c, t, g, unknown or other
  misc_feature (207)..(207): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
  modified_base (483)..(483): a, c, t, g, unknown or other
  misc_feature (483)..(483): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggcctcccagattattacgtggagacgtttgtcttgacgcagtcctccgaggccacccgtgtcgctcgtcctccggaaggggaaancgcccacccttctcgttagtaacgtccagtcaagtaatacgttaaacaacagtatatggttacgccgttaggtactacacggacaaggacgaccgttcggaccgtaacggtcctttccccgttccttcccgtcggttacgtttggcgtccggaccgacggaccgggccgacgggcctactcccngaaccagtcttcgagtggacgtacgggtcggtccggtanacgtctatcgcgctcaacgtcgtacggcggtactacggacgtagaagtgttcncgactattactactttctagtactacgttactttagttagtttaactacctacccgttcgttactacgttcgttccgtttacggaccggtacggtaacctacggtacgtacggagtaacgtaacgaacgtcggttcgagtccgtcgacctacgtactcgtacttactcctccgtacccg

SEQ ID NO: 152989 - DNA, 745 bp, Homo sapiens
  misc_feature: GYAE6OF01AGBP4.22.20.B09.1.454.CMB.1.raw
  modified_base (195)..(195): a, c, t, g, unknown or other
  misc_feature (195)..(195): n is a, c, g, or t
  modified_base (376)..(376): a, c, t, g, unknown or other
  misc_feature (376)..(376): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaangcccaccctctcgtgtaacggccagtcagaatgttaacaacagatatgtacgcctggtatcgagcagagcctggccagtcctcccgttctcctcgttctttggtgtcggccgacgtacgggcccacggggtcacgtccctgacagtacttacgaggtcggctaggtcggggtcccgggtanacggtactagtcctaggccttacaccgtacggtccgggtccggttaccgtacggggtaacccgtaggtaaacgttacgtttccgtacggtaccctaaacgtttaagttacgttttaaccgttcggttaccctaacggtttaaccgttttttagttaccgttttaaacgtttccccgttaacccgtttcccggtttaccgtttaaccttacggttttaccgttttacggggacccggttaaccgggggtaaccacggtcgttaacggggaattaaccgtaaaccgaaaacggtaccgtagggttcggtaccgttaccgaccgtaacccgttaacgtttcctacggttttccttactccgtttacccccgg

SEQ ID NO: 152990 - DNA, 654 bp, Homo sapiens
  misc_feature: GYAE6OF01ACDC6.22.20.B09.1.454.CMB.1.raw
  modified_base (197)..(197): a, c, t, g, unknown or other
  misc_feature (197)..(197): n is a, c, g, or t
  modified_base (632)..(632): a, c, t, g, unknown or other
  misc_feature (632)..(632): n is a, c, g, or t
  modified_base (645)..(645): a, c, t, g, unknown or other
  misc_feature (645)..(645): n is a, c, g, or t
tcagacatacgcgtcacgaccggtgctcgatttagtgtagtgtgaaggggagagctgctcagttaggacccagacggaaccatggaaaccccagcgcagcttctcttcctcctgcctactctggctcccagatattactggagacgtttgtcttgacgcagtctccaggcaccctgtcgctgtctccgaggggaaancgcccaccctctcgtgtaaggccagtcaagtaatgttaaacaacagatatgtagccttggatcgagcagacgacctggaccagtcctcccgttctccgtcgttctttaggcgccggaccgacgacgggcccgaacgggcactccctgaacaggtacttcgagtggctaggtcgggtccggtcagtacttagtccgtggccttaccgaaccgtacgtccgggtaccgggttaccgtacggaaccgttgaaacggttactttaccgtggaccctaacttacgttaacgttaccttagtaccgtagttaccgttttaagtacgtttaactccgtacccgttaccgtcgttaaacgtctttacggttaccggaccgtaacggggtacccaaggtccgtaggacgtaacttaccgaaaacgtgtaacgtggctacgaccnctatcttgtcttntacttcccg

SEQ ID NO: 152991 - DNA, 794 bp, Homo sapiens
  misc_feature: GYAE6OF01B93TB.22.20.B09.1.454.CMB.1.raw
  modified_base (110)..(110): a, c, t, g, unknown or other
  misc_feature (110)..(110): n is a, c, g, or t
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
  modified_base (436)..(436): a, c, t, g, unknown or other
  misc_feature (436)..(436): n is a, c, g, or t
tcagacatacgcgtcacgaccggtgctcgatttagtgtagtgtgaaggggagagctgctcagttaggacccagagggaaccatggaaaccccagcgcagcttctctttcncctgctactctggctccagatattactggagacgttgtcttgacgcagtctccaggcaccctgtcgctgtcctccgaaggggaaanacgccctaccctcgtcggtaggtaacggcccagtaccaaggtaaacttaggttaaaaccaanaggaattaagtgtaacggccgttaggtatcgaaggcaaggacgtacctggacctacggttccctcccgttctccgttcggttcgtttcgggcgccggacccgaacggacgggcccgaacgggctacttcccgagaaccaggtacttcagggtcggtcgtagggttcggggtccggtanaacggtactacgtcgcgtccttaccgacgtacggtcgggaccggttactacggtaaaccgtaggtaacgttacttaccgacgtaacttaacgttaacttaacgttacgtaggttacctaagtttaccgttttaagttacgttttaaaccgttcctaacccgttccggttaacttaccgttagtttacccgtttacgggaacccgtaacggggtaaccctaaggacccggtttaagggaaccgtaacgtttaaaccggaaaacgggtaccgttaggggtacccggtaccttaccgggtaacccctaaccgtttaccgttacgtttacccgttacccttaccgttaccgtttacccccgg

SEQ ID NO: 152992 - DNA, 689 bp, Homo sapiens
  misc_feature: GYAE6OF01CS75L.22.20.B09.1.454.CMB.1.raw
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaaggggaaagcgcccaccctctcgtgtaaggccagtacaagaatgttaaacaacagatatgtagcctggtatcagcaagacgacctggcccagttcctcccgttctcctcgttcgtttggtcggccggccgacgacgggccgaccgggcactcccgtagacgagtattcgagtggcgtaggtcggggtccgggtcgaacgtactagtccgtcgcctacgtaccgacgtcggtaccggtacgttacgggtaaccgtagaacgttacgttccgtcgtacgtacttaacttaacttacgtagttacttagttacttttaacgtttacgttttaaacgttccctacccgtttaccgttaccgttaacttacgtttccgtttacgggacccggtaacgggaaccgtaggtacgtaggtaacgtaacttaacgaaaccggtaacgttcggttagccgtaccgtaccgtaaccgtacgttcgttacgttccttacgtcccgtttaccccg

SEQ ID NO: 152993 - DNA, 734 bp, Homo sapiens
  misc_feature: GYAE6OF01DZJK8.22.20.B09.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (238)..(238): a, c, t, g, unknown or other
  misc_feature (238)..(238): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaancgccaccctntcgtagtaacggccagtcagaatgtaaacaacngatatgtacgccgtaggtactcagcaaggacgaccgtggccagtctcccgttctcctcgtctttggcgcggcgacgcgggccgacgggcactcccagacagtacttacgagtcggcgtaggtcggggtccggtacgagtactagtctcggtctaccgacctaggtcccgggtcggttacgttacgggtaaacccgtaggtaacgttaacgtttccgtacggtacccttaacctttaagttaaacgttttaccgtttacgttaacgttacgtttaaccgtttttagtttacgttttaaacgtttccccttaacccgtttcccggttaacgtttacctaacgttttaccgtttaccgtaacccgggtaacgggtaaccctaagggttccgtaaggaacgttacgttaaaccgaaaaccggttacgttcggttacgggacccgttacgacccaaacgtttacgttaccgttgttacccgtttacgtccgtttacccccg

SEQ ID NO: 152994 - DNA, 704 bp, Homo sapiens
  misc_feature: GYAE6OF01B0RX8.22.20.B09.1.454.CMB.1.raw
  modified_base (199)..(199): a, c, t, g, unknown or other
  misc_feature (199)..(199): n is a, c, g, or t
  modified_base (479)..(479): a, c, t, g, unknown or other
  misc_feature (479)..(479): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctccagatattactggagacgttgtcttgacgcagtctccaggccaccctgtcgcttgtcctaccgaaggggaaanacgccctacccgtcgtcggtggtaaacggccaagtcaagaaattcgttaaacaacgagataagtgtacgccttggtatcagcagagacctggccagtcctcccgttctccttcgtctttgggtcgtcgggacccgacgacggggcccacggggcacgtcccctgaaccaggtacttcaggtggcgtaggttcggggtcccggtacaggtacttacttccgtgccgttacaaccgtacgtccgggccggttcgttacgggaaccctaggaaacgtctttcngcctaacgttattatttaacgtggttctacgttacttttatacgttttaaacttcctacccgtttacggtcgttaactacgtttccgtttacggaccggtaacgggtaccaacggttcgtagggtaagtaaacttaaccggaaaacggtaccgttagggttccggacttacgggaccctaaccgtactttacttccggtttacttcccgtaacgtttccccccgg

SEQ ID NO: 152995 - DNA, 806 bp, Homo sapiens
  misc_feature: GYAE6OF01BA8ZF.22.20.B09.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (396)..(396): a, c, t, g, unknown or other
  misc_feature (396)..(396): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggccaccctgtcgctgtctccgaggggaaancgcctaccctctcgtgtaaggccagtcagaatgttaacaacagatatgtagcctggtatcagcagagacctggccagtctcccgttcncctacgttcttttcgggcgacggtcccgacgacggggcccacggggcaacgttcccctagaacgaggtaactttcgaaggtcggacgtacggttcgggggtacccgggtaanacgtacgtacgtcgtacggtacctccgaaccgtaggtccgggttacggttaccgttaaccgggtaaccgttaacggtaaacggttcgttttaccgtaacggtacgtaaaccgtttaacttaacgtttaaccgttacggttaaccgttaacgtttacctttttaagtttacgttttaaaccgtttacccgtaaccccgtttcccggtttaaccgtttaccgtttaccgtttaccgggtttacccgggaacccgggttaaacgggtaacccgtaacggttaccggttaacggtaacgtaaaccgtaaaccgtaaaaccgggttaacggtttgggtacccggtacgttaccggtaacccgtaacccgttacgttacccgtttacgtttccctttaccgtacccgtttcccccg

SEQ ID NO: 152996 - DNA, 629 bp, Homo sapiens
  misc_feature: GYAE6OF01C7984.22.20.B09.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (464)..(464): a, c, t, g, unknown or other
  misc_feature (464)..(464): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggccaccctgtcgctgtctcgaaggggaaancgcccaccctntcgtggtaaggccagtcaagaatgtaaacacagatatgtancctggtatcagcagacgacctcggccagttcctccgttctccgtcgttcgtttggcggccggtccgacgacgggcccacgggctactcccgtagactagtacttacgagtcggcgtagggtcggggtccggtacaggtactatcgtcgcctcaaccgtgtccggtacgttcgtacggaacgtagaacgtacttcgacgtactattataacttcgtntactgttacttttagtacgtttactcctaccgttccgtaactacttactttcggttccggaccggtaacggtacctaggcgttaaggaataccgtaacaaacggtacgtggtacggcctacgtacccacttaccgttgttaccgttcttaccgttcttacccccg

SEQ ID NO: 152997 - DNA, 830 bp, Homo sapiens
  misc_feature: GYAE6OF01EU3WS.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctccagatattactggagtacgttgtcttgacgcagtctccaggcaccctgtcgctgtctccgaggggaaancgcccaccctctcctgcacgggccagtcagtagtattagcaacacttagcctaggtaccagcagacgacctggaccaggcctcccgaggtcctcctcatcttagtgttcgctactccgagccgacggggcccacgttaccggtacccccaggtccctagggtttcaaggttcggacgtagggttcggggtcgtaggggactaggtacgtttcctaacgttccctaccaaccctagttaccgacggcctaacggtcccttacggaccgtaaggtttcccgtaaggtaaaaccggtttagttttttacggaaccgttttaaggtttttaaccgtttaacgtttcggttaccgtaaggttaccgttaaaaggttttaactttaaaccggttttaccggtaccggggttacccccggtttaccggggggttaacccggtttacccgggggtaaacccccggtaaaaggggggtaaaccccgttaaaaggggggtccgggttaaaaaaccggtttaaccgggaaaaaacccggttacggttacgggggttaggggtaccctaacgggtacccctaaccgttaacgttcccggtttacggtttaccctttaccgtaaccgtttccccgtttaaccccccgg

SEQ ID NO: 152998 - DNA, 715 bp, Homo sapiens
  misc_feature: GYAE6OF01A26WL.22.20.B09.1.454.CMB.1.raw
  modified_base (196)..(196): a, c, t, g, unknown or other
  misc_feature (196)..(196): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctgctcccagatattactggagacgttgtcttgacgcagtctccaggcaccctgtcgctgtcctccgaggggaaacncgcccacccttcgtcgtagtaacggcctagtcagaattgttaaacaacgagatatgtagcctggtatcagcaagacgacctggcctagtccttcccgttactccgttcgttcgtttgggcgccggccgacgacgggcccacgggcctactcccgtgacctagtcttacgaggtcggacgtaggtcggggtacccgggtataacgtaccttagtccgtgacccttaccgaacccgtaggtcccgggtaccggttacgtacggtaacccgttaggaacgttacgtttcgtacgtaacctaacttaagttaacttaccgtcgtactagtttacctttagttacgttaactttccctaaccgtttccgtaacgttacctacgtttcccgttacgggaccgtaacggggaacctacggtcgttacgggaataccgtaaaccgtaaacggtacgttcgggttacggtacctacggaccctaacgttactttaccgttacgtttcccttaccgtcgtttacccccg

SEQ ID NO: 152999 - DNA, 608 bp, Homo sapiens
  misc_feature: GYAE6OF01EF65O.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaangccaccctctcgtgtaaggccagtcagaatgttaaacaacagatatgtagcctggtatcagcagagacctggccagtctcccgttctcctcgtctttggtgcggccgacgacgggccacgggcactccctgacagtattcgagtggcgtaggtcgggtccgggtcagactatcgtgctcaccagtcggtcgtcgtaggaacctgaagtattctgactactattacttactgtacagttactttagtagtttaacttcctaccgttccgttacgttaactacgttccgtttacggaccgtaaggggtacccaaggtcgtagggaactaacgtaaccgaaaacggtacgttaggtacggtcttacggaccctaaccgtagtttcccgttaggtttcccttacgtacgtttccccg

SEQ ID NO: 153000 - DNA, 753 bp, Homo sapiens
  misc_feature: GYAE6OF01DKHKS.22.20.B09.1.454.CMB.1.raw
  modified_base (179)..(179): a, c, t, g, unknown or other
  misc_feature (179)..(179): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctgctcccagatattactgggagtacgttgtcttgacgcagtctccaggccaccctgtcnctcgtctccgaaggggaagcgccaccctctcgtcggtaacggccagtacagtaattgtaacgacaaactaacttacgtcgtacggtaaccagcaagacgacccgtaggccacggcctcccgaggtcctcctactatctagtggttcgtcttacgtaccgcggacctcgttacggtacctccccgacgtacggtcacggtcgccgtaggtgggtacgtgggaactacgtacggttacacgtttcacctaacctcgtacaccgaccgtaccgtacccgtcggaccgttaccggttacgttaaggttaaacgttttaacgtttttcggttaaccttttaaccgttttttaagtaacccgtttcgggtaactaacggtaaccttaaaatttaacgtttaaacgttaccgtacgttttaccggtttccgtaacgttaccctccgttaacccggtaccggaaccggtaaacggggcctaacggtaaggtaccggtaaattaaacggtaaacgttaccggtgtacggttcacgaacccgtcttaacggttcttacgtttcctttaaccgccctttacccgg

SEQ ID NO: 153001 - DNA, 744 bp, Homo sapiens
  misc_feature: GYAE6OF01EN0OX.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaancgcccaccctctcgtgtaacggccagtcagaatgttaacaacagatatgtagcctggtatcagcagagacctggccagtccttcccgttctcctcgttcttttgggcgccgggccgacgacggggcccgacgggcactccccgtgacctagtacttcaggttcggcgtaggtcggggtccgggtcaaggtacctatccgtgccttaccaccgtaggtccgggtcggttccgtacgggtaaccctggaaacgtactttccgtacggtacctaacttaacttaactttaccgttacggttactaacgtttacctttttaaacgttagtttttaacctttacccttaacccgtttcccggttaccttaaccgttacgtttacggttttccggggacccgtaacggggggtaaccctaaggtccggttagggtaaaccgttaacctaaaccgggaaaacccgttaacggtttgggtacgggtcccttacgggtaacccctaacccgttaatttccccgttccggtttacctttacctacccgtttaccccccg

SEQ ID NO: 153002 - DNA, 572 bp, Homo sapiens
  misc_feature: GYAE6OF01DLGZ1.22.20.B09.1.454.CMB.1.raw
  modified_base (142)..(142): a, c, t, g, unknown or other
  misc_feature (142)..(142): n is a, c, g, or t
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactgganacgtttgtcttgacgcagtctccaggcaccctgtcgctgtctccgaggggaaancgccacctntcgtgtaacggccagtcagtaatgttaaacacgagntatgagcctggtatcagcaagngacctggcctagtcctcccgttctctcgttctttggtggccgccgacgacgggccacgggcacgtcccgtagacagtctcgagttggctaggtcgggtcgggtacagtacttatcngtactcaccngtcggcgtcgtacggaacctgaagttnttcngtacctagtataattcgtgtctagttcttatgtttactcacttcggtctactagttcgttcgaccggtaacggtcgacgtacgtaggataaccgtacgaaacggtaacgtgttaggccttacgaccactcgttcttcttcttccgattcccg

SEQ ID NO: 153003 - DNA, 742 bp, Homo sapiens
  misc_feature: GYAE6OF01BB8YS.22.20.B09.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (448)..(448): a, c, t, g, unknown or other
  misc_feature (448)..(448): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggcctcccagtatattactggagacgttgtcttgacgctagtcctccgaggccaccctgtcnctcgtcctccgaaggggaaanacgcccacctcgtcgtaggtaacgccagtcaacgtaattacggttaaacaacagaacttatgtagcctggtactcagcaggacgtacccgtggcctacgttccttcccgttctaccgttcgttcgttttgggcgccggtccgacgtacggggacccgacgggtacctaccgtcccctagaacgtacgtacttccgaggtcggaccgtagggttccggggtccgggtacaggtactacgtcgtcncttaccaccgtagtcccgggtcggtacgtaggtaacccgtagtaaccgttacttcgtactacctaactttacttactttacgtcgttacgttactttacgttttagttaacgttttaaccgttccttaacccgttccggttaaccctacgttaccgttaccggtttaccggtaccggtaaccgggaaccgtacgtacgtaacggacgtaataaacccgtaaacgtggtacgttaggtcaccggtaacctacccgttactttccgttaagtttcccgtaaccttcgttacccccg

SEQ ID NO: 153004 - DNA, 714 bp, Homo sapiens
  misc_feature: GYAE6OF01BML7H.22.20.B09.1.454.CMB.1.raw
  modified_base (194)..(194): a, c, t, g, unknown or other
  misc_feature (194)..(194): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctcaggcaccctgtcgctgtctccgaggggaagngccacctctcgtagtaaggccagtcagtaatgttaacaacagatagtgtacgctaggtactcgagcaagacgacctggccacgttcctcccgttctccttcgttcgtttggtggccgggccgtaacgacggggcccgacggggtcctacgtccccgtgaaccgaggtacttccgaaggttcggaccgtagggtcggggtcccgggtacaacggtactacgtcgttacggcctaccgaccgtaggtccgggcggtttaccgagggtaaccgtaggaacttacgtttcctacgactaacttaagtttaacttactacgttacttacgttacctttttagtaacttttaacctcctaaccctttccggtactacgttaacgttccgtttacgggccgtaacgggtacctaaggtcggttacggagtaacgtaaccggtaaaacgtcggttggtacgggttcctagtaccccgtaaacttacgttccggttccgtttacccttacgtttacccggttccccccg

SEQ ID NO: 153005 - DNA, 616 bp, Homo sapiens
  misc_feature: GYAE6OF01EVHO7.22.20.B09.1.454.CMB.1.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagtacgttgtcttgacgcagtctccaggcaccctgcgctgtctccgagggaaancgccaccctgtcgtgtaaggccagtcagaatgttaacaacagatatgtagcctggtatctagcagtagacctggcctagtctccgttctcctcgtcgtttggngcggtccgacgtacgggccacgggcactcccgtgacagtattcgaggtcggngtacggtcggggtccgggtacacgtactagttcctggacctaccaaccgtagtccgggtccggttccgtacggtaacccgtagtaaacgtacttactacgactaacgtattacttacgtagtacgtagtactttattagtttaacttcctacctccgtacgttactcttcgtttacggacgtagggaaccgtagtcgtagacgtaactacgtaaacgtacgtaggtcgtcgtgacctacgtactgttaccttcttcgtacttccccg

SEQ ID NO: 153006 - DNA, 672 bp, Homo sapiens
  misc_feature: GYAE6OF01CQM78.22.20.B09.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
tcagacatacgcgtcacgaccggtgctcgatttagtgtagtgtgaaggggagagctgctcagttaggacccagagggaaccatggaaacccagcgcagcttctcttcctcctgctactctggctcccagatattactggagacgttgtcttgacgcagtctccaggcaccctgtcgctgtctaccgagggggaaangcccaccctctcgtgtaaggccagtcagaatgttaaacaanagattatgtanctggtatcagcaagagacctggccagtcctcccgttctcctcgtcttggtgcgcgacngggccacgggcacgtccctgaacagattcgagtggctaggtcggggtccgggtanagtactatctcgctcacgagtcgggcgtactcgggaaaccttggaagtactttcgacgactaacgttaatacgtttacctggtactaagttcttttaagttagtttaaacttccctaacccgtttccgttaacgtaaccttacgtttccggtttacgggacccgtaacggggtaacccaggtaccgttaaggggaaactaacgttaaaccgaaaaaccggttaacgttgggttacgggtaccctacggtaccctaaaccccgttagtttaccgttaccggtttacctttacccgtaaacgttttccccccg

SEQ ID NO: 153007 - DNA, 783 bp, Homo sapiens
  misc_feature: GYAE6OF01DKUMW.22.20.B09.1.454.CMB.1.raw
  modified_base (197)..(197): a, c, t, g, unknown or other
  misc_feature (197)..(197): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggcctcccagatattacgtggagacgttgtcttgacgcagtctccaggcaccctgtcgctgtcctcgaggggaaancgccacctctcgtgtaacggccagtcaagaatcgttaaacacagataatgtagcctaggtactcgagacgacgagtacctaggccagttcctcccggttccttcccttcgttcgttttgggtacggtccggtacccggaaccgacggggccccgaacggggccctaacgtccccgtagtaacgagtacgttaccaagggttcggtacctaacgggtcggggtacccggggtactaacggtaccgtaagtttctacgggtcctaccgaaccgtacggtccgggtcgggtaccgtacgggtaacccgttaaggaaccgttacgtttacgtacggttaaccctaagttaacgttaacgtttacgttaccgggttaccgttaaggtttcttttaaacgtttaagtttttaaccttacccttaccgtttaccgttaccgtacgttaacttccgttttacgggaccggtaacggtaccgacggtacgtacggtaacgaacgtaacggtaaaacccgtaggttacggtacggtaccctcggtaccgtaacccgttacgttaacttcgggttacctttaccggtcttaccccgg

SEQ ID NO: 153008 - DNA, 710 bp, Homo sapiens
  misc_feature: GYAE6OF01ANILT.22.20.B09.1.454.CMB.1.raw
  modified_base (202)..(202): a, c, t, g, unknown or other
  misc_feature (202)..(202): n is a, c, g, or t
  modified_base (508)..(508): a, c, t, g, unknown or other
  misc_feature (508)..(508): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggcctcccagatattactggagacgttgtcttgacgctagtcctccgaggccaccctgtcgctgtcctccgaaggggaaancgcccaccctctcgtaggtaacggccagtcagtaatacgtaaacacagatatgtagctgtatcagcagacgacctggacctagtcctcccgttctccgtcgttcgtttgggcgccggccacgcggcccgacgggccactccccgtagaccagtacttcgacggttcggccaggggttccggggttacccgggtacaaggtaccttagtccgtcgccctaccgacccgtaggttcccgggtcggttacgacggtaacccgttaggaaacgttctttccgtagacccttaacgttattacgtttaccngttaccgttaagtttacgtttttagttaccttttaacctttcccacccgtttaccgttacgttaccttacgtttcccgttacgggacccggtaaggtaacccgtagtccggaaggtacgtaaccgtaaccgaaaacgtacgttcgggtcggtccctacgaccttaccgtcgttcttacccgttccttacctcccgttacccg

SEQ ID NO: 153009 - DNA, 878 bp, Homo sapiens
  misc_feature: GYAE6OF01D9A71.22.20.B09.1.454.CMB.1.raw
  modified_base (505)..(505): a, c, t, g, unknown or other
  misc_feature (505)..(505): n is a, c, g, or t
tcagacatacgcgtcacgaccggtgctcgatttagtgtagtgtgaaggggagagctgctcagttaggacccagagggaaccatcggaaaccccagcgcagcttctcttcctcctgctactctggcctccagatattacgtggagtacgtttgtcttgaccgctacgtcctccgaggccacccgttgtccgcttcgtccgtaccggaaggggaaagcgcccacccttcgtcggtaggtaacggccagtacaagtaattacgtaacaacgagtaagttatggtacgtccgttaggtactacgagacaggaccgtaccgtcggaccttacgttcccgttcccggttcttcccgttcggtttccgtttcggggccggccggtacccggaacgggtaccggggcccggtaaccggtccttacccgtacccgtagtaaacgtaggtaccttacggagggtcgggacggtacggggtccggggttaccgggtacaaggtacttgtccgtacnccgttaccacggtacggttccggtaccggttacgtaaccggtaaccgttaaggtaacgttaccgtttaccggaacgtaaccttaacgttaaacgtttacgtttaaccggttcgtttaccgttaagttttaccgtttttaaggttaacccgtttttaacgttaccccgttaaccccgttacccgttttaacgttaacgttaccgtttccgggtttaaccggggaacccggtaacggggttaaaccctaggtaccgtaacgggtaacttaaaccggttaaaacccgtaaggtaccggttggttacccggtctaacccgtaccttaaccgttaccgtttcggttaactttcccgttaacccgttcccgttcccccg

SEQ ID NO: 153010 - DNA, 803 bp, Homo sapiens
  misc_feature: GYAE6OF01AT0KE.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaancgccaccctctcgtgtaaggccagtcagaatgttaacacagatatgtagcctggtatcagcagagacctggaccagtcctcccgttctccttcgttctttcggtggccggtccgactacgggacccgacggggcacgtccctaggactaagactttcgaaggtcggacgtacggtggggtcccgggtacaacggtactatcgtaggtccttaccgaaccgtacgttccggggacggttacccgtaggggtaaaccccttgggtaaaacgttaaccgttttcgtacgtaccccgtaaactttaacgtttaacgttttaaacctttcgggtaccgttaacggtttaccgttttttaacgtaacggttttttaaacctttacccccgtaaccccgttttaccgggttacccgtttaacgtaccggtttttacccggtttacggggtaccccggttaaacggggggttaaccccaacgggttaccggtttgggtaaaccgtaaccgttaaccgtaaaaaccggttacggtttcgggtaccggtcccgttaacgacccgtttaacccctaagttacccgttagtttaccttttcccgtaaacgtttcccccgg

SEQ ID NO: 153011 - DNA, 607 bp, Homo sapiens
  misc_feature: GYAE6OF01BI1I3.22.20.B09.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgtttgtcttgacgcagtctccaggccaccctgtcgctgtctccgaggggaaangcccacctntcgngtaacggccagtcaagaatcgttaacaacagatatggtagcctaggtatcagcagagacctggccagtccttcccgttctccttcgttcgtttggtgccggtccgacgacgggcccgacgggctacgtccctgacagtattcgagtgcgaggtcggggtcgtcagtactatctcgctacacncgtcggcgtctggaacctagacgtacttcgnactatattactactgtactagtctttatacgtttatccgtaccgtcgttactacttagttcggtttacggacccggtagggacctaacggtcgtaacggagtaactaacccggtaaagtaccgttgggacggtctaccggtactaaccgtacttcgttactttccttccgttaccgttccccgg

SEQ ID NO: 153012 - DNA, 869 bp, Homo sapiens
  misc_feature: GYAE6OF01B07PM.22.20.B09.1.454.CMB.1.raw
  modified_base (197)..(197): a, c, t, g, unknown or other
  misc_feature (197)..(197): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtccgctgtctccgaaggggaaancgcccaccctctcgtgtaagccagtcaagtaatagttaaacaacagatatgtagcctggtactcagcgagacgtacctggcctagttccctcccgttccttcccgttcgttcgtttcgggtcggccgggtacccgacggacggggcccgacggggccctaacgttcccctaggaacaggtacgttaccgaggtcggaccgtacgggttcgggggtacccgggtacgacggtaacttacgtcgttcgcctacctacccggtagttcccggggtaccgggtttaccgttacggggtaaaccccgttagggaaacgttacgtttacccggtacgtaaccctaaaccgttttaacgtttaacttttaaccgttaccggttacgttaacggtttaccttttttaagtttaaccggtttttaaacccttttccccgtaaccccgttttacccggtttaccgttaaacccgtttaccggtttacccggttttaccggggaacccgggttaacccgggggtaaccctaacgggttccggtaagggttaaacctaaacgttaaaccccggtaaaacggttaaccggttacggggtaccggttcgtacccggtaccctaaacccggttacgtttacccggtttcgtttaacccttttcccgtaaaccccgttttcccccggg

SEQ ID NO: 153013 - DNA, 657 bp, Homo sapiens
  misc_feature: GYAE6OF01A4VVF.22.20.B09.1.454.CMB.1.raw
  modified_base (183)..(183): a, c, t, g, unknown or other
  misc_feature (183)..(183): n is a, c, g, or t
  modified_base (195)..(195): a, c, t, g, unknown or other
  misc_feature (195)..(195): n is a, c, g, or t
  modified_base (467)..(467): a, c, t, g, unknown or other
  misc_feature (467)..(467): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtcnccgaggggaaancgcccaccctctcgtgtaaggccagtcagaatagtaaacaacagatatgtagctggtaatcagcagagacctggccagtcctcccgttctccttcgttcgtttggtcgccggaccgacgacgggcccgacgggccacgtcccgtgacagtacttcgaggtggtccgtaggtcggggtaccgggtacgaagtactagtcgtcgcctacgaccgtacgtcgggcggttccgacgggtacctaggaagtccttcgtgacctaatattattacgtntacgtacgtcttttattagttaactttcctaccgttccgttacgtaaccttagttccgtttacgggaccgtaacggggtaacctaggtaccgtagggacgtaactaaacccgaaacgtaccgttgggaccggtcgtacctacctacccgttagttacccgttcgtttaccgttccgttacgttcccccgg

SEQ ID NO: 153014 - DNA, 725 bp, Homo sapiens
  misc_feature: GYAE6OF01B3N2E.22.20.B09.1.454.CMB.1.raw
  modified_base (143)..(143): a, c, t, g, unknown or other
  misc_feature (143)..(143): n is a, c, g, or t
  modified_base (491)..(491): a, c, t, g, unknown or other
  misc_feature (491)..(491): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatacccactgganaaatgttgaattcgacgcagtctccagcccacctgtctgtcgtctccgaaggggaaactcgccctaccctcctccgtgcgtacggccaagtccaggtagttcgttaagacaaacgtacttagtcgtaggtaccagcaagaacgtccgtcggccacggtcctacccgacggtacctcccgtactaacgttctaagtggttaccgtcccgttaccgttaaccgacgggtaccctacgttcgggtaaccctcccccggacgttacgggtttaccacgtccgtacccggtagggttcgggtacgtcggggacctaggtacgttcacgtcctaccgacaatcaggcacgtccngacctacgtacgtagtaagttactttcggtactttaacgtttatttaccgtagtccgtactaacttaaattataacctacgtacgttacgtttccgtacgtacctaccgttaccgttaaccggacaaccgggtacctaaccggtacgtaacggtaacgtaacgttaaaaccggtcgttaacggtccggtacgtaaccggtacctacccttaagtccgtttacgtacccttaccg

SEQ ID NO: 153015 - DNA, 674 bp, Homo sapiens
  misc_feature: GYAE6OF01ELMUA.22.20.B09.1.454.CMB.1.raw
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
tcagacatacgcgtcacgaccggtgctcgatttagtgtagtgtgaaggggagagctgctcagttaggacccagagggaaccatggaaacccagcgcagcttctcttcctcctgctactctggctccagatattactggagacgttgtcttgacgcagtctccaggcaccctgtcgctgtctcgagggaangccacctntcgtgtaacgccagtcagaatgtaacaacagatatgtacgcttaggtatcgagcagacgactcggcctacgtcctcccgttcttccttcgttcgttttcggtcggccggtaccgtacgacgggccgaccgggcaccgtccgtagacccctagtacttacgagtcggcgtacggttcggggtccgggtacgtacgtacttactcgtcgtcctccgaccgtacgtccggtcggttcgtacggtaaccgtaggtaacgttacgttcgtacggtacctaacttaacgttacttacgttcgttactacgtttactttacgtttacgtttaacttacctaccgttaccgttacgttacttacgtttcgtttacggaccggtaacgggtaccgtacgtacgtcggtaacgtacgtaacgaaacggtacgttaggtcggtcgtaccgacctacctacttcgttacgttcttcctcgttaccccg

SEQ ID NO: 153016 - DNA, 728 bp, Homo sapiens
  misc_feature: GYAE6OF01BM5JJ.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagtacgttgtcttgacgcagtctccaggcaccctgtcgctgtctccgaggggaancgccacctcgtcgtgtaacggccagtcaagaatgttaaacaacagtatatgtacgcctaggtatcgagcaagacgaccgtcggcctacgttcctcccgttctccgttcgttcgttttcgggtcgccgggtccgacggacgggcccgtacgggcctacgtccccgtagacgtagtacgttacgaggttcggacggtacgggttcgggggtaccggtacgaacggtacttacgtccgtcgcctcccgtaaccgtcggtccgggccggttcgtaacggtaaccgtaggaacgtacttcgtagacctaacgttatttaacgttacgttcgtactacgttatttttaacgttactttaactttcccgtaaccgtttccgtacgtttaacttacgttttcggttaccggtaccggtaacggggaccctaaggtcggtaacggacgtaaaccgtaaacgtaaaccggtacgttggtacggtccgtaccgaccctaaccgtactttcccgttaggttccctttacccgtactttccccccg

SEQ ID NO: 153017 - DNA, 748 bp, Homo sapiens
  misc_feature: GYAE6OF01C442Q.22.20.B09.1.454.CMB.1.raw
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtcctccaggcaccctgtcgctgtcctaccgaggggaaagacgcccaccctctccgtagtaacggccagtcaagaatagttaacaacagatatgtacgctggtatcagcaagacgactcggcctacgtccttcccgtccttacctcgttcgttggtcgccggaccgacgacggggccaccgggcctactccctgacagtcttacgaggtggacgtagggttcggggtccggtacacgtactacgtcgcgtcctacctaccgacgtccgggtacggttaccggtacggtaaccctagggtaactactttccggtagaccttaacttaatttaactttacgtcgttacgtacgttttctttaagtttacttttaaccgttaccctaaccgtttcccgttaccgttaaccttacgttttaccgttaccgggaaccggtaacggggtaacctacggtacgtaacggggtaaactaacggtaacccgttaaaaaccggtacggttaccgggttacggtcccgtaaacggtacccctaaccggttactttcccggtttacgtttacccttaccccgttaccgttttacccccccgg

SEQ ID NO: 153018 - DNA, 821 bp, Homo sapiens
  misc_feature: GYAE6OF01DQZ66.22.20.B09.1.454.CMB.1.raw
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
tcagacatacgcgtcacgaccggtgctcgatttagtgtagtgtgaaggggagagcgtgctcagttaggaccagagggaaccatggaaacccagcgcagcttctcttcctcctgctactctggcctccagattattactggatagttgtcttgacgcagtctcgagcaccctgtcnctgtctaccgagggaancgcccacctctcgtagtaacgccaagtccaagtaacttacgtaaaacaacgtagtaattacgtacggtacggtaccgttagggttaacacgtacggtacgaacggtaaccggtaacccgtaccgggtaccgtaaccggttacccgtttcccggtttaccgttccggtttccgttcccggttttcgggttccggtaccggggtacccggaccggtaccggggtacccggtaacccgggtaccgaagtaccccccccccgttagtaacgtaaccggtaacgttaccgtaggtacggtacggtacgggtttaccggggtaccgggttaaccggtacgtaaccgtttacgttaccgtccggtacctaccgtaaaccgtacggttaccgggttccggttacggtaccggtaaacgttaacggtaaagtaccgttacgttacgtaacgttaacgtaacgttaacttacgttacgtacgttacgttacgtttactttacgtttacttacgtaccgttaccgtacgttacttacgttacgttacggtaccggtaacggacgtacgtcgtagacgtactaacgaacgtacgtagacgtcgtacgacacgtacttacgtactttctcgttcgttacccg

SEQ ID NO: 153019 - DNA, 717 bp, Homo sapiens
  misc_feature: GYAE6OF01ENG8K.22.20.B09.1.454.CMB.1.raw
  modified_base (179)..(179): a, c, t, g, unknown or other
  misc_feature (179)..(179): n is a, c, g, or t
  modified_base (196)..(196): a, c, t, g, unknown or other
  misc_feature (196)..(196): n is a, c, g, or t
  modified_base (430)..(430): a, c, t, g, unknown or other
  misc_feature (430)..(430): n is a, c, g, or t
tcagacatacgcgtcacgaccggtgctcgatttagtgtagtgtgaagggggagagctgctcagttaggacccagagggaaccatggaaaccccagcgcagcttctcttcctcctgctactctggctcccagatattactggagtacgttgtcttgacgcagtctccaggcaccctgtcnctgtctcgaggggaaancgccacctctcgtgtaaggccagtcaagaattagttaacaacagatagtagtacgccttggtatcgagtcaacggacgtaacccgtggaccctacggttcccttccccgtttccttacccgttcgttccgttttgggcggtccgggacccgtaccggacgggggtcccgaccggggcctaccgtccccgtagaaccgtagtacgttcgaggtcggcgtagggtcgggtccggtnaacgtactatcgtgacgtaccacgtaggtcggtcgttcgtacggacctagaacgtattcgacgtacgtacttatttacttagtcgttactacgtttacttttaacttacggtttaactttacccgacccgttttacgtacccgttaaccttacggtttcccgtttacgggacccgtaaccggggactaacggtcgtacgggaagtacctaccggtaaaacgtcggtacgggtacgtccggtacaccgtaaccttacgttccgttagtttcccgtactccgttccccg

SEQ ID NO: 153020 - DNA, 839 bp, Homo sapiens
  misc_feature: GYAE6OF01BPS6R.22.20.B09.1.454.CMB.1.raw
  modified_base (196)..(196): a, c, t, g, unknown or other
  misc_feature (196)..(196): n is a, c, g, or t
tcagacatacgcgtcacgaccggtgctcgatttagtgtagtgtgaagggagagctgctcagttaggacccagaggaaccatggaaaccccagcgcagcttctcttcctctgctactctgctccagatattactggagtacgttgtcttgacgctagtctccgaggcacccgtgtcgctgtcctccgaagggaaacncgcccaccctcgtcgtagtaacgccagtcgaagtaatacgttaaacaacgagtaattagtggtacgtccgttaggtactaccgaagacgaagaccgtaccgtcggtacctacgttcccttccccgtttctcccgttcgtttcgttttcggtccggccggacccgtaacggaccggggcccgtaaccgggtccctaccgtccccgtagaacctagttacgttccggtaggtacgggacgtaacggggttccgggggtacccggactaacgtactttacgtccgtacgcccttaaccaccgtacggttccgggtccggttacgttaacgaaccgttagtaacgttcgttacgtacgtaacttaacttaacgtttaactttccgtacgttacgttacgtttacgtttttaacgttaacgttttaaccgtaccccgttacccgtttaccgttaaccgttaccgtttacggttccggtttaaccgggacccggttaaaccgggttaccgtaacggtcggttaaacggtaccgtaaacctaaaaccggtaaaacggttaccgttagggttacccggttccgtaacccgtacccgtaaccgttacctttccggtttaccgttaccctttaacgtccccctttacccccgg

SEQ ID NO: 153021 - DNA, 522 bp, Homo sapiens
  misc_feature: GYAE6OF02H3LJY.22.20.B09.1.454.CMB.1.raw
  modified_base (194)..(194): a, c, t, g, unknown or other
  misc_feature (194)..(194): n is a, c, g, or t
  modified_base (433)..(433): a, c, t, g, unknown or other
  misc_feature (433)..(433): n is a, c, g, or t
  modified_base (481)..(481): a, c, t, g, unknown or other
  misc_feature (481)..(481): n is a, c, g, or t
  modified_base (516)..(516): a, c, t, g, unknown or other
  misc_feature (516)..(516): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaangccacctctcgtgtaaggccagtcagaatgttaacaacagatatgtagcctggtatcagcagagacctggccagtctcccgttctcctcgtctttggcgcggccgacgagggccacgggcatccctgacagattcagtggcaggtcggggtccgggtcaggacctatctgcctcaccagtccgggcggttctagggaacctgaagtattctgactactatattactgtcagtctttatntttaatcaccttcgtctacattctttggcctaggggaccaagctgganatacaacgtatggtggctgcacagtcctgtcttcnttcccg

SEQ ID NO: 153022 - DNA, 506 bp, Homo sapiens
  misc_feature: GYAE6OF02F8NI3.22.20.B09.1.454.CMB.1.raw
  modified_base (350)..(350): a, c, t, g, unknown or other
  misc_feature (350)..(350): n is a, c, g, or t
  modified_base (469)..(469): a, c, t, g, unknown or other
  misc_feature (469)..(469): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtnagactatctgctcaccatcggcgtctggaacctgaagattctgcactatattactgtcagtctttatgttaattcacctccgttcgtactattctttggcctaggggaccaagctgganatcaacgaactgtggctgcaccatctgtcttcattcc

SEQ ID NO: 153023 - DNA, 507 bp, Homo sapiens
  misc_feature: GYAE6OF02HB8VN.22.20.B09.1.454.CMB.1.raw
  modified_base (492)..(492): a, c, t, g, unknown or other
  misc_feature (492)..(492): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcgtctggaacctgaagtattctgcactatattactgtcagtctttatgttaattcacctccgtcgtactatctttggcctaggggaccaagctggagatacaacgaactgtggctgcaccntctgtcttcattccc

SEQ ID NO: 153024 - DNA, 788 bp, Homo sapiens
  misc_feature: GYAE6OF02G8U5G.22.20.B09.1.454.CMB.1.raw
  modified_base (203)..(203): a, c, t, g, unknown or other
  misc_feature (203)..(203): n is a, c, g, or t
tcagacatacgcgtcacgaccggtgctcgatttagtgtagtgtgaagggagggagctagctcagttaggacccagagggaaccatggaaccccagcggcagcttcgtccttcctcctgctactcctgggctcccagatattactggagacgttcgtcttgaccgcagtctccaggccacctgtcgcctgtctccaggggaacncgcctacctctcgtgtaacggcctaggtcagaatgttaacaacagatatgtagccgtggtatcaggcagtagacctaggtcctagtcctcccggttctcctacgtacgttacggtggcggaccgtaccgagggcccaccggggtcaactcccctaggaccagtacttccacggttcggaccaacggttcggggtacccgggggtccaacggtaccgtttacgttccgtcggccgtacctaaccgtacggtaccgggtccgggttacggtacgggaaacccgttaggtaaacgtacgttttccgtacggacctaacgttaacttaacgtttaaccgtacggtaccctaagggttacccttttaagtacgttttaaaacgttccctaacccgtttccggttacggttaacctaacgttttaccgttttacgggacccgttaaagggggtaaacccttaaaggtacccgttagggaaccgtaccttaaccgtaaaaccggtaaccgtttacggggtacgggtaccggttacggaaccgtaaccgtaacgttaccgttacggttaaccgtttacgtacgtttaccccgg

SEQ ID NO: 153025 - DNA, 531 bp, Homo sapiens
  misc_feature: GYAE6OF02F88AH.22.20.B09.1.454.CMB.1.raw
  modified_base (194)..(194): a, c, t, g, unknown or other
  misc_feature (194)..(194): n is a, c, g, or t
  modified_base (354)..(354): a, c, t, g, unknown or other
  misc_feature (354)..(354): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaanagccacctctcgtgtaaggccagtcagaatgttaacaacagatatgtagcctggtatcagcagagacctggccagtcctcccgttctcctcgtctttggtgcggccgacagggcccacgggcatccctgacagacttcagtggcaggtggggtccgggtnagactatctgctcaccatcggcgtctggacctgaagtattctgcactatattactgtctagtctttatgtttaacttcctaccttccgtcgtactacttcgtttcggccgtacggggtaccaagtcgtaggagatacaacgtaactggtggtctgacacactctgtcttcattcccg

SEQ ID NO: 153026 - DNA, 496 bp, Homo sapiens
  misc_feature: GYAE6OF02HYF89.22.20.B09.1.454.CMB.1.raw
  modified_base (280)..(280): a, c, t, g, unknown or other
  misc_feature (280)..(280): n is a, c, g, or t
  modified_base (429)..(429): a, c, t, g, unknown or other
  misc_feature (429)..(429): n is a, c, g, or t
tcagacatacgcgtcacgaccggtgctcgatttagtgtagtgtgaagggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctccccgttntcctcgtctttggtgcggccgacagggccacgggcatccctgacagattcagtgcagtgggtcggtcagactatctgctcacatcggcggtctggaacctgaatattctgcactatattactgtcagctttatgttaattcacctcgtntacatcttggccaggggaccaaagcgtgagatcaaacgaactgtggctgcaccatctgtcttcatcc

SEQ ID NO: 153027 - DNA, 514 bp, Homo sapiens
  misc_feature: GYAE6OF02F8ID0.22.20.B09.1.454.CMB.1.raw
  modified_base (204)..(204): a, c, t, g, unknown or other
  misc_feature (204)..(204): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctntcgtgtaaggccagtcagaatgttaacacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagtctttatgttaattctaccttccgtcgtactacttctttggtccaggggaccaagctaggagatacaaacgtaactgtaggcttgcaccatctgtcttcattcc

SEQ ID NO: 153028 - DNA, 574 bp, Homo sapiens
  misc_feature: GYAE6OF02G5PYE.22.20.B09.1.454.CMB.1.raw
  modified_base (194)..(194): a, c, t, g, unknown or other
  misc_feature (194)..(194): n is a, c, g, or t
  modified_base (371)..(371): a, c, t, g, unknown or other
  misc_feature (371)..(371): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaanagccaccctctcgtgtaaggccagtcagaatgttaaacaacagatatgtagcctggtatcagcagagacctggccagtcctcccgttctcctcgtctttggtgcggccgacagggccacgggcactccctgacagattcagtggcaggtggggtccggtcagactatctgctcaccntcggcgtctcggaacctgaagattctgcactatattactgtcagtctttatgtttaacttcaccttccgtacgttactattcgtttcggaccgaggggacccaaggtccgtagggaacgtacgtaccgaaacggtaacgttacggtcggccttacggacctaacccgttatccgttcgtttacctttacctacgtttcccccg

SEQ ID NO: 153029 - DNA, 507 bp, Homo sapiens
  misc_feature: GYAE6OF02GFXV2.22.20.B09.1.454.CMB.1.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
  modified_base (388)..(388): a, c, t, g, unknown or other
  misc_feature (388)..(388): n is a, c, g, or t
  modified_base (490)..(490): a, c, t, g, unknown or other
  misc_feature (490)..(490): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaanagccaccctctcgtgtaaggccagtcagaatgttaacaacagatatgtagcctggtatcagcagagacctggccagtctcccgttntcctcgtctttggtgcggccgacagggccacggggcatccctgacagacttcagtggcagtgggtccggtcagactatctgctcaccatcggcgtctggacctgaagnttcgtgctactatattactgtcagtctttatgttaacttcaccttcgtcgtacattctttgccgagggaccagcgtgagatcgaacgactgtggctagcacngtctgtcttcgattccg

SEQ ID NO: 153030 - DNA, 510 bp, Homo sapiens
  misc_feature: GYAE6OF02FPX5V.22.20.B09.1.454.CMB.1.raw
  modified_base (468)..(468): a, c, t, g, unknown or other
  misc_feature (468)..(468): n is a, c, g, or t
tcagacatacgcgtcacgaccggtgctcgatttagtgtagtgtgaagggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacggggcatccctgacagattcagtggcaggtgggtccgggtcagactatctgctcaccatcggcggtctggaacctgaagattctgcactatattactgtcagctttatgttaattcaccttccgtctacatctttggccaggggaccaagctgganagtacaaacgaactgtggctgcaccatcctgtcttcattccc

SEQ ID NO: 153031 - DNA, 562 bp, Homo sapiens
  misc_feature: GYAE6OF02I43OU.22.20.B09.1.454.CMB.1.raw
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
  modified_base (357)..(357): a, c, t, g, unknown or other
  misc_feature (357)..(357): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaanagccaccctctcgtgtaaggccagtcagaatgttaaacaacagatatgtagcctggtatcagcagagacctggccagtctccccgttntcctcgtctttggtgcggccgacgacgggccacgggcaatccctgacagattcgagtggcaggtgggtccgggtnagactatctgctcaccatcgggccgtcgtaggaacctgaacgtattctgcctaactattattaactgtactagtctttatgttaacttccaccttccggttactactctcgtttggccgtagggaccagtcgtggatagtacgaaacgtaacgttggtcggtacttacgaccgacctagttccgttcgttccttactattccccg

SEQ ID NO: 153032 - DNA, 521 bp, Homo sapiens
  misc_feature: GYAE6OF02HJ8MI.22.20.B09.1.454.CMB.1.raw
  modified_base (194)..(194): a, c, t, g, unknown or other
  misc_feature (194)..(194): n is a, c, g, or t
  modified_base (513)..(513): a, c, t, g, unknown or other
  misc_feature (513)..(513): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaanagccaccctctcgtgtaaggccagtcagaatgttagcaaacaacttagtctggtaccagcagagacctggccaggctccaggctcctcatctatgttgccttctaccagggccactggtactccccgctaggttcagtgccagtgggtctgggacagattcactctcacatcagcagccctgcagtctagaagtattttgcttactttattactgtcagtacaattataatgacttggttctagtatcgtaccttcggcctaaagggcaacgacgtggactaattaaacgacttggtggactgacactatctgtccttnacttcccg

SEQ ID NO: 153033 - DNA, 565 bp, Homo sapiens
  misc_feature: GYAE6OF02JJU75.22.20.B09.1.454.CMB.1.raw
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaangccaccctctcgtgtaaggccagtcagaatgttaacaacagatatgtagcctggtatcagcagagcctggccagtctcccgttctcctcgtctttggngcgccgacagggccacgggcatccctgacagattcagtggcaggtcggggtccgggtcagactatctgctcaccatcggcggtctggacctgaagattctgcactatagttactgtcatctttatgttaacttcaccttccgtcgtactacttcgttttggccgtaggggtaaccgaagtcgttgggaacgtacgtaaccgaaaccggtaacttggtagggtccttacggacctaacccgtattaccgttcgtttacttccgtactttccccg

SEQ ID NO: 153034 - DNA, 717 bp, Homo sapiens
  misc_feature: GYAE6OF02I8T5H.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaangccacctctcgtgtaaggccagtcagaatgttaacaacagatatgtagcctggtatcagcagagacctggccagttcctcccgttctccttcgtcttttgggcgccgggtcccgaacgacggggcccaacggggccaacttccccgtagaaccaggtactttcgaggttcggacgagggttcgggggtacccggggttcaaggtacctttagtccgttggccttaccgaacccgtaggttcccggggtcggttccgtaacggggaacccttaggtaaacggtacgttttccgtcggtacctaacgtttaacgttacttttaacgtcgttacgagttaccgttttaagttacgttaactttcctaaccgttccgttacgttaactcgtttaccgtttcgggacccgtacggggtaacccaaggtcgtagggtaacgtacttaaccggtaaaacgtaacgttggtacggtacttaccggacctaaccgtattaccgttacgttacgtttacccaagtttccccg

SEQ ID NO: 153035 - DNA, 579 bp, Homo sapiens
  misc_feature: GYAE6OF02F5FRJ.22.20.B09.1.454.CMB.1.raw
  modified_base (195)..(195): a, c, t, g, unknown or other
  misc_feature (195)..(195): n is a, c, g, or t
  modified_base (564)..(564): a, c, t, g, unknown or other
  misc_feature (564)..(564): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagngcccaccctctcgtgtaaggccagtcagaatgttaacaacagatatgtagcctggtatcagcagagacctggccagtcctcccgttctcctcgtctttggtgccggccgacgacgggccacgggcactccctagacagattcgaggtcggcgtaggtcggggtccgggtacaggtactagtctgcctacaccgagtccgggtccggtctacgggaacctagaacgtgttcgtgactacttattattactgtcagttctttatagtttacttcctaccgttcgtacgtactctttcgttcggaccgtagggtaccaggtcgtaggacgtactaacgaacgtacgtggtcgcgttgacctactacttcgtnttccttcacttcccg

SEQ ID NO: 153036 - DNA, 509 bp, Homo sapiens
  misc_feature: GYAE6OF02F4SEH.22.20.B09.1.454.CMB.1.raw
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
  modified_base (469)..(469): a, c, t, g, unknown or other
  misc_feature (469)..(469): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccggtnagactatctgctcaccatcggcgtctggaacctgaagnttctgcactatattactgtcagtctttatgtttaattcaccttccgtcgtacattctttggccgtagggaccaagctagganatacaaacgtactgtggctgcacatctgtcttcattcccg

SEQ ID NO: 153037 - DNA, 557 bp, Homo sapiens
  misc_feature: GYAE6OF02HTL5P.22.20.B09.1.454.CMB.1.raw
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
  modified_base (404)..(404): a, c, t, g, unknown or other
  misc_feature (404)..(404): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaangccaccctctcgtgtaaggccagtcagaatgttaacaacagatatgtagcctggtatcagcagagacctggccagtcctcccgttctcctcgtctttggtcgccggccgacgagggcccacgggcacgtccctgacagattcagtggctaggtcggggtccggtnagactagtctagctcaccgagtcggcggtctaggaacctgaagtnttctgcacttatattactgtcagttctttagttagttaacttcctaccttcgtacgtactacttcgtttcggaccgtagggtaccaagtcgtagagtactacgaaacgtacgttgtcggcttacgactacctatcctcgttcttcgattcccg

SEQ ID NO: 153038 - DNA, 534 bp, Homo sapiens
  misc_feature: GYAE6OF02JBRRJ.22.20.B09.1.454.CMB.1.raw
  modified_base (398)..(398): a, c, t, g, unknown or other
  misc_feature (398)..(398): n is a, c, g, or t
  modified_base (516)..(516): a, c, t, g, unknown or other
  misc_feature (516)..(516): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacgagggccacgggcatcccctgacagacttcagtcggcaggtcgggtccgggtcagactagtctgctcaccatcgggtcgtctggaacctgaagtnttcgtgcactattatactgtcagtctttatagttaattcaccttccgtactacacttcgttcgccgaggggtaccaggctaggactacacgtaacggtactggtacggtctagccacntctgttcttcacttcccg

SEQ ID NO: 153039 - DNA, 566 bp, Homo sapiens
  misc_feature: GYAE6OF02F4U2C.22.20.B09.1.454.CMB.1.raw
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaanagccaccctctcgtgtaaggccagtcagaatgttaacaacagatatgtagcctggtatcagcagagacctggccagtctcccgttctcctcgtctttggtgtggccgacgagggccacgggctacgtccctgaccagtacttcaggtggcaggtggggtccggtnaggactatctgctcaccagtcggcgtcgtacggaccgtgaagtattctgctactattacttactgtctagtactttattgttaacttctaccttccgttactacttattcgtttggaccgtagggacctaagcgtaggagtactacgaaacggtaactggtcggtactcgacctactacgttccttaggttccttacctacttcccg

SEQ ID NO: 153040 - DNA, 658 bp, Homo sapiens
  misc_feature: GYAE6OF02J0MYM.22.20.B09.1.454.CMB.1.raw
  modified_base (347)..(347): a, c, t, g, unknown or other
  misc_feature (347)..(347): n is a, c, g, or t
  modified_base (555)..(555): a, c, t, g, unknown or other
  misc_feature (555)..(555): n is a, c, g, or t
tcagacatacgcgtcacgaccggtgctcgatttagtgtagtgtgaagggagagctgctcagttaggacccagagggaaccatggaaaccccagcgcagcttctcttcctcctgctactctggctcccagatattactggagacgttgtcttgacgcagtctccaggcaccctgtcgctgtctaccgaggggaaagacgcccacccttctcggtgtaacggccagtcagaatgttaaacaacagatactgagtccgtaggtactcacgcagacgaccgtggcacgtctccgttctccttcgttcttggtgccggtccgacgtacgggccgaccgggctacgttcccgngtaaccaggtaacttcggtacgtcgggacgtaggtttcggggtcccgggttacagtaaccgtagtccgtgcccttacacccgtacggttcgggccggttctacgggaaccctaggtaaacgtacgttccgtagccgtaactttagtaacttagtcgtacgttacgttactttagtacgtttaactctaacccgttcgttaactacgtntttaccgtgggtccctaagggacctagacgttagacgtacaccgtaaaacggtcgtagtcgacttcgaccaccgttctcgttaccgtcttaccgcttaccccg

SEQ ID NO: 153041 - DNA, 523 bp, Homo sapiens
  misc_feature: GYAE6OF02FJA9W.22.20.B09.1.454.CMB.1.raw
  modified_base (194)..(194): a, c, t, g, unknown or other
  misc_feature (194)..(194): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaanagccaccctctcgtgtaaggccagtcagaatgttaaacaacagatatgtagcctggtatcagcagagacctggcctagtctcccgttctcctcgtctttggtgcggccgacgacgggccacgggcactccctgacagattcagtgcagtgggtccggtcagactatcgtgcctcaccagtcggcggtctaggaccttgaagtattctgctacttatattactgtcagtctttatagttatctacctcgtactactatctttgccgtacgggacagcgtggatatacaaacgtactgtgtctgacacctatcctagtcttctacttcccg

SEQ ID NO: 153042 - DNA, 577 bp, Homo sapiens
  misc_feature: GYAE6OF02GAH3Z.22.20.B09.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
  modified_base (392)..(392): a, c, t, g, unknown or other
  misc_feature (392)..(392): n is a, c, g, or t
  modified_base (446)..(446): a, c, t, g, unknown or other
  misc_feature (446)..(446): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagngccaccctntcgtgtaaggccagtcagaatgttaacaacagatatgtagcctggtatcagcagagacctggccagtctcccgttctcctcgtctttggngcggccgacgagggccacgggcactccctgacagattcgagtggcaggtcggggtccgggtcagactatctgctcacatcggcgtctaggacctgaanattctgcactatattactgtcatctttatgttaattcctacctcgttactactntttcgtttcggaccgtacggggaacctaaggtccgtagggacgtacgttaacgaaaccggtaacttggtacgggtccttaggaccctaaccgttacgttccgttacgttacctttaccgtactttccccgg

SEQ ID NO: 153043 - DNA, 600 bp, Homo sapiens
  misc_feature: GYAE6OF02HQSF6.22.20.B09.1.454.CMB.1.raw
  modified_base (391)..(391): a, c, t, g, unknown or other
  misc_feature (391)..(391): n is a, c, g, or t
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (576)..(576): a, c, t, g, unknown or other
  misc_feature (576)..(576): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaagacgccacctctcgtgtaaggccagtcagaatgttaacaacagatatgtagcctaggtatcagacagacgacctggccagttcctcccgttctccttcgttcgtttggtcgccggtccgacgtacggggaccacggggcacgtccctagaccgagtacttccgagtcggcgaggttcggggtccgggtcagtactanctgcctcactagtcggcggtactcggaactagaacgtnttctgctactattattacgtntactagtctttagttacttaacttactaccttccgtacttacctacgttacgttcgggaccgtacgggtacctagcgttggaagactaaccgtaaacgtcgtggtcggactacggtaccaccgttntaccttgtacttcctacttccccg

SEQ ID NO: 153044 - DNA, 669 bp, Homo sapiens
  misc_feature: GYAE6OF02IF0P4.22.20.B09.1.454.CMB.1.raw
  modified_base (199)..(199): a, c, t, g, unknown or other
  misc_feature (199)..(199): n is a, c, g, or t
  modified_base (337)..(337): a, c, t, g, unknown or other
  misc_feature (337)..(337): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtcctccaggccaccctgtcgctgtcctccgaaggggaaancgccacccttctcgtaggtaacggccagtcaagaattgttaaacaacagatatgtacgcctggtactcagcagagacctggccagtcctcccgttctcctcgtctttggcgcggccgacgagggccacgggcactccngaccagtattcagtggctggtcggggtccggtcagactactctcgctccaacgcgtcggcggttcgacggtaacctggaaagtacgttcgtcgacctaacttaactaatttacgtgtactaagtttcttttaattaacggtttaacttaccctaccgtttacccgttaccgtttaaacttaccgtttcgttttaccgggaccggtaacggggtaacctaaacggtccgttagggtaacgtacgtaaccctaaaacggtaccgttaacgggtcggtacccgtacggaccctaacgttacttacgttccgtttcctttactacgtttacccccg

SEQ ID NO: 153045 - DNA, 558 bp, Homo sapiens
  misc_feature: GYAE6OF02HYJKA.22.20.B09.1.454.CMB.1.raw
  modified_base (195)..(195): a, c, t, g, unknown or other
  misc_feature (195)..(195): n is a, c, g, or t
  modified_base (323)..(323): a, c, t, g, unknown or other
  misc_feature (323)..(323): n is a, c, g, or t
  modified_base (399)..(399): a, c, t, g, unknown or other
  misc_feature (399)..(399): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaangccaccctctcgtgtaaggccagtcagaatgttaaacacagatatgtagcctggtatcagcagagacctggccagtctcccgttctcctcgtctttggtgcggccgacgagggccacgggcactcccngacagtattcagtggctaggtcggggtccggtcaggtactatctgctcacagtcggcgtctggaacctgagattcngacatatattactgtctagtctttattagttaattcctacccttccgtactactatttcgttcggccgacggggtaccaaagtccgtaggatactacgaaacgacgttggtaggtctacggcctacgtacttccgttacggtctttaccgtattccccg

SEQ ID NO: 153046 - DNA, 554 bp, Homo sapiens
  misc_feature: GYAE6OF02GRXNN.22.20.B09.1.454.CMB.1.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagcccacctctcgtgtaacggccagtcagaatgttaaacaacagatatgtagcctggtatcagcagagactggccagtctcccgttctcctcgtctttggngcggccgacagggccacgggcactcccctgacagtattcgagtggcaggtcggggtccggtnaggtactagtctgctnaccagtcggcgtcncgaacctgaagattcngacatatattactgtacagttctttatgttaatcctaccttccgtatactattcgttaggcgtaacgggaccagtcgtaggacgtacgtacgtaaacgtagtggtacggctacggtaccacgtcgttactcggttacttcgactttccccg

SEQ ID NO: 153047 - DNA, 637 bp, Homo sapiens
  misc_feature: GYAE6OF02GUP6V.22.20.B09.1.454.CMB.1.raw
  modified_base (201)..(201): a, c, t, g, unknown or other
  misc_feature (201)..(201): n is a, c, g, or t
  modified_base (384)..(384): a, c, t, g, unknown or other
  misc_feature (384)..(384): n is a, c, g, or t
tcagacatacgcgtcacgaccggtgctcgatttagtgtagtgtgaagggggagagctgctcagttaggacccagagggaaccatggaaaccccagcgcagcttctcttcctcctgctactctggcctcccagatattactggagacgttgtcttgacgcagtctccaggccaccctgtcgctcgtcctccgaaggggaaancgcccaccctcgtcgtagtaacggccagtcagaacttgtaaacaacagatatgtagcctggtactcgagcaagacgaccgtggacctagtccttcccgtcttcctcgttcgtttggcgcggaccgacgtacgggccgacgggccacgtcccgtagacagtactcgagtgcaggtcgggccganacgtactgtcgtgcctacaccgtgtccggtcgtcgtaacgaccgtagaacgtacttcgcgtactacttaattacttaccgtagtctaagttactttaattacgttaaccttccgtaacccgttcgttaccgtacttagtttaccgttcgggaaccgtaacgggaaccctaagtccggtagaagtaccgtaacgaaaccgttcgtggtcggtactcgtaacctaccgtcttcgtaccgtccttacaccttcccg

SEQ ID NO: 153048 - DNA, 640 bp, Homo sapiens
  misc_feature: GYAE6OF02I974I.22.20.B09.1.454.CMB.1.raw
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (343)..(343): a, c, t, g, unknown or other
  misc_feature (343)..(343): n is a, c, g, or t
  modified_base (497)..(497): a, c, t, g, unknown or other
  misc_feature (497)..(497): n is a, c, g, or t
tcagacatacgcgtcacgaccggtgctcgatttagtgtagtgtgaagggagagctgctcagttaggacccagagggaaccatggaaaccccagcgcagcttctcttcctcctgctactctggctcccagatattactggagacgttgtcttgacgcagtctcaggcaccctgtcgctgtctccgaggggaagagcccacccttctcgtgtaacggccagtcagaatgttaacaacagatngtacgcctggtatcagcagngacctggccagtctcccgtntctntctttggtgcggccacgcggccgacgggcatccctaggacagtattccgagttgggacnggttcggtccggggtacaggtaactttgtcctggtccgttaccaacccgtacggcgggttccggttacgttcgggaacccgttaggaacgactttcgtcgtactaaccgtattatttacgtaggtacctagtcgttttaatcgttaactttacnccttaccgtacgttacttacttcgtttggtcccgaagggggtaccaaactccggtaggttaccggattaccgtaaaccgtacggttaagttcgggctacggttacccgactacgttccttacggtcttaccgtacttacccgg

SEQ ID NO: 153049 - DNA, 886 bp, Homo sapiens
  misc_feature: GYAE6OF02JE8B9.22.20.B09.1.454.CMB.1.raw
tcagacatacgcgtcacgaccggtgctcgatttagtgtagtgtgaaggggagagctgctcagttaggacccagagggaaccatggaaaccccagagcagcttctcttcctcctgctactctggcctcccagatattactggagacgttgtcttgacgcagtctccaggccaccctgtccgctcgtcctccgaggggaaatacgcccacccctctcgtacggtaaaggcccagtcagtaacttggttaaaaccaacaggaattagtaggttacgacccgttagggtacttcgaacgccgtaacggtaacgaccccgttacggccccgaaggtttccccttcccccgggtttaccttccccctttcggttcccttttcggggttccgtcccgggccgtaaccggacggggtccccgaccggggcctacgtccctagaccaggtaacttccgaggtgacgagggttcggggtcccggtacgaacgtacgtacttccgtagtcctacctaccggaagtcccggggtccgggttactaccgggtaaaccgtagggtaaaccggtacgtttaccgttacgaacccgtttaaccgtaacgtttaacgtttaaccgtacggtttccgttaacgtttaccgttttttaacttacgggtttttaaacctttacccgtacccttttaccccgggttaccgttaacccgtttaacgttttccgggtttacccgggaccggttaaacccgggggaaaccgtttaaacccgggaccgttaacgggggtaaccgtacgtaaccggtaaacccgtaaacggttccggtaaagggtcccgtaacggaccttaacccgtaaccggttccttacgggtacccctttacgtacgtttcccccccgg

SEQ ID NO: 153050 - DNA, 749 bp, Homo sapiens
  misc_feature: GYAE6OF02J2O2K.22.20.B09.1.454.CMB.1.raw
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaancgcccaccctctcgtgtaacggccagtcagaatcgttaacaacagatatgtacgcctggtactcgagacagacgacctggacctacgttccttccccgttctccgttcgttctttgggtcgccggtccgacggtacggcccgacgggcacgtcccngactagtcttcgaggtcggacgtacgggttcgggtaccggtacaacgtacgtacgttcgtcgtacctaccgtaccgtacgtccggggtacgttaccgtacggtaaccgtagacgttacgttaccgacgtacgtaaactttagttaacgttcgttacggtacttacgtttaacgttttaacgttacgtttaaccgttacccgtacccgtttacgttaaccgttacgtttaacgttttcccggttaaccgggacccgggttaaaccgggtaacctaacgggtacggtaacgtaaccgtaccgtaaaccggtaaccggttacggtccgggttacgtacccgttacgaacccttaacgtaccgtttcgtttacccgtaccgttaccctaccccgtttccccg

SEQ ID NO: 153051 - DNA, 683 bp, Homo sapiens
  misc_feature: GYAE6OF02FMF26.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgtttgtcttgacgcagtctccaggcaccctgtcgctgtctccaggggaaangccaccctctcgtgtaaggccagtcagatgttaacacagatatgtagcctggtatcagcagagacctggccagtccttcccgttctccttcgttctttggtgccggccgtacgacgggtcccacggggtcctagtccctgactagactttacgagttggcgtaggtcggggtccggtcaggactagtctggcttaccacccgtagtccgggtaccggtcgtacggtaaacccgtggtaaaggttacttcgtacgtaccgtaactttacttaacgtttaccgtaggttaccttagttacctttttaagttacggttttaaacttcccgttaaccgtttccgttaccgttactaacgtttccgtttacgggacccgttaacggggtaaccaaggtcgtacgggtaacttacgtaaccgtaaacgtacgttcggtacggtcttaccgaccgtaccctacgttccgttcgttaccttacgtacctttccccg

SEQ ID NO: 153052 - DNA, 832 bp, Homo sapiens
  misc_feature: GYAE6OF02H69D8.22.20.B09.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagacatacgcgtcacgaccggtgctcgatttagtgtagtgtgaaggggagagctgctcagttaggacccagagggaaccatggaaacccagcgcagcttctcttcctcctgctactctggctcccagatattacgtggagtacgttgtcttgacgcagtctccagcaccctgtcgctgtctccgagggaaangccacctntcgtgtaacgccagtcagaatgtaaacaacagatacgngtacgctaggtatcagcagagaccgtggacctacgtccttacccggttcttccccgtcgttcgttttcgggtcggtccggtaccgaaccgacgggacccgaccggggactacgttcccgtacgaaccgaggtacttccgaaggttcgggacgtacgggttcggggtaccgggttcgaacggacctttagtccggttcgtccgttaccctaaccgtaacggttccggggtacccggtttcggtttaacccgggaaaccgttacgggtaaacgttaaccgttttccgtaccggtaaccgttaacgttaaacgtttaaaccgtttacggttacggtttaaccgtaaccggttttacccgttttaaagttttacccggtttaacctttttacccgaacccccgttttccggtttaacccggttaaccgttacctttccgggttttaaccggacccgttaaccggggtaaccctaaacgggtccgtttaacgggaacgtaacgttaaccggaaaaccggttacgttaggttacccggtgtaaccggaccttaacgttaccgttagtttcggttaccgttaccttacgttccccccgg

SEQ ID NO: 153053 - DNA, 952 bp, Homo sapiens
  misc_feature: GYAE6OF02FY7GO.22.20.B09.1.454.CMB.1.raw
  modified_base (140)..(140): a, c, t, g, unknown or other
  misc_feature (140)..(140): n is a, c, g, or t
  modified_base (210)..(210): a, c, t, g, unknown or other
  misc_feature (210)..(210): n is a, c, g, or t
tcagacatacgcgtcacgaccggtgctcgatttagtgtagtgtgaaggggagagctgctcagttaggacccagagggaaccatggaaaccccagccgcagcttctcttcctcctgctactctggctcccagtatattacnggagacgttgtcttgacgcagtcctccgacggccaccctgtccgcttcgtccgtccgaaagggggaaacnccgcccacccttcgtcgtacggtaacggccgaacgtacgaagtaacttaacggttaaaaccaaactaaggaatttaagttacggttaacgtccccgtttaggggttaaactccgaacggtaccgaagggtaccggtaccccgtcgggaccctaacggtttcccccgtttccccgtttacccctttccggttccgttttcgggttttcgggtcgggtacccggggcccgtaccgggaccggggcccggtaccgggcctaccgttcccgtacggaacgtaacggtacgtttaccgacggttggaccgtaggggttccgggggtaccggtacgtaacggttctacgttcgtcgtacctaacgaccgtaccggtcgggtccgttacgacggtaaccgttagtaacgttacgttaccgtagtacccttaaattaaaccgtttacgtttaccgtacggtttaccgttaacgttttacgtttttaaccgtttaccggtttaaacccttttcccgtttaaccccggtttaccgtttaccggttaaacctttccgttttaccgggttaaccgggtaccgggtacccgggtaaacgtaaccgtttacggtaacgggtaacgttaaccgttaaacccggtaaacgttccgggttaccggttaccggtaaccggtttacccgcccggttaaacccgtttcggtttacccttttaccgtttacccccgtttaacgttccccgttttaccccccgg

SEQ ID NO: 153054 - DNA, 758 bp, Homo sapiens
  misc_feature: GYAE6OF02J04BW.22.20.B09.1.454.CMB.1.raw
  modified_base (201)..(201): a, c, t, g, unknown or other
  misc_feature (201)..(201): n is a, c, g, or t
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactcgtggctcccagatattactggagacgttgtcgttgaaccgcagtctccgaggccaccctgtcgctgtctccgaaggggaangcccacctctcgtgtaaggccagtcaagaatgttaaacaacagtatagtgtacgccgtggtatccagcgagacgacctggcacggtccttcccggttctccgtcgtcgtttggtcgccggcccggacgtacgggcccgaaccgggtctacgtccccgaggacctaggactttccgaggtggccgtaaggttcggggtacccggtnaacggtacgtactcgtnccgtcaacccgtaggtccggacggttcgtacgggtaaccttaggacggttacttcggtacgcgttaacgtaacgttaacgttaacgtcgttaccgtaacgtttaccgttttaaagttacgtttaaacctttacctaacccgtttaccggttaccggttaccttacccgttttaccgtttccgggtaaccggttaaccgggggtaaccctaacggaccgttacggaacgttaacgtaccgttaaacccggtaacgttacgggttacgggtaaccgttaccgtaaccgaccgttaccgttacgttacgtttcggtttacccttccggtttaaccccc

SEQ ID NO: 153055 - DNA, 740 bp, Homo sapiens
  misc_feature: GYAE6OF02JVF9Z.22.20.B09.1.454.CMB.1.raw
  modified_base (193)..(193): a, c, t, g, unknown or other
  misc_feature (193)..(193): n is a, c, g, or t
tcagacatacgcgtcacgaccggtgctcgatttagtgtagtgtgaagggagagctgctcagttaggacccagagggaaccatggaaaccccagcgcagcttctcttcctcctgctactctggctccagatattactggagacgttgtcttgacgcagtctccaggcaccctgtcgctgtctccgaggggaaancgccaccttcgtcgtaggtaacggccagtcaagtaattacgttaaacaacaagtactagtacgtaggtcccgttaggtattaccgagtacgaacggacgtaccgtcggacctacggtcccgttccccgttcttccccgttcggtttccgttttgggtcgcccggaccggtacggtaaccggggccgtacccggggctacgtcccgtagaaccgtagtacgttcggacggttcgggcgtacgggttccgggggtacccggtcaagtaccgttcgtcgtacgtccctaccgacgacggttcgggacgttaccgtacggtaacgtacggtaagttacgttcgtacgtaactacttaacgttacgttacgtacgttacgtacgttacgtttacgtttacttacgtacctcccgttacgttcctaacgttcgtcgttacgggtaccggtaacggtaccctagggtcctaagggtacgtacctaacgtaacggtaccgtggttcggaacttccgacttaccgtcgttcttacgttacctcgttaccttacccg

SEQ ID NO: 153056 - DNA, 685 bp, Homo sapiens
  misc_feature: GYAE6OF02GTCGV.22.20.B09.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (340)..(340): a, c, t, g, unknown or other
  misc_feature (340)..(340): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccagacaccctgtcgctgtctccgaggggaaangccaccctntcgtgtaaggccagtcagaatgttaacaacagatatgtacgcctggtatcagcagacgacctggccagtcctcccgttctccctcgtctttgggtcgccggccgtacgacgggcccacggggtccacgttccccgnggaccagtacttcgaggtcggacgtaggttgggggtcccggtcgacgacttagtcgttgccttacaccgtagttccggggcgtttcgtacggtaaccctaggtaacgtactttacgtcgtactacgttaacttagtttaccgtcggttacgttacgttactttttaagttacgtttaacgtttacctacccgtttccggttaccgttaacttacggtttaccgtttacggggtacccgtaaccgggggttaacctaaggtcctaggggtactaaccgtaaccgtaaacggtaccgttgtacggacttacgacaaccttgtccttcgttacctacctacttccccg

SEQ ID NO: 153057 - DNA, 712 bp, Homo sapiens
  misc_feature: GYAE6OF02FSKPQ.22.20.B09.1.454.CMB.1.raw
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
tcagacatacgcgtcacgaccggtgctcgatttagtgtagtgtgaaggggagagctgctcagttaggacccagagggaaccatggaaaccccagcgcagcttctcttccctcctgcctactctggctcccagatattactggagacgttgtcttgacgcagtctccaggcaccctgtcgctgtctccgaaggggaaancgcccacccctctccgtgcgacgggccagtcagagttattagacaactaacttagcctggtaccagcagacgacctggaccaggcctcccgaggcccttccctacacttctagttcgttgacacgtccnggcgacggcctacgtcccggtaccccaggccgtaggtttaccaggttcggctaggggttcggggtcgtaggggaacgtacggtacctttccgaaccgttccaccaccgtataccgagcccgagtccctaggacgtcgtacgttaataacggtttatttacgacgtttattttaacgttacgttcgttacgtacgttcgtaagtttaactagttttccggacggttaccgtaccgggtttaccgttaccggaacccgggtaaacggtaaccggtaagggttacgggtaaccgtaacgaaacccggtagttcgggtacgtaccgttacgaccgtaaccttccggttacgtttcggtaccctttacgttaccttcccggttacccccg

SEQ ID NO: 153058 - DNA, 657 bp, Homo sapiens
  misc_feature: GYAE6OF02IAKCO.22.20.B09.1.454.CMB.1.raw
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
  modified_base (596)..(596): a, c, t, g, unknown or other
  misc_feature (596)..(596): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattacgtggagtacgttgtcttgaccgnagtcctccgaggccaccctgtcgctgtctccgaggggaangcccacctgtcgtgaacggtccagtcagtaatgtaacacagtntaatgttagccttaggtatacgagacgtaagacgacctacgggctacggtccttaccccgttcttcccgtacgtttccgttttggccggtaccggtaccggtacgaacggggcccgtaacgggccctaacgtcccctaggaacctagtacgtcgaggtcggtctagggttccggggccgttagacgtactagtcncgtcaccaccgngtccggtccggtagtcggaacgtggtaanacgttcagtacctaagttatacgttacttgacttcgttacttttaacgtacgtttaacttaccgtacccgtcggttacttaccgtacgtttcccggttaggaccgtacgggtaaccncggtacgtagactacgtacgaacgtctagtcgactcgcctatctacttctctactactccc

SEQ ID NO: 153059 - DNA, 766 bp, Homo sapiens
  misc_feature: GYAE6OF02H9K3U.22.20.B09.1.454.CMB.1.raw
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccgaggggaaagcgccaccctcgtcgtgtaacggccagtcagaatacgttaacaacagatatgtacgccgtgtatcagcagacgaccgtggaccagtccttcccgttctccgttcgttcgtttaggcggccggtaccgacggtacgggacccgacgggtacctacgtccccgtaggaacctacgtacttcgaggttcggcgtagggttccggggttacccgggtacaacggtaaccgtttacgtccgtacggtcccttacgaaacccgtcggttccggggtccgggtttaccgttacggggtaaacccgttacgggtaaacggtttaccgttttaccgtacggtacccttaactttaacgtttaaacgttttaccggttaggttaccgttacgttttaacttttaacgtttaacggttttaacctttacccgtaacccgtttaccgttaccggtttaacttcgtttaccgttacgggacccggtaacggggtaccaaggtcgtacggaagtaccgtaacgtaaccgtacggtcggtacgacgttcgacctacgtacgttcttacgttcttccgtacttccccg

SEQ ID NO: 153060 - DNA, 826 bp, Homo sapiens
  misc_feature: GYAE6OF02G5B7F.22.20.B09.1.454.CMB.1.raw
  modified_base (93)..(93): a, c, t, g, unknown or other
  misc_feature (93)..(93): n is a, c, g, or t
  modified_base (115)..(115): a, c, t, g, unknown or other
  misc_feature (115)..(115): n is a, c, g, or t
  modified_base (143)..(143): a, c, t, g, unknown or other
  misc_feature (143)..(143): n is a, c, g, or t
  modified_base (227)..(227): a, c, t, g, unknown or other
  misc_feature (227)..(227): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (482)..(482): a, c, t, g, unknown or other
  misc_feature (482)..(482): n is a, c, g, or t
tcagacatacgcgtcacgaccggtgctcgatttagtgtagtgtgaaggggagagctgctcagttaggacccagagggaaccatggaaaccccngccgcagcttctcttcctcctnctactcgtgcctaccagtattagttcgnggtacggtacgttgttcttggaccgtctaagtcctaccgaggcctacccgtgtccgtcgtcgtccgtaccggaaggggaaaacncgtcccctaccgttccgtggttaacggtaacgcccgagtacgaaggtaaacgttacgttaaaaaccaacgtaaggtaattaaggtcgttaaccgtccggttaaggtaactccgaaggaccgtaaggacggtccgtacggacctcgttcccttcccgtacttccgtcgttcgttggcgtccggacgtaacggcggacgccgctactccgtaagacgtacgtntacggcgnggtacgtacggtccgggtaccggtanaggtaacctaggctacggtacccacggtacgttacggcggtttaccgacggttaaccgtacgtacgtaagttctacggtctagtacctaacgttagtaccgtagttacttcgtttactaacgtttacttccggttacctaccgtaccggtttacgtacgttacccggttttaacggtcggtaacccggtaccggtaacccgtagtaacggtacggaacgttaacgtaaccggtaacgggtaaacgtttgggacccggtaacccgttaccggtacccgttaacccttacggtttaacccggtttacccggtttaccgtttaacccgtaccccgttttaccccggg

SEQ ID NO: 153061 - DNA, 671 bp, Homo sapiens
  misc_feature: GYAE6OF02JNX88.22.20.B09.1.454.CMB.1.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (359)..(359): a, c, t, g, unknown or other
  misc_feature (359)..(359): n is a, c, g, or t
  modified_base (508)..(508): a, c, t, g, unknown or other
  misc_feature (508)..(508): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtcctccaggggaaancgccaccctctcgtaggtaacggccagtcaagtaatcggttaaacaacaagatatgtacgctggtacncgagcagacgactcggccacgtcctcccgttctcctcgttcttggtcgccggcgacgtacggccgacgggtcattccgtcactatattccgtaggngtcgacggttcggggtacccggggttcaacggtacctttaacgtcgtcgtaccttaccgacccgtaagttcccggtacgggttcctacgggtaaccgtggtaacgtacgttcgtacgctacgttacttaacttacgtcgtagtacgttntttacgttacgttaacttaccggtaccttaccgttccttaacgtcgtttaccgtttcgggaccggtaacgggtaaccctaacgtcgttaaggacgtactaacgaacgtcgttagtacggctacggtaaccgtcctaattccgtatttccgtacctcgttcccg

SEQ ID NO: 153062 - DNA, 806 bp, Homo sapiens
  misc_feature: GYAE6OF02JSLCO.22.20.B09.1.454.CMB.1.raw
  modified_base (196)..(196): a, c, t, g, unknown or other
  misc_feature (196)..(196): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccgaggccaccctgtcgctgtctccgaggggaancgccaccctcgtcgtagtacggcagtcagaactagttaacactagatatgtacgtcctaggtatcagacagacgacgtggacctacgtccttacccgttctccgttcgttacgtttcgggcggccggaccgtacggtaccgggaccctaacggggcctaccgtccctaggaccgaagtacttacggaggtcggtacggtacggtcggggtaccggtacaacggtacgtacgtcgtacggacccgttacgacccgtaacggttccggggtacccgtttacgtaccggggtaaacctaggtaaacgttccgtttacgtaacgtacccttaaaccgttagttaaccgttaccgttacgttacgttaacgtttagttttaaccttacggtttaaaccttcccgaaacccgtttttcggtaaacgtttaccgtacgttttacccgggtaacggtacccgggtaaaccggggtaactaaacccggttaggtaacgggttaacgtacccgttaaaacgggtaacccgtaacggttaccgggtaccgggtaaccttaaccggtacccggtaccttaacgtttccgaccggttttaccacccgtttacccgttaccccg

SEQ ID NO: 153063 - DNA, 904 bp, Homo sapiens
  misc_feature: GYAE6OF02GPGUH.22.20.B09.1.454.CMB.1.raw
  modified_base (158)..(158): a, c, t, g, unknown or other
  misc_feature (158)..(158): n is a, c, g, or t
  modified_base (199)..(199): a, c, t, g, unknown or other
  misc_feature (199)..(199): n is a, c, g, or t
tcagacatacgcgtcacgaccggtgctcgatttagtgtagtgtgaaggggagagctgctcagttaggacccagagggaaccatggaaaccccagcgcagcttctccttcctcctgctactctggctcccagatattactggagacgttgtcttgacgnagtcctccgaggccaccctgtcgctcgtctcgaaggggaanacgcccaccctcgtcgtaggtaacgccagtacagtaatgttaaacaacagatataggatccgtagtatcagcgagacgtaccgtcggaccctacggttcccttccccgttccttacccgttccggtttcgttttacgggccggccggtacccggtaaccggaccggggacccgtaaccgggtctaccgttccgtacgaaccgtaagtacttcgacgggttggaccggtagggttaccggggtcccggggtacctaaggtaccgtttacgtccgtacggtacctaaccggaccctccgggtacggtcccgggtacgtacggtaaaccgtacggtaacgttacgtttacgtaccgtaccttaacgtttaaacgttacgttttaaccgtacgtttacccgttaagttttaaccgtttttacggttaaaccggttttaactttaccccgtttaaccccgttaacccgggttttaccctttaaacgttcccgtttttacggggtttaacccggggcccccggttaaaacggggggtaaccctttaaaccgggacgtttaacgggggtaaacccgtttaaccgtaaaccggtttaaaacccgggtaaggttttaccgggtaaccggtacccggtacccggtaacctttaacccggttccggttaccggttttaccctttccggtttacccccttacccgttttccccccgg

SEQ ID NO: 153064 - DNA, 824 bp, Homo sapiens
  misc_feature: GYAE6OF02HHI19.22.20.B09.1.454.CMB.1.raw
  modified_base (195)..(195): a, c, t, g, unknown or other
  misc_feature (195)..(195): n is a, c, g, or t
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgtcagtctccaggcaccctgtcgctgtctccgaggggaanacgccaccctctcggtaggtaacggccagtacgagtaagtacgttaaaccaacaagtatacgtagtacgtacccgtaggtactcgaagacgaggaacgaccgtggccctaaggttccttccccggtttaccttcgttccggtttcgtttttcgggtcggcccgggtacccggtaccggaccgggggcccgaaccggggccgtaaccgtcccgtacggaccgtaaggttacttaccggaggtacgggacggtagggtttaccgggggtcccggggtaacacggtaactttacgtccgtcgtacccgtaccgaccctacggtcccgggtcggtttaccgtaccggggtaaccctaagggtaaccgttacttccggttacgaacccgttaaactaactttaacggttaactcgggttaaccttggtttaaccttttagtaacggtttacttacccgtaccgttacctttaacggttaccttaagttttcccgggtaacgggaccgttacggggaactcgtacggacggtaacgtaacgtaaccggaaaggtttcctacggggtactaccggtaccgtaacccgttaccgttacgttaccgtttctttacccgtttaccgtccttacccccgg

SEQ ID NO: 153065 - DNA, 923 bp, Homo sapiens
  misc_feature: GYAE6OF02HJN2Y.22.20.B09.1.454.CMB.1.raw
tcagacatacgcgtcacgaccggtgctcgatttagtgtagtgtgaaggggagagctgctcagttaggacccagagggaaccatggaaaccccagcgcagcttctcttcctcctgctactctggctcccagatattactggagtacgttgtcttggacgcagtctccaggccaccctgtcgctgtcctaccgaaggggaaacgcgccctaccccttcgtcgtaggtaacggccctagttccaagtaaattgttaaaccaacgagtaatagtcgtagcctaggtatccaagcagacgaccgtcggacctacgtccttacccgttctaccttccggttcgtttcggtcggtccggccgacggtacgggcccgtaacgggctaacgtcccgtaggactacggtacttcgaggtcggacgtacggtcggggtccggtacacggtacgttacgtccgttacgaccgtacctaaccgtagggtccggtaccggttaccgttacgggtaaccgttacggtaaacgtttaccgtttacccgtagttaccccttaaatttaccgtttaaacgtttaaccggttacgttacccggttaaggtttttacccgttttaaacgttttaaccgttttaaacgttaccccgtttaaccccggtttacccggtttaaaccgggtttaacccttaacgttttttaccccggggttttaaccggggaaccccgggttaaaccgggggggttaaaccctaaaccgggtttccgggttaaacggggtaacccgggttaaacccgttaaacccggggtaaaaacccgggtttaacgggttccgggtaaccgggttaccccggttaaccggtacccgttaaccccggttcggtttaacccggtttaccggtttacccgtttaccccttaaccccggttttcccccc

SEQ ID NO: 153066 - DNA, 691 bp, Homo sapiens
  misc_feature: GYAE6OF02IDBP5.22.20.B09.1.454.CMB.1.raw
  modified_base (94)..(94): a, c, t, g, unknown or other
  misc_feature (94)..(94): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
tcagacatacgcgtcacgaccggtgctcgatttagtgtagtgtgaaggggagagctgctcagttaggacccagagggaaccatcggaaaccccngcgcagcttctcttcctcctgctactctgctccagatattactggagtacgttgtcttgacgcagtcctccaggcctccgtgtcgcttcgtctccggagggaaagcgccctacctctcggtgtaacggccagtacaagattacgttaacaatagatatgtacgctggtacnacgcagcgactggcacgtcgtcccttctcctgttcgtttcggngtaccggctacggacggccgcggactactcccgtacgagtatacgtcgtaaggtcgtacgacgggttcgggtaccggctaaggccttagtccgagttccctaacgacccggtagtccgggtcggtttagtaccgggtaactggttaaacgcggttttaccacgacgtaactttaattccggtttattcgtaacgttacgtttctttaagttaccgttttaaacgtccgtacccgtttacgttcccgtaagtttccgttcccgttacggaaccgtaccggtaccgtaagtcgtacgtacggaacttaccgaaacggttaacttcggtacgtcggttacccagttaccctaagttcccgttccggtacttccgttaccttacccg

SEQ ID NO: 153067 - DNA, 654 bp, Homo sapiens
  misc_feature: GYAE6OF01EH4GL.48.57.F02.1.454.CMB.1.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggnagaccgtcaccatctcttgttctggcagcagatggaacatcggganctaatttttgtcactggtaccagcaactgccaggacgccggacccccaaactcctcatcctaacaggaatgaataagccgacctcgagggtccctgcccgtattctctggcctaccgaagtctggccaccacacgccctcccgtggcccagtccgaaggacggtacccgtcccgggtaccgaagggtagttcgggtaaggggttagttaagttttttagttggttcggtctttgggtttgggattggaacgtactagttagtaagttgggtttacggttagttttccggggacgggtaacgggtaacctaaacgtcggacccgttacgtacggtccaacggtcccgaacggtcctacccggcccccgttcggtcctacccgttccgttacccgttcccccgtcccttcccgtctacg

SEQ ID NO: 153068 - DNA, 589 bp, Homo sapiens
  misc_feature: GYAE6OF01BVK50.48.57.F02.1.454.CMB.1.raw
  modified_base (190)..(190): a, c, t, g, unknown or other
  misc_feature (190)..(190): n is a, c, g, or t
  modified_base (235)..(235): a, c, t, g, unknown or other
  misc_feature (235)..(235): n is a, c, g, or t
tcagagtatacatacacgaccggtgctcgatttagctcgatatagttgggtttgggagagaagacaggattcaggacaatctccagcatggccggcttccctctcctcctcaccctcctcactcactgtgcagggtcctgggcccagtctgtgttgactcagccaccctcaacgtctgggactcccgggnagaccgtcaccatctcttgtctggcagcagatggaacatcggganctaattttgtcactggtaccagcaactgccaggacgccggccccaaactcctcatctacaggaatgataacgcgaccctcgacgggtccctgcccgattctctggctcaagtctggcaccacacgcctcccgtggccatcagacggccttccggtccgaggagtcggtagggtgtatttttattggtgtcgttggttgggtatcggaacgtactagtcgtaagttggtttacgtagttttcgggacggtacggtacaacgttcgaccgtcgtacggttccgagtcccgaaggtcctaccggcccccgttcggtcctaccgtccttccgttacccccacccttccctcgttaacg

SEQ ID NO: 153069 - DNA, 637 bp, Homo sapiens
  misc_feature: GYAE6OF01DKGS3.48.57.F02.1.454.CMB.1.raw
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgtctggcagcagatggaacagtcggganctaattttgtcacgtggtaccagcaactgccaggacgccgaccccaaatcctcatctaacaggaatgataagccgacctcgacgggtcccngcccgtattctctggctaccaagtctcggcaccacacgtcctcctcgactatcacggaggtaccgtccggtaccggaggacgtagggtacgggttgttaacttttttaagtgttagtcgtttggtttagggacgtaggacgtaacgtagtagtaacgttgggttacgttaggttttccgggacgggaacgggtaacctaaacgtggtacccgtcgttacgggacctacgtacccgaaggtccgtacccgtcccccgtacgggtaccctaccgttccgttacccgttcccccgtcccttccgtcttaacg

SEQ ID NO: 153070 - DNA, 687 bp, Homo sapiens
  misc_feature: GYAE6OF01ENEPI.48.57.F02.1.454.CMB.1.raw
  modified_base (174)..(174): a, c, t, g, unknown or other
  misc_feature (174)..(174): n is a, c, g, or t
  modified_base (194)..(194): a, c, t, g, unknown or other
  misc_feature (194)..(194): n is a, c, g, or t
  modified_base (659)..(659): a, c, t, g, unknown or other
  misc_feature (659)..(659): n is a, c, g, or t
tcagagtatacatacacgaccggtgctcgatttagctcgatatagttgggtttgggggagagaagacaggattcaggacaatctccagcatggccggcttccctcgtcctcctcaccctcctcactcactgtgcagggtcctgggcccaggtctgtgttgactcagccaccctnaacgtctgggacctccgggnagaccgtcaccatctcttgtctggcagcagatggaacagtcgggagctaagtttttgcacgtggtaccagcaactgccagggacgccggacccccaaatcctacatcctaacaggatggaactaacggccgaccctcggacgggtccctcggcccgtattccacgtcggctaccaagtctacgggacctaccgacgtacgcccttacccgaggacccaagtaccaggggaacggtaccgtcccggggtaccggaacgggtacgttacgggtaacggggtttattaagttttttacgtcggttacggttcgtttaggggttttagggaacgttacgggtaacgtaaccgttaagttaggttacgttcgggtttacgtttacggtttaccggggcgggtaacggaccgaacgtcggtacccgtacggtcggtacaccgcccgtagtcctccggccccgtacgtaccncgtcgtccgttcccgcccttcgcttacg

SEQ ID NO: 153071 - DNA, 601 bp, Homo sapiens
  misc_feature: GYAE6OF01CQQ51.48.57.F02.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (289)..(289): a, c, t, g, unknown or other
  misc_feature (289)..(289): n is a, c, g, or t
  modified_base (372)..(372): a, c, t, g, unknown or other
  misc_feature (372)..(372): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagcccaccctcaacgtctgggactcccgggnagaccgtcaccatctcttgttctggcagcagatggaacatcgggganctaattttgtcagtggtaccagcaactgccaggagcggccccaaactccncatctacaggaatgataagcgaccctcgacgggtccctcgcccgattctctggcctcaagtctcggcaccacacgcctcccgnggtccatcagacggaccgtcccggtaccgaggatcggagggtgtagtttttacgttgtgtcttggtttgggtactgacgactagttagaagttggttacgtagttttcgggcggtaacgggtaccgaacgtcgtaaccgtccgtgggtaccacggacccgtaagggcccttacggccccccttcgggtccctacctcgttaccgttcccctaccccttccgtccttacg

SEQ ID NO: 153072 - DNA, 731 bp, Homo sapiens
  misc_feature: GYAE6OF01AHFK6.48.57.F02.1.454.CMB.1.raw
  modified_base (192)..(192): a, c, t, g, unknown or other
  misc_feature (192)..(192): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (360)..(360): a, c, t, g, unknown or other
  misc_feature (360)..(360): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagcccacctcaacgtctgggacctcccgggnacgaccgtcaccatctcttgttctggcagcagatggaacntcggganctaattttgtcacttggtaccagcaactgccgaggacgccggacccccaaactccctcaactcctacgaggaatgaactaggccgacccgtcggaccggggtcccctgccccggtattccncgtcgctaccaagtcgtcggactaccacgtaccgcccttcccgtcggacctacgtcgaacggacgggtacccgttacccgggccggtaacggtacggtagggtacggggtttagtttaacgttttttacgttgggtttcgttccggtttgggtttcggggtagttcggacggtaacgtaggttacgtagtttcgggttacggttacggttttcggggacgggtaacggtaaccgtaacgtccggtacccggtccgtagggtaccgtaccggacccggtacggtcccgtacccggtcccccggttaccggttccctacccggtttcccgttacccggttaacccccctcccgtttcccgtttcccgttaacg

SEQ ID NO: 153073 - DNA, 603 bp, Homo sapiens
  misc_feature: GYAE6OF01BO84I.48.57.F02.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
tcagagtatacatacacgaccggtgctcgatttagctcgatatagttgggtttgggggagagaagacaggattcaggacaatctccagcatggccggcttccctctcctcctcaccctcctcactcactgtgcagggtcctgggcccagtctgtgttgactcagccaccctnaacgtctgggactcccgggnagaccgtcaccatctcttgttctggcagcagatggaacatcggganctaattttgtacactggtaccagcaactgccaggacgccggaccccaaactcctcactctacaaggaatgactaagcgaccctgacgggtccctgcccgtattctctcggcctcgaagtcgtcggcaccgacacgccctcctggaccatcgaagacggaccctccggtacgaggtacgtaggtagggtcgttaagttttacgtggttgtcgtttggtttagggatacggacgtacgtagtagtaacgttcggttacgttacgtttcgggacggtacggaccaacgtacgaccgtccgtaggtcacgccgaaggtcctccgtccccgcggtactaccgtacgttccgtaccctaccctcctctacg

SEQ ID NO: 153074 - DNA, 252 bp, Homo sapiens
  misc_feature: GYAE6OF01E3FQD.48.57.F02.1.454.CMB.1.raw
  modified_base (246)..(252): a, c, t, g, unknown or other
  misc_feature (246)..(252): n is a, c, g, or t
tcagagtatacatacacgaccggtgctcgatttagctcgatatagttgggtttggggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatagnnnnnnn

SEQ ID NO: 153075 - DNA, 850 bp, Homo sapiens
  misc_feature: GYAE6OF01BM0ZU.48.57.F02.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagcccaccctcaacgtcgtgggacctcccgggnacgaccgtcaccatctcttgttcnggcagcagatggaacngtcggganctaattttcgtacacgtgtaccagcaacgtcgccaggacgccggacccccaaactcctaccactctaacgaaggtaactagtaactaacgaccgacccgtacggaaccggggttccccgtcggtaccccgtactttccgtcgtcggtcctaccgtaacgtccgtacggacctaacccgaaccgtacccggtccctaccccgttacggccctaacgttacgaacggtaccgggtacccggtacccgggtaccccggtaaggtacggttagggtaacggggttagtttaacgttttttacggtagtttcggtcgtttagggtttacgggtagttacggtaacggtaactaaggtttacggttaaaggttcggtttaccgggtttacgggttttaccggggtaaccggggttaaccgggtaaacccgtaaacggttacccgggtaacccggtttaccgggttaccgggttaacccgtaccggtaacccccgggtaacgggtaccccggttacccgggttccccccggttaccgggttaccccgttacccgtttacccggtttacccgttacccccccggtttaccccttacccgtttcccgtttaaacccg

SEQ ID NO: 153076 - DNA, 732 bp, Homo sapiens
  misc_feature: GYAE6OF01C4DRQ.48.57.F02.1.454.CMB.1.raw
  modified_base (239)..(239): a, c, t, g, unknown or other
  misc_feature (239)..(239): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagcccaccctcaacgtctgggacctcccgggcagaccgtcaccatctcttgtctggcagcagatggaacagtcgggancttaattttcgtcacgtaggtaccagcaactgccaggacgccggacccccaaactcctcactcctaacgaggaatgataacgccgaccctcggacgggtccctcgcccgtattcctcgtcggcctacgtaacgttcgtcggaccaacccgtacgacgtcccctcccgtcggaccctagtaccgaagggacggtacccgtacccgggtaccggaagggtacgtacgggtacgggttagttttaacgtttttagttcggttcgttcggttagggtttagggacgtacggtaacgtacgtagttacgttaaggtttcgggtttacggttacggttttcggggacgggtaaccggtaaccgtaaccggttccggtacccggttcggttacgggtaccgtaccggaccccggtaacggtcccgtccccggttccccgtccggtaccccgttacccgttccgttaccccgttaccccctacccgttccgttccgttacg

SEQ ID NO: 153077 - DNA, 714 bp, Homo sapiens
  misc_feature: GYAE6OF01C5I2A.48.57.F02.1.454.CMB.1.raw
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagcccaccctcaacgtcgtgggacctcccgggnacgacctcaccatctcttgtctggcagcagatggaacatcggganctaattttgtcactggtaccagcaactgccgaggacgcccggaaccccaaactcctcatactacgaaggaatagaacgtaaacgcccgacccgtaccggtacggggtccccttcgcccggtacttccgtcgtcggtacctaccgaaagttcgtacggacccaaaccaccacgtcccctcccgtacggacctagacgacggaacggcccgtacccggtaccggaaggacgtagggtaggttagtttaattttacgttgtaggtcgttaggttttagggactggaacctagtagtacggttaaggtcggttagttccggttacggggacggaaaccggtaacgaacccgtacggtacccgttcggtaccgggtacgaaccgtaccgggtaaccggtcgttccccggtaacccccgttccgggtacctacccttccccgttaccggtaccccccttacccgtttcctacgtttaaccg

SEQ ID NO: 153078 - DNA, 731 bp, Homo sapiens
  misc_feature: GYAE6OF01DGY2I.48.57.F02.1.454.CMB.1.raw
  modified_base (340)..(340): a, c, t, g, unknown or other
  misc_feature (340)..(340): n is a, c, g, or t
tcagagtatacatacacgaccggtgctcgatttagctcgatatagttgggtttggggagagaagacaggattcaggacaatctccagcatggccgcttccctctcctcctcaccctcctcactcactgtgcagggtcctggcccagtctgtgttgactcagcccaccctcaacgtcgtcgggacctcccgggacacgaccgtccaccctatccttcttagttcgtggcagcagtagtacggaactagtcgggataccttaagttttcgtacacgtggtaaccagacaacgtcgaccgaggaccgcccgacccctaaactcctacactacgtaagaagtangaactaccgccctaccgtcggaccgggtccctacgccgttactctcgtcgtcctacgagtccgtcgacctaccaacgtccgtcccgtaccgtcgacctaagtccggaacggtaccggtaacccgtccggtaccggtaggtaacgttgggtaacggttagttttacgtttttaacggtggttacggtttcgttagggtttcggaagttaccggaacgtacgtaagtacggttaggtttaccgttacggtttacggtttacgggggaacgtaaccgggtaaccttaacggtcgtacccggttcggtacggtaccgaccgtaccgtacggtcccttcccggtcccgtccgttcctaccgttccgttaccccgtccctcccttacgtcgttaccg

SEQ ID NO: 153079 - DNA, 918 bp, Homo sapiens
  misc_feature: GYAE6OF01B1DMV.48.57.F02.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggacctcccgggnagaccgtcaccatctcttgttctggcagcagatggaacagtcggganctaatttttgtccactggtaccagccaacgtcgccaggacgcccggacccccaaactcctcactactaacgaggtaatgaataacggccgaacccgtcggacgggtcccctggccccgtattcgtccgtcggtcctacctaagtccgtacggcccaccgaccaccgtccccttacccgtcgggaccctaacgtaccgaacggtaaccggggtacccgttccccggggtaccccgggtaaagggtaacgttaggggttaacggggtttacggttttaaacgtttttttagttcgggtttacggtttccggttttaggggtttttacgggggtaacggtttacgggtaaccggttaaaccggttaaggtttacgggttaaaacgggtttttcgggggttttaaccggttttacgggttttttacccggggggtaaaccggggggtaaaccggggttaaaaccccgttaaaccgggtttacccggggtaccccgggtttaacccggggttaccgggggttaaccccggtaacccgggtaacccccggtaaaccggggttccccggttaccccccggttcccccccggttacccgggttaccccggttaccccgtttccccggtttacccccgggttttcccccccctccccccggttttacccgtttcccgtttaaacccgg

SEQ ID NO: 153080 - DNA, 881 bp, Homo sapiens
  misc_feature: GYAE6OF01ERH8W.48.57.F02.1.454.CMB.1.raw
  modified_base (192)..(192): a, c, t, g, unknown or other
  misc_feature (192)..(192): n is a, c, g, or t
  modified_base (231)..(231): a, c, t, g, unknown or other
  misc_feature (231)..(231): n is a, c, g, or t
  modified_base (295)..(295): a, c, t, g, unknown or other
  misc_feature (295)..(295): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagcccacctcaacgtctgggacctcccgggnagaccgtcaccatctcttgttctggcagcagtatgaacngtcggatctaagttttgtcactggtaccagcaacgtgccgaggacgcccgaccccaactccctnaacttcctaacgaggtaactgtaagtaacgccgaccctcgggtacgggtcccctcggtacccgtacgttcctaccggtacggtccttaacccgtaaaggttccgtacggaccctaacccgaacccggtcgttaccccccgtaccgttaccggggaccctaaccgtaccggaacgggttaacccgggttacccgttaacccccggggttaccgtaaccggggttaacggttaggggttaacgggggtttagttttaacgttttttaacggtttcggttccgggtttaccgggtttgggttttaacggggtaccgttacgggttaacccggtaagttaacgggttaacggtaacggttttacggggtttaccggttttaaccgggttttccgggggtaaaccgggtaaaccggggttaaacccctaaaccgggttaccgggtacccggttaccgggttccggggtaaccgaacccgggttacccgggtaaccggtcccggttaaccccggtccccccgttaggggtaccccttaccggttcccgtttccccggttaccccccgttccccttcggttacctttaaccgg

SEQ ID NO: 153081 - DNA, 763 bp, Homo sapiens
  misc_feature: GYAE6OF01DA4SY.48.57.F02.1.454.CMB.1.raw
  modified_base (724)..(724): a, c, t, g, unknown or other
  misc_feature (724)..(724): n is a, c, g, or t
  modified_base (731)..(731): a, c, t, g, unknown or other
  misc_feature (731)..(731): n is a, c, g, or t
  modified_base (737)..(737): a, c, t, g, unknown or other
  misc_feature (737)..(737): n is a, c, g, or t
  modified_base (756)..(756): a, c, t, g, unknown or other
  misc_feature (756)..(756): n is a, c, g, or t
  modified_base (759)..(759): a, c, t, g, unknown or other
  misc_feature (759)..(759): n is a, c, g, or t
tcagagtatacatacacgaccggtgctcgatttagctcgatatagttgggtttggggagagaagacaggattcaggacaatctccagcatggccggcttcctctcctcctcaccctcctcactcactgtgcacgggtcctggcccagtctgtgttgactccagcccaccctcgaacgtctcgggacctcccgggcaacgaccgtccaccatcttcttgtcgtggcagccagacgtagaacctaggtacgggatactttaagttttcggtacctacggtaggtaacccagttaacccgaacgttacgggccccgaaaaggggtccgaccccccggtaaccccctaaacttcctaacaccgtttacgaaaccgtaaggtaaccgtagtaacggtaaccggaccccgacccggtttacggggtacccggggtcccctaacggccccttagttccgtccgttaggaccttaccggtacgtcgtacgaccctacctacggaacccgtccctcccgtggaccttaacgtcggaaggaacccgggttcccttacccggggaacggtaggttaaccgtagggggttacgtttaattttttcgtttaagggttcgtcggtttaacgtttgggtaccggttagacccgtaagtcgttagacggtttacggtcgttagtttacgggccgggtaagacggtactacggcgtcggtaccgggtaccacgtcgcgtcnccgttcnccgtanccgttactcccgcctccgnttntacg

SEQ ID NO: 153082 - DNA, 795 bp, Homo sapiens
  misc_feature: GYAE6OF01DDLGS.48.57.F02.1.454.CMB.1.raw
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (460)..(460): a, c, t, g, unknown or other
  misc_feature (460)..(460): n is a, c, g, or t
  modified_base (584)..(584): a, c, t, g, unknown or other
  misc_feature (584)..(584): n is a, c, g, or t
tcagagtatacatacacgaccggtgctcgatttagctcgatataggttgggtttggggagagaagacaggattcaggacaatctcagcatggccgcttccctctcctcctcacccctcctcactcactgtgcacggggtcctgggcccagtctggtgttagacctacacgccctacccgtgtaacgtcgtcggggacctcccgggcacggacccgtcacctattctctttcggtcgtcggacacgcaagagtacgggaactaggtcgggatacttaattttggtacacgtcggtaccagacacgtcgaccgacggtacncccggaaccctaactcncgtactacgtaacgaagatacgtaactaacgcccgacccgtcggtaccggtccgttacgacccgtattccgtcgtacgacctcgtaacggtcgtacgaaccctcgtaacgccgtcccctaccgnggtaaccagtacggaacgtacggacccgttaccgggacggtaacgggtagttacggtagggttaacgttttactttacggtggttcggtttcgtttaggggttacttacgtcggtaaccggttnttaaggttacggttagggttaccggtttaccggttagggggtttaaccggacgggaaccgggtttaaacctacggggttcccgaccggggttccgttaaccgggacccgtaaccgggaacccgtccgggtacccgttacccggtaccccggtacttccgttaccccgttcggttacccccttacccgtttacccgacgttttccgaaacgg

SEQ ID NO: 153083 - DNA, 257 bp, Homo sapiens
  misc_feature: GYAE6OF02I3DIH.48.57.F02.1.454.CMB.1.raw
  modified_base (244)..(257): a, c, t, g, unknown or other
  misc_feature (244)..(257): n is a, c, g, or t
tcagagtatacatacacgaccggtgctcgatttagctcgatatagttgggtttgggggtgtggtggtctccactcccgccttgacgaggctgattactactgtcagtctttgataacaacaatcacgtggtcttcggcggagggaccagcctgaccgtcctaggtcagcccaaggctgccccctcggtcactctgttcccaccctctctatgtatactctgagcgggctggcaaggcgcatagnnnnnnnnnnnnnn

SEQ ID NO: 153084 - DNA, 245 bp, Homo sapiens
  misc_feature: GYAE6OF02HVGKH.48.57.F02.1.454.CMB.1.raw
tcagagtatacatacacgaccggtgctcgatttagctcgatatagttgggtttgggggtgtggtggtctccactcccgccttgacgaggctgattactactgtcagtcttttgataacaacaatcacgtggtcttcggcggagggaccagcctgaccgtcctaggtcagcccaaggctgccccctcggtcactctgttcccaccctcctctatgtatactctgagcgggctggcaaggcgcatag

SEQ ID NO: 153085 - DNA, 603 bp, Homo sapiens
  misc_feature: GYAE6OF02GT8UA.48.57.F02.1.454.CMB.1.raw
  modified_base (237)..(237): a, c, t, g, unknown or other
  misc_feature (237)..(237): n is a, c, g, or t
  modified_base (335)..(335): a, c, t, g, unknown or other
  misc_feature (335)..(335): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcaggaccgtcaccatctcttgtctggcagcagatggaacatcgggancaattttgtcactggtaccagcaactgccaggagccggcccccaaactcctcatctacaggaatgataagcgacctcgaggggtccctgcccgattcnctggctccgaagtctggcaccgacagcctcctggcccatccgagacggaccgtcccggtccggacggagtcggagggtcgtattttaagttgttcgtcgttggtttcgggtattgacgtactagtagtaagttgggttacgtagttttccggggacggtacgggacccgtaaacgtcggtaaccgtccgtagggtccgacgacccgaaggtccgttcggcccccgtcggtcctaccgtccgttcgttccccgtcccttcctcttaccg

SEQ ID NO: 153086 - DNA, 737 bp, Homo sapiens
  misc_feature: GYAE6OF02G7C1Z.48.57.F02.1.454.CMB.1.raw
  modified_base (240)..(240): a, c, t, g, unknown or other
  misc_feature (240)..(240): n is a, c, g, or t
  modified_base (377)..(377): a, c, t, g, unknown or other
  misc_feature (377)..(377): n is a, c, g, or t
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagcccaccctcaacgtctgggacctcccgggcagaccgtcaccatctcttgttctggcagcagatggaacagtcggganctaagttttcgtacacgtggtaccagcaactgccaggacgccggacccccaaacgtcctcactcctaacgaggaatgataacgccgaccctcgacggggtccctcgcccgtattcctcgtggtcctaccgaagtcgnggtacccaccgactacgcccttccgtcggaccctagtccgaagacgggtacccgtccgggtacccggaagggtacgtgggtacggggttacgtttacgttttttaggttacggttgttccggtttagggttttcggggtacttacgggaaccgtaacgtagttacggtaagtttcggggtttacgttacggttttccggggacgggtaaccgggtaacccttaaacggtccggtaaacccggttccgtcggggtaccgtaccggtaccccggaacggtccctcccggtacccccgttccgggttcctaacccggttccgttacccggttccccccggtcccctttccgtacccgttaacg

SEQ ID NO: 153087 - DNA, 817 bp, Homo sapiens
  misc_feature: GYAE6OF02I3RQ0.48.57.F02.1.454.CMB.1.raw
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacagtcgggagctaattttgtcacgtggtaccagcaactgccaggacgcccggacccccaaactcctcacttcctaacgaagggtaactaggaactaacggcccggtacccgtaccggaacggggggttccccctacggacccccggtaactttccgtaccgtcgggtcccttacccgtaaacgttccgttacgggaccctaacccgaccgtaccgtacccccgttccccgttacgggacccctacgtacccggaacggtaccgggtacccgttaccccggggtacccggtaacgggtacgtacgggtacggggttacgtttaacgttttttacggtttcgggttacggttcggtttcgggttttagggtacgttacggtaaccggtaacgtacgttaaggtacgtttacgggtttacggttacggtttttacggggacggggtaacgggtaaacccgttaaacgggttaccggtaaccggtaccggttacgggtaccgtacggacccggtaacggtcccggtaccggtcccccgtacggttaccctaccgttccgttcccgttacccctaccccgttccctacgttacg

SEQ ID NO: 153088 - DNA, 366 bp, Homo sapiens
  misc_feature: GYAE6OF02GTMY0.48.57.F02.1.454.CMB.1.raw
  modified_base (360)..(366): a, c, t, g, unknown or other
  misc_feature (360)..(366): n is a, c, g, or t
tcagagtatacatacacgaccggtgctcgatttagctcgatatagttgggtttggggcagggagggggctaaggtgaggcaggtggcgccagccaggtgcacacccaatgcccatgagcccagacactggacgctgaacctcgcggacagttaagaacccaggggcctctgcgccctgggcccagctctgtcccacaccgcggtcacatggcaccacctctcttgcagcctccaccaaggcccatcggtctccccctggcaccctcctccaagagcacctctgggggcacagcggccctgggctgcctggtcaaggctacttcctatgtatactctgagcgggctggcaaggcgcatagnnnnnnn

SEQ ID NO: 153089 - DNA, 825 bp, Homo sapiens
  misc_feature: GYAE6OF02GWQKF.48.57.F02.1.454.CMB.1.raw
tcagagtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggacctcccgggcacgaccgtcaccatctcttgtctggcagacagataggaacagtccgggagaccttaattttgtaccacgtcgggtaaccagaccaacgtcgaccgtaggaccggtacccggaccccctaaaaccgtcctactactacccgtaacgtaacggaagtacgtaacgtaaacggacccgtaccccgtacggtaacccgggggttcccctaccggtccccgttaacgttccgttaccggtcggtaccgtaccgtaaccgttcgtaccgggacctaacccgaacccgtaccggtccccttcccggtaccggaccctaactacccggtaagtaccgggacccggttacccgggtaccggaacggttcggttacgggtaagggtttacgtttaaacgtttttacggttacggttaccggttcggttagggttttacgggagttacgggtaaccgtacgtaagtacggttacggttacggttacggtttacgtttaccgggacgggtaacggttaaccgtaaaccgtcggtaaccgtccggttacgaccgtaccggaccgtaaccggtcgtccccgtacccggttaccgtaccgtacccgttccgttaccccggttacccctacccgttactccgtttaacg

SEQ ID NO: 153090 - DNA, 881 bp, Homo sapiens
  misc_feature: GYAE6OF02GQW37.48.57.F02.1.454.CMB.1.raw
  modified_base (200)..(200): a, c, t, g, unknown or other
  misc_feature (200)..(200): n is a, c, g, or t
tcagagtatacatacacgaccggtgctcgatttagctcgatatagttgggtttgggggagagaagacaggattcaggacaatctccagcatggccggcttcctctcctcctcaccctcctcactcactgtgcgagggtccgtcgggcccagtctggtgttgactcacgcccaccctcaacgtcgtgggaccgtcccgggnacgacccgtacaccatcttcttgttctggcagcagtagtacggaacagtcggggactcttaagttttgtactacgttcggtaacctacggactaacgttacgaccgaagggaccggcccgggtaacccccctaaaacctccctaccgtacttaccgtaaacggtaaggtaacgtaacgtaaacgtaaccgggtacccggaacccccgtaacgggtacccggggtaccccgtaccggacccgttacgttccgtaccgtcggtacccttaccgtaacggttccgtaccggaccctaacccgtaacgtacccgtccccgttacccggtcccggtaccctacgtaacccgtaacgggtaccggttaacccggtcccgggtaaccgggtaaggtaacgggtacggggtaggtttaacggttttacgtttttaggttacggttcggttaggtttcgggtttaacggtacgtacggttacgtaacgtagtttagtacggttttacggttacggttacgggtttccgggaacgggttaaccggtaaaccttaaccggtacggtacccgggttacgtcggggtaccacgggtaacccgtaacgggtccgttcccgggtaaccccgtcggttacccgtaccgtttcccggttacccgttacccccgtaccttacccgttacgtttaaccgg

SEQ ID NO: 153091 - DNA, 531 bp, Homo sapiens
  misc_feature: GYAE6OF01DNDXG.40.57.F02.1.454.CMB.1.raw
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
  modified_base (402)..(402): a, c, t, g, unknown or other
  misc_feature (402)..(402): n is a, c, g, or t
tcagtctagcgactcacgaccggtgctcgatttagctcgatatagttgggtttgggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggacaaacggtcccaaacttctagtatttangatgtcaactaagcggccctcgagggtcnctgatcgcttctctggctcaagtctggcgacacggcctccctgaccatctctgggctcagactgagntgagctactttattttgctgtctcttatcgctaggctagtttcgcttctccggtaagtcggttcgggcgggtacgggaccggagcgtacggacccgttacctacgtacacgacccgaaggtcctcccgg

SEQ ID NO: 153092 - DNA, 526 bp, Homo sapiens
  misc_feature: GYAE6OF01D61QP.40.57.F02.1.454.CMB.1.raw
  modified_base (331)..(331): a, c, t, g, unknown or other
  misc_feature (331)..(331): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaaggtcccaaactttctgatttatgatgtcactaagcgcctcagggtcnctgatcgcttctctggctcaagtctggcgacacggcctccctgaccatctcgtggctccagactgaggatgaggtcttactttatttttgcttgtcttcttatgctaggctagtttccgcttctcgtaagttcggtcggcgggacgggaccgaggccgtcggaccgtcccgtacgcgacgcccaaggcctcccgg

SEQ ID NO: 153093 - DNA, 531 bp, Homo sapiens
  misc_feature: GYAE6OF01AYMYR.40.57.F02.1.454.CMB.1.raw
  modified_base (329)..(329): a, c, t, g, unknown or other
  misc_feature (329)..(329): n is a, c, g, or t
tcagtctagcgactcacgaccggtgctcgatttagctcgatatagttgggtttggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaacggtccccaaattctgtatttatgatgtcactagcgcctgagggtcnctgatcgcttctctgctcaagtctggcacacggcctccctgaccatctctcgggctcccgagactgaggatggacggtacttactttatttttcgcttgtcttcttatcgtcgtaggtctagtttccgcttcgtcgtaagtcgttcgggcgggacggacgaggtcgtcgaccgttcctacgtcacgcccgaaggccgtcccg

SEQ ID NO: 153094 - DNA, 529 bp, Homo sapiens
  misc_feature: GYAE6OF01BO943.40.57.F02.1.454.CMB.1.raw
  modified_base (333)..(333): a, c, t, g, unknown or other
  misc_feature (333)..(333): n is a, c, g, or t
  modified_base (416)..(416): a, c, t, g, unknown or other
  misc_feature (416)..(416): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacaccccgggcaaaggtcccaaacttctgatttatgatgtcactaagcggccctcaggggtcncgtgatcgcttctctggctccaagtctggcgacacggcctccctgaccatctctgggctccagactgaggatgaggctacttnttttgctgctcttatgctaggctagtttcgcttcgtcgagtggttcggcgggtacgggacccgaggtccgtacggacccgttcctacggtccaggccccgaagggcctcccgg

SEQ ID NO: 153095 - DNA, 500 bp, Homo sapiens
  misc_feature: GYAE6OF01EDMWQ.40.57.F02.1.454.CMB.1.raw
  modified_base (331)..(331): a, c, t, g, unknown or other
  misc_feature (331)..(331): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccggcaaaggtcccaaacttctgatttatgatgtcactaagcggccctcaggggtcnctgatcgcttctctggctccaagtctggcgacacggcctccctgaccatctctggctccagactgaggatgagctacttattttgctgctcttatgctaggctagttcgctctcgaagtgttcggcggagggaccgaggctgccgtcctacgtcagcccaggctcccgg

SEQ ID NO: 153096 - DNA, 499 bp, Homo sapiens
  misc_feature: GYAE6OF01ERP0P.40.57.F02.1.454.CMB.1.raw
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
  modified_base (468)..(468): a, c, t, g, unknown or other
  misc_feature (468)..(468): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaaggtcccaaacttctgtattatgatgtcactaagcggccctnaggggtcnctgatcgctctctggctccaagtctggcacacggcctccctgaccatctctgggctcagactgaggntgaggctattattttgctgcttntatgcaggctagtttcgctctgtagtgttcggcggagggaccgngctgaccgtcctacgcagcccaggctcccgg

SEQ ID NO: 153097 - DNA, 589 bp, Homo sapiens
  misc_feature: GYAE6OF01A1CKQ.40.57.F02.1.454.CMB.1.raw
  modified_base (245)..(245): a, c, t, g, unknown or other
  misc_feature (245)..(245): n is a, c, g, or t
  modified_base (387)..(387): a, c, t, g, unknown or other
  misc_feature (387)..(387): n is a, c, g, or t
tcagtctagcgactcacgaccggtgctcgatttagctcgatatagttgggtttggggggggtctcaggaggcagcactctcgggacgtctccaccatggcctggctctgctcctcctcagcctcctcactcagggcacaggatcctgggctcactctaccctgactcagcctcgctcagtgtccgggtctcctggacagtcagtccaccatctcctgcactggaaccagcagttgattagttggngtcttataactctgtctcctcggtaccaacaacgacccggcaaacggtccctaaacttctgtatttactgatgtacactaacgcggccctacgagggtcgctgactcgcttctcgtcggcctactaagtctacgggcgaacnccggccctcccgagtacctactctccgtcgggccttaccacgacgtcgagagtagtacggtctttacgtttattttcgtcctagtcttcttaagtcgacgtacggtcttacgttcgtacttcgtacgagttcggtcgggcgggtacgggacgcgtccgtcgtacccgtcccgtacgtccacggacccgacggtcctccccgg

SEQ ID NO: 153098 - DNA, 555 bp, Homo sapiens
  misc_feature: GYAE6OF01BJF5V.40.57.F02.1.454.CMB.1.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtncttaataactctgtctctgtaccaacacacccgggnaaaggtcccaaattctgatttangatgtcactaagccggcctgaggggtcnctgatcgcttctcgtgcctcaagtctggccacaccggcctccctgacctatcgtcgtggcctacagactgagatgaggtcttactttattttcgcttgtcttacttatgactacggtctagtttccgcttcgtacggtaagttcggttacgggcgggtaacggggaccgtaggccgtacgaccccgtccgtaccgtacgacgacccgtaacggtccctaccccggg

SEQ ID NO: 153099 - DNA, 654 bp, Homo sapiens
  misc_feature: GYAE6OF01CZHGU.40.57.F02.1.454.CMB.1.raw
  modified_base (348)..(348): a, c, t, g, unknown or other
  misc_feature (348)..(348): n is a, c, g, or t
  modified_base (406)..(406): a, c, t, g, unknown or other
  misc_feature (406)..(406): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcagtcaccatctcctgcactggaaccagcagtgattagttggtgtcttataactctgtctccgtggtaaccaacaacgacccggacaaacggtacccaaacgttctagtatttatgtatgtacactaacgcggccctgacgggtcngtgactcgtcttctcgtcgtctaccgaagttctcggccgaccgtaccgcccttcccgngaccctacttccgtcgtcgggtcctaccgacgtacgtcggaggtacgtagggacgttacttacgttttagttttcgcttcgtactttcttaacgttcgacgtacggttccgtacgttttccgccgttcgttacggttaacggttccgggttaccggggacgggtacgggacccgtacggtccggttaccggtaccccgttacccgtaccggtaccgtaaccgaccccggtaggtccccgttccccggg

SEQ ID NO: 153100 - DNA, 549 bp, Homo sapiens
  misc_feature: GYAE6OF01B4F75.40.57.F02.1.454.CMB.1.raw
  modified_base (228)..(228): a, c, t, g, unknown or other
  misc_feature (228)..(228): n is a, c, g, or t
  modified_base (501)..(501): a, c, t, g, unknown or other
  misc_feature (501)..(501): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccngcagtgatattggtgcttataactctgtctcctggtaccaacaacacccggcaaacggtcccaaacttctgatttatgatgtcactaagccggccctcgagggtcgctgactcgcttctctggctccaagtctggcgacaccggccctcctcgaccatcctcgtgggcctccgagactggaggatggaggtcttactttatttttgcttgcttcttatgcgtaggctagtttcgcttcgtacggtagttcggtcgggcgggtacgggaccggngtccgtcgtacccgttccgtaccgtcaccgcccgaggcccgtccccgg

SEQ ID NO: 153101 - DNA, 693 bp, Homo sapiens
  misc_feature: GYAE6OF01BNA6V.40.57.F02.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (611)..(611): a, c, t, g, unknown or other
  misc_feature (611)..(611): n is a, c, g, or t
tcagtctagcgactcacgaccggtgctcgatttagctcgatatagttggggtttggggggggtctcaggaggcagcactctcgggacgtctccaccatggcctgggctctgctcctcctcagcctcctcactcagggcacaggatccgtgggctcacttcgttaccctgactctagcctcgctcgagtggtccgggtctccgtggactggtcagtcacgatctcngcacgtggaaccngcagtgatagttggtcgtcttataacgttcttcgtaccttacctacggtaacctaacgaaccgacccgggacgtaaaccggtccctaaaccttcgtacgtactttacgtaggtacgtcgtaccgtaacgtaacggccggtacccctacggaacggggtacgcgtaggtacgtcgtcgttactacgtcggtcctacgtaacgtcgtcggaccgtaaccgccggtccctccgtcgaactcgtcctcggtacgggcctaccgaacgtactacggacgtactggacgtacttactttaagtttcgacttcgtcttctagtcgtacgtaggtaccttacgttcgtcgttacgtaccggttaaggtcgggttacccggnggggtaacgggtcgaccggtcgtaccggtaccggttacccggtacggtaccgaacccggtccggtaacggcccgtaccccgg

SEQ ID NO: 153102 - DNA, 693 bp, Homo sapiens
  misc_feature: GYAE6OF01EPMQ1.40.57.F02.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtcgtccggtctcctggacagtcagtcacntctctgcactggaaccngcagtgattagttggcgtcttataactctgtctctcggtaaccaacaacgaccggacaaacggtccctaaacttctagtaatttacngtactcgtacaactaagccgcctcgagggtcntcgactcgtcttctcgtcggcctactaagtcgtacggccgtaacgaccggtccctccgtacgaccctattcctcgtcgggtcctcccgaaggtacctggaacggtacgtcggtacggttacctttaacgtttttacgtttacgtcgttcgttacccgtttcgtttaacgtccggtacgtacgggttaccgttacggttttcccgaccgtttaccgttacgggttaaacggtttcccggggttaccggggaaccggggttaccgggaaccggtacggttccggtaccgttacccggtacccgttacgtaccggtacccgtaacccggtacggtcccgttaccccccggg

SEQ ID NO: 153103 - DNA, 576 bp, Homo sapiens
  misc_feature: GYAE6OF01BZ5FC.40.57.F02.1.454.CMB.1.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (522)..(522): a, c, t, g, unknown or other
  misc_feature (522)..(522): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaaccacccgggcaaaacggtcccaaacttctgactttangatgtcactaagcggccctcgaggggtcnctgatcgcttctctggctccaagtctggcgacaccggccctcccgtgacccatcctcgtcgggccttcccgagacgtggaggtatcggacggtcttactttactttttgcttgtcttctttatggtactaggtcttagtttcgcttcgtacgtaaggttcggttacgggcgggacgggtaccgnggtccgtacggtacccgttccgtaccgtcgacgccccaagggtccgtaccccgg

SEQ ID NO: 153104 - DNA, 562 bp, Homo sapiens
  misc_feature: GYAE6OF01C3K5J.40.57.F02.1.454.CMB.1.raw
  modified_base (335)..(335): a, c, t, g, unknown or other
  misc_feature (335)..(335): n is a, c, g, or t
  modified_base (385)..(385): a, c, t, g, unknown or other
  misc_feature (385)..(385): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggaccaacaacaccggcaaacggtcccaaacttctagatttatgatgtcactaaagcggccctcgacggggtcnctgatcgctttctctgctccaagtctggcgacaccggtcctccctgaccnctctctgggctccagactggagagtgaggtctactttagtttttgacttcgacttcttatcgacgtacggtcttagtttccgccttacgtcgtaaggtcggttacgggcggggtacgggaccgacggtccgtcgtacccgtacctaccggtaccacgcccgaaggtccgtaccccgg

SEQ ID NO: 153105 - DNA, 693 bp, Homo sapiens
  misc_feature: GYAE6OF01DG5OL.40.57.F02.1.454.CMB.1.raw
  modified_base (231)..(231): a, c, t, g, unknown or other
  misc_feature (231)..(231): n is a, c, g, or t
  modified_base (661)..(661): a, c, t, g, unknown or other
  misc_feature (661)..(661): n is a, c, g, or t
  modified_base (673)..(673): a, c, t, g, unknown or other
  misc_feature (673)..(673): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtccaccatcctcctgccactggaaccngcagtgattagttggtgtcttataacttctcgtcctccgtcgtaaccaacaaccgaccggactaaacggtaccctaacttctagtactttagtgtatcgtacaacgtaacgccgaccgtcgacgggtcgtcgtgtactcgtcttcgtcgtcgcctaccgaagtcgtcggaccgaccgaccgtccctacccgtacgaccctactccgttcgtcggtaccctaccgagtaccgttagggacgtagttacggacggttacctttagtttttacgttttcggactttcggttacctttagtttaccggtgtaccggtacggttaccgtttacgtttccgcgttaccgtacggttacgggttcggttccggggaaccgggtaacgggtcccgaacggttccgttacccgggaccccgttaccgtacggtaacccnccgggtaacccncgggttcccctacccccggg

SEQ ID NO: 153106 - DNA, 790 bp, Homo sapiens
  misc_feature: GYAE6OF01A4CNI.40.57.F02.1.454.CMB.1.raw
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (324)..(324): a, c, t, g, unknown or other
  misc_feature (324)..(324): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatccgtgggctcactctaccctgacctcacgcctcgctcagtcgtcccgggtctcctggacngtcagtccaccatctcctgcacgtggaaccngcagtgatattggtntcttataactcgtgtctccgtgtaccaacgaaccgcccgggacaaacggtaccccaaatttctagtattttacngtatcgtaccacgtaacggccgtacccgtggacggggtcctcgtacgacgttcgtcttccgtcgttcgacctaccgtaagtccgtcgggccaacccggacccggtcccttcccgacgtacccgtaacttccgtccgttccgggtaccctacccgtacggtacgtacggtaacgggtaacgttacgggtaacgtaccgttttaaccggttttacgttttttcggctttacgtacccgtttcgtttacggtaccggtaccgttaacggttcccgtttaacggtttcccgtaccgtttaccggtacgggttaaccgggttttcgggttacccggggtaaaccgggtcccgggggttaaccccggtacggttaccggttacccccgggttaacccggtttaaccccggttccggttaaccccggtaccccggtaacccggtaacccggttccccgggttacccccccggg

SEQ ID NO: 153107 - DNA, 713 bp, Homo sapiens
  misc_feature: GYAE6OF01ERB5L.40.57.F02.1.454.CMB.1.raw
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcagtcaccatctcctgcactggaaccagcagtgatattggtgtcttaataactctgtcctcctaggtaccaacaaccgacccggacaaacggtacccaaacttctgtaatttacgtgtactgtaccaacgttaacgccggtcccgtacgtacggggtcgtcgtgacgtcgtcttcctcgtcggtcctaccgtaagtcgtcgggaccgtacggaccggcccttcccgtacgaccctacttcccgttcgtcgggtcctacccgaagtaccgtaggaacggtatacgggacgttacctttacgttttaagtttttcgtcctttgtcctttacgtttacgtcggtacgtacggtaccgtttacggtttccgtacgtttccggtacgttaacggtttcggggttaaccggggtacggggtaaccgggtacccggtacggtccggttaccggtaccccggttaccgttacccggtcccgaaacccgggtaccccgtaacggtcccgtaccccccggg

SEQ ID NO: 153108 - DNA, 584 bp, Homo sapiens
  misc_feature: GYAE6OF01BXIPJ.40.57.F02.1.454.CMB.1.raw
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (479)..(479): a, c, t, g, unknown or other
  misc_feature (479)..(479): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagccagtgattattggtgcttataactctgtctcctggtaccaacaacacccggcaaaggtcccaaaacttctagatttangtatgtcactaagcgccctgacggggtcnctgactcgtnttctcgtgctccaagtctggcacgaccgcctccctcgaccactctccgtgggcctcccgagacttggaggtatggacggtcttacgtttatttttcgcttcgcttacttagtcgtctaggtctacggtttcnccgttcgtacggtaacgttggtccgggtacgggacgggtaccgacggccttacggaccccgttaccgtaccgtacgaccggaccccgtaaggtcccgtcccccgg

SEQ ID NO: 153109 - DNA, 722 bp, Homo sapiens
  misc_feature: GYAE6OF01EUQRA.40.57.F02.1.454.CMB.1.raw
  modified_base (358)..(358): a, c, t, g, unknown or other
  misc_feature (358)..(358): n is a, c, g, or t
tcagtctagcgactcacgaccggtgctcgatttagctcgatatagttggggtttggggggggtctcaggaggcagcactctcgggacgtctccaccatggcctgggctctgctcctcctcagcctcctcactcgagggcacaggatccgtgggctcactcctacctgactcacgcctcgctcagtcgtccgggtctccgtggacagtcagtccaccatcctcctgacacgtacggaaccagcaggtgtattagttggtgtacttaactacctcgttcgttcctccgtaacggtaaccaaaccgaaccggaacccgggaactaaaaccggtacccctaaacgtttctagttaatttagngtagtcgtactaacgtaacggccggtccctggacggggtcacgtagtacgtccgtcgtttcgtcgtcggtccttacgaggtccgtacgggacccgtaccgtacccggtccctccgacgtaacctccgttccgtcggtaccggtccgtacgtaacggtcgtagggacgtacgtggtacgtttacctttagttttagtttcgacgttcgtctttcgttactacggtacgtacgtctttcgggtttccgcctttacgggacgttacgggttcgggtaccgggtaccggggtaacggaccggtcgtaccggttccgtacccgttcccggtacgacccggaaccgtccccggtaacgcccgtaccccgg

SEQ ID NO: 153110 - DNA, 701 bp, Homo sapiens
  misc_feature: GYAE6OF01C4L3I.40.57.F02.1.454.CMB.1.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
  modified_base (517)..(517): a, c, t, g, unknown or other
  misc_feature (517)..(517): n is a, c, g, or t
  modified_base (547)..(547): a, c, t, g, unknown or other
  misc_feature (547)..(547): n is a, c, g, or t
tcagtctagcgactcacgaccggtgctcgatttagctcgatatagttggggtttggggggggtctcaggaggcagcactctcgggacgtctccaccatggcctgggctctgctcctcctcagcctcctcactcagggcacaggatcctgggctcactctaccctgactcagcctcgctcagtcgtccgggtctccgtggacagtcagtcaccatcctcctgctacgtacggaaccngcagtgaatgttggntacttactaactctcgtcctcctacggtaaccaacaaccgacccgganaaacggtaccctaaacttctagtactttagtcgtattacgtactaaccgtaaacggtcccggtaccccttaggtaaccggggtccgtacgttacggacgtttccgtcgttttaccgtccggttcgggtcccttaaccggtaacggttcgtaccgggtacgaccggtaccggtcccctccgtacgaacctctccgtacgtcggctaccgagtacgtagngtactggacgttcttaatttcgttttacgnttcgttcctattacgcgtacgtcgtcgttacgttccgtcgtacgttacggtaacggttcgggtaccgggcgggtaacgggtacccgtagggtcctacccgggtaaccttccgttaccgtaacgacccggtaccgtaacggtccccgtccccggg

SEQ ID NO: 153111 - DNA, 708 bp, Homo sapiens
  misc_feature: GYAE6OF01COFAV.40.57.F02.1.454.CMB.1.raw
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (597)..(597): a, c, t, g, unknown or other
  misc_feature (597)..(597): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcacctcagggcacaggactcctgggctcaccttcctaaccctgactcagccctcgctacagtcgtccgggtctccgtaggacagtcagtcaccntctcngcactggaaccngcagtgatagttggntcttataactctgtctcgtacgtaaccaacaacgaccggactaaacgtaccctaaactctacgtatttactagacttacgtacaactaacgcccggtacccgtacgtacggggtccacgtacgacgttccgtctttccgtacgtacggtaccctaccgtaaggtccggtacggaccgtaacgtaccggtcccgtaccgtacgaacccttcgttccgtaccggttcgggacccttacccgacggttacggaggtaacgggtacttagggtacggttacctttaagttttcgtttcggacttacggtccttacgtttaacgcgtaacgtcggtaccttggtttcccncgtacgtacggtacggttccggtacggaccggtaccggtacgacggttcccgtaccggtaccccgttacgtaaccgacccgaccggtaacccgtccgtccccgtaccccgg

SEQ ID NO: 153112 - DNA, 692 bp, Homo sapiens
  misc_feature: GYAE6OF01B834Y.40.57.F02.1.454.CMB.1.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtcgtccggtctcctggacagtcagtccaccatcctcctgccacgtggaaccngcagtgattagttggngtctataactctcgtcctccgtacggtaaccaacgaaccgacccgggactaaaccggtacccctaaacgtttcgtagttaactttatagtacgttcgtacctaacgtaacgcccggtcccctaggtacgggtccgtctacggtactcgtccttcgtcgtcgtccgtaccgtagtcgtacggccgaccgaccggtccctcccgtcgacctctcgtcgtcggacctcgacgtacgtagaggtactaggtacgttacttacttttagtttcgtacgttgttaccgttattacggtcgacggtacggtacttacggtttccgtcttaccggttacggttaacggttccgggtaccgggaccggggtaacgggtaccggtacggtccgtaccggtaccccgttaccgtaccgtaccggaccgtacccggtacgtccccggttacccccgg

SEQ ID NO: 153113 - DNA, 759 bp, Homo sapiens
  misc_feature: GYAE6OF01CZKTY.40.57.F02.1.454.CMB.1.raw
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatccgtgggctcactctaccctgactcacgcctcgctcagtgtccggtctccgtgacagtcacgtcaccatcctcctgcctacgtacggaaccagacagttgaattagttggtgtacttaacgtaacttcttcgtcctaccgttacggtaaccaaacgaccgaacccgggactaaaaccggtaccctaaactttcgtagttaactttacgtgtacttcgtactaacgtaacggccggaccgttacggacggggtctcgtacgtacgttaccgtctttccgcgttacggtacctaccgtagttcggtacggtaccgtaaccgtacccggtcccttaccggtaccaccgttaccgtccgttccgggtacggtaccctaacccggtacgtaaccggtacgggaacggtagttacgggtacgttaacctttacgtttttaacgttttcgtacgttcggttactttccgttagtccggaccgttacggtccgtttacgtttcgtaccgttacgttacggttacgggttccgggttacggggacgggtacgggtacgaacggttcggtaccggtacccgttccgtaccggtaccacggacccgtaaccggtccgttaccccgg

SEQ ID NO: 153114 - DNA, 763 bp, Homo sapiens
  misc_feature: GYAE6OF01DWRWB.40.57.F02.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (370)..(370): a, c, t, g, unknown or other
  misc_feature (370)..(370): n is a, c, g, or t
  modified_base (408)..(408): a, c, t, g, unknown or other
  misc_feature (408)..(408): n is a, c, g, or t
tcagtctagcgactcacgaccggtgctcgatttagctcgatatagttggggtttgggggggggtctcaggaggcagcactctcgggacgtctccaccatggcctgggctctgctcctcctcacgcctcctcactcgagggcaacgaggactccgtgggctcactcctaccctgactcacgcctcgctcagtcgtccgggtctccgtggactgcagtccaccatcctccngacacgtcgaaaccngctagtcgaattagttcggtcgttacttaacgtaaccttcgtacttccgtacccgttacggaaaccaaaccgaaaccgaccccgggaactaaaaccggttaccctaaactttctacgttatttagngtactacgtaacacgtacggccgaccgtcggcgggtcncgtagactcgtacgttctcgtcgccgtacgtagtcgtacgccgtaacccgccggtccctaccgtacgaccgttacgccgttaccggtcgggtaccctaacggtacgaacggtacgtaacgggtcgtaacgggtacgttaacttttttaacggtttccttttttcgaccggtttacgttacctttacggttacgtacgtccgggttaacggtttacgtttccggtttactcccggttaggttaccggtagggtttccggggttacccgggaggggtaacccggtcggttaacgccggttaccccggttgttacccgaacggttccgaaccggttaacgcccgggtacctccccggg

SEQ ID NO: 153115 - DNA, 720 bp, Homo sapiens
  misc_feature: GYAE6OF01BFLA4.40.57.F02.1.454.CMB.1.raw
  modified_base (312)..(312): a, c, t, g, unknown or other
  misc_feature (312)..(312): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctctgcactggaaccagcagtgattagttggtgcttataactctcgtctcctggtaccaacaacgaccggcaaacggtcccaaacttctgtactttatgtntgtcaacgtaagccggtccctggacgggtcgtctgacttcgtccttcgtcctgggtccctccgtaatccgtcgggaccgtaccacccggtccctcccgtacgtacccgtacttacccgttccgtccggggtcctacccgtacggcgtaggaacgggtagtacggtacggttcctttaacgttttactttttcgtccgttagttccgtttacgtttagtacggtacggtacggtccgtttacgtttccgtacccgtttacgtaccgggttaacgggtttccggttaaccgggggtccggggtaacggggtacccgggacggtcccgttacccgggtaccccgttaacccgggttaccgtacccggaacccgggtaccccggtaaaccgggtcccggttacccccccggg

SEQ ID NO: 153116 - DNA, 730 bp, Homo sapiens
  misc_feature: GYAE6OF01EW4K7.40.57.F02.1.454.CMB.1.raw
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (356)..(356): a, c, t, g, unknown or other
  misc_feature (356)..(356): n is a, c, g, or t
  modified_base (534)..(534): a, c, t, g, unknown or other
  misc_feature (534)..(534): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcagtcaccatctcngcacgtggaaccagcagtgattattggtntacttaataactctgtcctccgtacggtaaccaacaaccgacccgganaaaacggtccctaaattcgtagtatttangtatgtacaacgtaacgccggtcctgacgggtcncgtgactcgtacttctcgtacggtcctacgaagttcgacgggaccgaaccgtaccggtccctcccgtacggtacccttacgttccgtaccggttacggccctaccggaacggtacgtagggaacggtacgtacgggtaacggtttaccgttttaacgttttacgttttcggaccgttntaccgtttcgttaacgccggtacgtacggttccgttaagttccgaccttttggaaccggttacgggtttccggggttaccgggaccgggtaaagggggtacccctaggtcccggttaacccggtaccccgttacccgggtaccgttacccggaacccggtacccccggtaaaccggggcccctttacccccccggg

SEQ ID NO: 153117 - DNA, 724 bp, Homo sapiens
  misc_feature: GYAE6OF01CJW0Z.40.57.F02.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (574)..(574): a, c, t, g, unknown or other
  misc_feature (574)..(574): n is a, c, g, or t
  modified_base (606)..(606): a, c, t, g, unknown or other
  misc_feature (606)..(606): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctggctcactctaccctgactcagcctcgctcagtcgtccggtctcctggacagtcagtccaccatcctcctgcacgtggaaccngcagtnatagttggtntcttataactctcgtctccgtggtaaccaacgaaccgacccggactaaacggtacccctaaaactttcctagttactttagtagacttacgtaccgtaacgtaacggcccggtacccgtcggtacggggtacgcgttacgtacgtccgttcctttccgtcgttcggtacccttaccgtaacgtccgggtcgggacccggtaaccgacccggttcccctacccgtacgaccctacgttcctccgggtcggtcccttacccgaacgttaccgtagggagtacgtacgggtacggtaaccttttagttttacttttcggcttacgttcttnttacgtcgtacggtacttccgttacggtttcnccgtttacggaccgttagggtccgggttcgggacgggtaccgggtacccgtaaggtccttccggaccccgtttacgtacccgtacgacccggaccccgacggttccccgtacccccgg

SEQ ID NO: 153118 - DNA, 775 bp, Homo sapiens
  misc_feature: GYAE6OF01BN5H9.40.57.F02.1.454.CMB.1.raw
tcagtctagcgactcacgaccggtgctcgatttagctcgatataggttggggtttggggggggtctcaggaggcagcactctcgggacgtctccaccatggcctgggctctgctcctcctcagcctcctcactcgagggcaacaggactccgtgggctcactcctaccctgactcacgcctcgctcgaggtcggtccggtctccgtggactagtcacgtccacctatcctacctgacctacgtacggaaccagcgtagtgtattagttcggtactacttaacgtaacctcgttccgttccgtaccgttacggtaaaccaaaccggtaacccggaaccccggggtaacgtaaaacccggttaccctaaaaccgtttcgtaacgttactttacgtacgtacgttacgtaacctaacggtaaccggtcccggtccgtacgggtacgggtccgtcgtacgtcgtacgtccttcgtcgtaccgctacgtacgtcgtacggaccgtacgcccggtcctaccgtacgtaccgtacttccggtcggtcgtaccctacggtacgtaaccggtggtaggtaacgtcggtaacgttcctttagggtttacttcggtaactccgttaacgttcgttaggtaccgtcggttacggtacgttacgttcccgtacgtaccgggtacgtacggggttcggtaccggggaccgggtacggtaccggtacgtcccggtacgtacccggtaccggtacacccgggtaacctccggtaaccggtcccgtaccccg

SEQ ID NO: 153119 - DNA, 698 bp, Homo sapiens
  misc_feature: GYAE6OF01CVDUQ.40.57.F02.1.454.CMB.1.raw
  modified_base (178)..(178): a, c, t, g, unknown or other
  misc_feature (178)..(178): n is a, c, g, or t
tcagtctagcgactcacgaccggtgctcgatttagctcgatatagttgggtttgggggggggtctcaggaggcagcactctcgggacgtctccaccatggcctgggctctgctcctcctcagcctcctcactcagggcacaggatcctggctcactctaccctgactcagcctcgctnagtgtccgggtctccgtggacagtcagtcacatctcctgcactaggaaccagcagtgattagttggtgtcttataactctgtactcgtacgtaaccaacaaccgaccggacaaacggtaccctaaacttctagtatttacgtagattacgtactaactacggccggtacccgtacgacggggtctcgcgtattccgacttctcgtcgtacctaccgtaagtcgtcgggacaccgtaccggtccctacccgtgaaccctatccgtcgtcgggaccttaccgagtacgtaggacgtagtacggtcgttacttacgtttttagtttcggcttacgtacttacttagcgtacgtaggttcttacggtttaccgtcttaaccggtacggttaaaccggtttggggtccgggaaccgggggtaaaccgggtcccgtacgggtacccttaaccggggtacccccgttacttaacccgggttaaccgacccggggtaaacccctacgggtcccctttaacccccgggg

SEQ ID NO: 153120 - DNA, 756 bp, Homo sapiens
  misc_feature: GYAE6OF01BLEWA.40.57.F02.1.454.CMB.1.raw
tcagtctagcgactcacgaccggtgctcgatttagctcgatatagttgggtttgggggggggtctcaggaggcagcactctcgggacgtctccaccatggcctgggctctgctcctcctcagcctcctcactcagggcacaggatcctgggctcactctacctgactcagcctcgctcagtcgtccgggtctccgtggacagtcagtccaccatctccgtgccacgtaggaaccagcagtgtattagttggtgtacttaacttaacttctacggtcctcgttacggtaacctaaaccgaaccgacccgggaactaaaccggttacccctaaacgtttccgtagtatttaagtacgtacttacggtactaacgtaaccgggtccggtacccgtacgggtaccggggtcgccgtacggtacgttccgtcttccgtaccgtcgtccgttaccgtaacgtccgtacggcccgtaacgtccccggtacccttacccgtaccgaaccttccgtccgttaccggtcggtacccgtacccgtaggtaccgtagggtacggtacgttacgggtacggttacctttaacgttttcgttttcggtcgttacgttccgttcgttagtccggacgttacgtcgttacggttacgccgttacggtcgttaacgggtccggttaccggggacggtaacggggaccgtacggtcccgtaccgggtcccgttacccgtaccgaccgtacccgaccgtccggtcccgtccccgg

SEQ ID NO: 153121 - DNA, 763 bp, Homo sapiens
  misc_feature: GYAE6OF01AY0GJ.40.57.F02.1.454.CMB.1.raw
  modified_base (348)..(348): a, c, t, g, unknown or other
  misc_feature (348)..(348): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatccgtgggctcactctaccctgactcagcctgctcagtgtccgggtctcctggacagtcagtcaccatctctgcactggaaccagctagtgatagttggtgtacttaataactctcgtcctccgtacggtaaccaaacaaccgacccggacaaacggtcccaaacttcgtagtattatgatgtcactagccgtcctcgagggtcnctgactcgtcttcgtcgtggcctacgtaacgtcgtcgggaccgtacgacccggtcccttacccgtacgtaccctacttaccgtccggtcggggtacccttacccgaaggtaaccgttagggaacggtacgttacgggaacggtttacctttaaacgtttttacgttttttcggtacgtttacggttaccctttacgtttaacgttcgggtaccgttacggggtacctttaacggttttccggtacctttaccgggttaacccggttaaagggtttccgggttacccgggggtacggggtaacccggggtaaccggaccgggttaccggttacccgggtaccccggtttacccgttaaacccgggttacccaaccccggggaacccgttaaacccggggcccttaaccccccgggg

SEQ ID NO: 153122 - DNA, 725 bp, Homo sapiens
  misc_feature: GYAE6OF01ET59A.40.57.F02.1.454.CMB.1.raw
  modified_base (245)..(245): a, c, t, g, unknown or other
  misc_feature (245)..(245): n is a, c, g, or t
  modified_base (546)..(546): a, c, t, g, unknown or other
  misc_feature (546)..(546): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccggtctcctggaccagtcagtcaccatcctctgcactggaaccagcagtgattattgggtntacttaataacctcttcgtcctccgtacggtaacccaaaccaaaccgtaccccggggactaaaaccggttacccctaaacgtttcgtacgtaattttacgacgtatcgtactaaccgtaacgcccggtacccctaggtacggggtccgcgtagacttccggtcttcgtcgtacggcctaccgtaacgtcgtacggccgtaaccgtcccgtccctccgtcgacctacttccgtacgtcgggtacctacccggaagtacttgggacgtagtacggtacgttactttacgtttttacggtttcncgttacgtcttaacgtttagcggtacggtaacgttccgttacggtttccgtaccgttcggtaacggttacggttcggggtaccgggaccggggtacgggttaccggacggtcccggttacggtacccgttccgttaaccggaccctaaaccgggcctaaacggtcccggttacccccgg

SEQ ID NO: 153123 - DNA, 773 bp, Homo sapiens
  misc_feature: GYAE6OF01AEMFC.40.57.F02.1.454.CMB.1.raw
  modified_base (217)..(217): a, c, t, g, unknown or other
  misc_feature (217)..(217): n is a, c, g, or t
  modified_base (314)..(314): a, c, t, g, unknown or other
  misc_feature (314)..(314): n is a, c, g, or t
  modified_base (388)..(388): a, c, t, g, unknown or other
  misc_feature (388)..(388): n is a, c, g, or t
tcagtctagcgactcacgaccggtgctcgatttagctcgatatagttggggtttggggggggtctcaggaggcagcactctcgggacgtctccaccatggcctgggctctgctcctcctcagcctcctcactcgagggcacaggatccgtgggctcactctaccctgactcacgcctcgctcgagtcgtccggtctaccgtggacagtcagtcaccntctctgcacgtcgaaccagctagtcgtattagttggtatactttaagtaaccttcgtcggtcctccgttacggaaccaaacgtaaccgacccggtanaaaaccgtaccctaaacttcgtagttatttagcgtaacgtcgtaactacgtaacggccgtccctaggagggtcncgtagactcgtcttcgtcgtcggctaccgaggttcgaccggtacgaacccgtaccgtcccgtacctacgtacccgtatcccgttacggtccggaccgtttaccgaagggtaccgttaggggaaacgttcgtaacgggtaacgtttaccttttaacgttttacggttttccgccgttaaccggttgttaccctttaaagggccgtaaccgttacgggttaacccgtttgtttaaaccccgtcggttaaccggtaaacgggtccggttttacgggggtaccggggaaccggttaacggggaccccgttagtaccggtacccggttaaaccccgttcggacccggtaaccgtaaccccggacccggtgtttccccccggtaccccggg

SEQ ID NO: 153124 - DNA, 647 bp, Homo sapiens
  misc_feature: GYAE6OF01EVTSY.40.57.F02.1.454.CMB.1.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (329)..(329): a, c, t, g, unknown or other
  misc_feature (329)..(329): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (538)..(538): a, c, t, g, unknown or other
  misc_feature (538)..(538): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactcctacctgactcagcctcgctcagtcggtccggtctccgtggacagtcagtcacatctctgcnctggaaccngcagtgatgtggtncttatactntntctctgtacaacacgaccggcaaacgtccaaacttcgtgtatttangtatcgcactagccgaccctaggcgggtcnctgtactccgtactcttccgtcgggtacctcgtaaggttcgtacgggacaacgtcccggtcccgttaccctaggacccagtttcccncggtcgggttacccnctaacgggacctagggaacgtcgtggacggttactttaacgttttatttttcggcctttgacccgtttgtttacacgggtcgtaacggtaccggtttagtttacccncgtttccggtaacggtacgtttccggggtacgggaccggggtacggacgggtactcggtaccggtacccttacccgtacgaccgaccgcccgtacggtcccgtccccgg

SEQ ID NO: 153125 - DNA, 656 bp, Homo sapiens
  misc_feature: GYAE6OF01BQQ7Y.40.57.F02.1.454.CMB.1.raw
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
  modified_base (491)..(491): a, c, t, g, unknown or other
  misc_feature (491)..(491): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtccaccatctcctgcactggaaccagcagtgatattggtgcttataacctctgtctcctggtaaccaacaaccgacccggcaaacggtcccaaacttcgtagtatttacngtatcgtacacgtaacgcccggcccgttacggagggtccncgtgatcgtcttctcgtcgcctacagtctgccgactccggcctccctgacctatcctcgtcgggtacctcccaaggtcctggaagggctacgggtacggttacctttacgttttacgtttttcgtaccttcgttcttntttaacgtcggacgtacgggtcctttacgggttctaccttcggttacggtacggtttccgggttaccggggaccggggtacggaacccggtggtccgtaccgggtacccccgttaccggttaacgtcccgaacccggacccgtacgggtcccgttaccccccggg

SEQ ID NO: 153126 - DNA, 717 bp, Homo sapiens
  misc_feature: GYAE6OF01DUBMU.40.57.F02.1.454.CMB.1.raw
  modified_base (248)..(248): a, c, t, g, unknown or other
  misc_feature (248)..(248): n is a, c, g, or t
  modified_base (446)..(446): a, c, t, g, unknown or other
  misc_feature (446)..(446): n is a, c, g, or t
tcagtctagcgactcacgaccggtgctcgatttagctcgatatagttggggtttgggggggggtctcaggaggcagcactctcgggacgtctccaccatggcctgggctctgcctcctcctcacgcctcctcactcgagggcacgaggatccgtgggctcactctaccctgactcacgcctcgctcagtcgtccgggtctccgtggacagtcacgccaccagtcctccgtgacctacgtacggaaccnggcaagtcgattagttgggtatcttaataactctcgttcctcgtacgtaaccaaacgaccgaaccggacaaacggtaccctaaacttcgtagttaatttacgagtactacggtacaacggtaacgtccggacccgtacggacgggtcacgtgtacttcgtcttcgcgttcggacctacgtaagtcgacggtaccgacncccggtaccctaccgtacgacccttacgtaccgtccgtacgggtacctaccggtagaccgtaggacggtaacgtagggtaacggttactttaacgttttagttttcgcgtacgttctttgtaacgtcggtacgtcggtactttcgtacgtcgtacggtacggtacgggttcggtaccggggacggtcccgggtaacggtcgtaccgtcccgggtaccttacccggtacggtaacccgtaacggacccgtaaccggtcccgtaccccccggg

SEQ ID NO: 153127 - DNA, 785 bp, Homo sapiens
  misc_feature: GYAE6OF01CVFSW.40.57.F02.1.454.CMB.1.raw
tcagtctagcgactcacgaccggtgctcgatttagctcgatatagttgggtttgggggggggtctcaggaggcagcactctcgggacgtctccaccatggcctggctctgctcctcctcagcctcctcactcgacgggcacgaggactccgtcgggctcacctcctaccctgactcacgccgtcgcgtcaggtcggtcccgggtctcgtacggacgtagtccgagtccaacctactccgtccgtcgtacacgttacggaaccaggactagtgtagttagttagtagtacttagtacctgtcgtcttaccgtaccgtaaccaaccgtaaccggaacccgggtaactaaaccggtaccccttaaacgtttcgtaagttaactttagtacgtaagttaccacgtaaccggtaccggcccggtaccccggtggggtaaccgggttcctacggtacgtacgtttcgtcccgtttacgtccgttacggtaccccttaacggtacggttacgtccgggaaccgacccgtaacccgtccccgtaacgtccctaacccgtgttcccggtacggtccggtaccctacgaacggtaggtacggtagtacgtcggtaaacgttccgttttagtttgttaccgtcttgtacgtttacgtacgtgtacggtaccgttcgtttaccgtccgttacgtcggtagtcgggtacccggtaggggaccgggttagggacccgtacgtccggttaccggtacccgtttcgacctcggtaacccgccggttaccgcccgtccccgg

SEQ ID NO: 153128 - DNA, 754 bp, Homo sapiens
  misc_feature: GYAE6OF01DADPJ.40.57.F02.1.454.CMB.1.raw
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
tcagtctagcgactcacgaccggtgctcgatttagctcgatatagttggggtttggggggggtctcaggaggcagcactctcgggaccgtctccaccatcggcctgggctctgctcctcctcgacgtcctcctcactcgagggcacgaggactccgtggctcgactctacctgacctcgacgcctacgctcagtcgtccggtctccgtggacagtcagtcaccatctccgtgacacgtcggaaccngcgtagtgacttagttcggagtacttactactctacgtcctcgtacgaacacacgaccggacaacggtacctaacttcgtagtactttacgngtacttacgtactaacgttagccggtaccgtacggacgggttccngtcgtactcgtacttcgcgttcgacctacgtaacgtcgacggtccgaaccggtccgtacccggttccgtaacgaacctcgttccgtacggtccgggtacttacccgagtacggtacggtacggtacgttaccggtacggtttaaccgtttacgttttacgttttcgaccggttttcgttaccgttcgtttaaggccggtaaacggttcggtaaccgtttaccggtttcccggtacgttaccggtacggttaaccggttacgggttacccgggacgggggtcccggtaaccggttccggtacccgtaccgttaaccccgttaccggtacccgttaccggccggtaacccgttacggcccggtttacccccgg

SEQ ID NO: 153129 - DNA, 812 bp, Homo sapiens
  misc_feature: GYAE6OF01EQJG8.40.57.F02.1.454.CMB.1.raw
  modified_base (257)..(257): a, c, t, g, unknown or other
  misc_feature (257)..(257): n is a, c, g, or t
  modified_base (651)..(651): a, c, t, g, unknown or other
  misc_feature (651)..(651): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcgagggcacaggactccgtgggctcaactcctaccctgacctcgacgtcctcgctcgacggtcggttcccgggttcctccgtggactacgtcacgtccaccgtatcctcctgtcacgtcggaaccngctagtgtagttcgttgggtcttacttaactaccgttcgttcgtccgtaccgtacggaacccaacgaacccggaccggtaactaaaccggttaccctaacttcgtagttactttacgacgtactcgtacgtaacggttaaccggcccggtaccgtacggtacgggttccgtcgtagtaccgtcgtaccgtttcaccgtcgtaccgttcgacggttcggccggaccgaccgtcccggtcctacccgtcgaacccgttattcccgtcggtacggtccgtaacggtacgtacggagggtactacggtacgggttacgttacctttagttttacgtttcggaccgttcgttaccgttcggtttaacgcgggtaacttacgggttccgtttaccggttntacccggttacggttacgggtaccggtttaccggggtaaccgggtaccggggtaaacggtcccggttaacgggttacccgttcccggggttaaaccccgttaccgtacccggttaaccggtaccccggtacccgtacgggttcccccttaacccccggggg

SEQ ID NO: 153130 - DNA, 927 bp, Homo sapiens
  misc_feature: GYAE6OF01A18KL.40.57.F02.1.454.CMB.1.raw
  modified_base (214)..(214): a, c, t, g, unknown or other
  misc_feature (214)..(214): n is a, c, g, or t
tcagtctagcgactcacgaccggtgctcgatttagctcgatatagttggggtttgggggggggtctcaggaggcagcactctcgggacgtctccaccatggcctgggctctgctcctcctcagcctcctcactcgagggcacaggactccgtgggctcactcctaccctgactcacgcctcgctcgtaggtcggtccgggtcctccgtaggacngtcacgtccacctattcctaccgtcgacctacggtacggaaccacggtacgtagttacgtagttacggttggttacgtaactttaacttaaccgttcgttaccgttaccgtaccggttaaccggtaaacccaaaccggaacccgggtaccccgggtaaaccggtaaaacccggttaaccccttaaacgtttaccggttagttaacgttttcgaacgttacgttaccgttaaccgaaccggtaaccgggtcccgggttacccggtacgggtaccggggttaccgtcgtaccggttactccggttaccttccggtacgttccggtacccgttaccggtaacggttccgggtaccggtaccgacccggttaacccgggtccccttaccgggttaccgtaacccttacggttccgtaccgggtccgtaaccgtccggtaacgacggttacggacgggtttactacgggttaccgtttacgtttaacgttttccgtttacggtccgtttacgtttaccgttacggttacgtacggttccgtaccggggtttccgtttaccgggttcctaccggttaggttacccggggtaacggtttcgggggtaacccggggtacgggtaacggtaccgggtccgttaccccgggttacccgggtacccgttacccggtaccgtaaccggtaccggttaacccggtccggtccccggggttaccccg

SEQ ID NO: 153131 - DNA, 765 bp, Homo sapiens
  misc_feature: GYAE6OF01A3JCF.40.57.F02.1.454.CMB.1.raw
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcgagggcacaggatcctgggctcactctaccctgactcacgcctcgctcagtcggtccgggtctccgtggacagtcagtccaccatctcctgctactgaaccngcagtgattattggctcttatacttntctctccgtacgtaaccaacgaaccgacccgggactaaaccggtaccctaaacgtttctagttaactttacgtggtaacttcgtaaccgaacgttaaccgggcccggtccccgttacgggtacggggtccgtactcggtaacgtccgtccttcgttacgtcggtaccttaccggtaagttcccgtacgggacccgtacccgacccggtcccctttacccgaacgtaccctacgttccgttccgggtcgtcccgtactacggacgtaggacggtagttacggttacgtaccttttacgttttacgttttcgacccgtttcgttacgttacgtttaggccggttaccgttaagggtcctttaaccggttcgacctttaccgggtacgtaacgggttccggggttaccgggaccggggtaaacggtccggttaaccgcccggtttaaccgggaccccgttacgtaccccggtacgaccccggtacccggtccgtaccccgtcccccgg

SEQ ID NO: 153132 - DNA, 821 bp, Homo sapiens
  misc_feature: GYAE6OF01CQB13.40.57.F02.1.454.CMB.1.raw
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (644)..(644): a, c, t, g, unknown or other
  misc_feature (644)..(644): n is a, c, g, or t
tcagtctagcgactcacgaccggtgctcgatttagctcgatatagttgggtttggggggggtctcaggaggcagcactctcgggacgtctccaccatggcctggctctgctcctcctcagcctcctcactcgagggcacaggactccgtgggctcactcctaccccgtgacctcacgtcctcgctacgagtcggtccgggtctccgtggacacgtcacgtcaccatcctctgacctacgtcggaacngctagtgatagttggttntacttacgtactcgtcgttacctccgtacgtaccaaccgaaccggaacccggtactaaaccggtaccctaaacgtttaccgtaggttactttagtacgtagttacggtacctaaccggtaccggtcccggttacccgtcgggtacgggtcctcgtcgttacgtccgtctttcgtcgtccggtacctacgtaaccggtccgtacgggtaccgtacccggtcccggtcccgtaccccgtagtaaccccgtcctttccggttcccggggtaaccggttcccgtacccgtaacgggttacggtaaggtagggtacccgtttacgggtacggtttactttacggtttttacgtttcgaccgttttaggtaccctttacggttancccgggtacgttacggttcctttaaccggttcgcccgttacggtccggggttaggtccgggtacggggttacccggaccgggtaacccggtccggttcccgggttacccggaccccggttaccgttacccgggacccgtaacccgggtaaccctcccggggtccttcccccccgggg

SEQ ID NO: 153133 - DNA, 773 bp, Homo sapiens
  misc_feature: GYAE6OF01B0PL4.40.57.F02.1.454.CMB.1.raw
  modified_base (386)..(386): a, c, t, g, unknown or other
  misc_feature (386)..(386): n is a, c, g, or t
  modified_base (433)..(433): a, c, t, g, unknown or other
  misc_feature (433)..(433): n is a, c, g, or t
tcagtctagcgactcacgaccggtgctcgatttagctcgatatagttgggtttggggggggtctcaggaggcagcactctcgggacgtctccaccatcggcctgggctctgcctcctcctcacgcctcctcactcgagggcacgaaggactccgtggcctcacctcctaccctgacctcaccgtccgtcgtcctcgtacggtcggtcccgggtctaccgtacgactacgtcacgtccaacctctcctccgtgaccgtacgtaacggaacctaggtacgtagtgtaagtttacggttggtacttacttaacgttacctcgtacgtccgttacgtaaccgtaaccaaaccggaccgtaaccggaacgtaaaccgtacccttaacgttnacgttatctagtactcgtaacacgtcggacccgtcgtacggcggtcncgttacgcttacgtctcgtacggtcgaccgttacgtacgttcggcgtacccgtaccgacccgttcccgtaccgaccgtaccgtaccgttaccggtaccggttcggtaccgtaccgtacgtaacggtacggtaacggtacgtacggttacgtttaaccgttttcgtttacggttcgttactcgttaaaaccgttcttacggtacgtacgttacgtcgttcggtttccgtcggtacggttacgtacgggttcggggcggtaacgggccggtaccgccggtccgtaaccggtcccgttacgtacccggtaccgacccggtaccggcccgtcccggtcccccgg

SEQ ID NO: 153134 - DNA, 714 bp, Homo sapiens
  misc_feature: GYAE6OF01EZE0W.40.57.F02.1.454.CMB.1.raw
  modified_base (231)..(231): a, c, t, g, unknown or other
  misc_feature (231)..(231): n is a, c, g, or t
  modified_base (350)..(350): a, c, t, g, unknown or other
  misc_feature (350)..(350): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtcgtccgggtctccgtggacagtcagtcaccatctcctgcacgtggaaccngcagtgattattgttacttataactctagtctcctgtaaccaacaaccgaccgggacaaacggtccctaaacttctagtatttagtgtactcgtactactacgccgccctgacgggtcnctgatcgtcttctcgtcggctaccgaacgtcgtaggaccgacgaccggtacctccgtacgtaccctatccgttcgtcgggtacctacccgagtaccgttggaacgggtacgtcgggaacggttacctttaacgttttacgtttttcgccgtttacgttccgttacgtttacgtacggtaccgtacgggttaccgttacggtttcccgtccgttaccgttacgggtaacggtttccgggttacccggggaccggggtaaccggggtaccggtacggtaccggttaccggttacccccggttaccgttaccggtacccgtaacccggtaccccggtaaccgggtcccgttccccgggtaccccccg

SEQ ID NO: 153135 - DNA, 742 bp, Homo sapiens
  misc_feature: GYAE6OF01AZTA5.40.57.F02.1.454.CMB.1.raw
  modified_base (146)..(146): a, c, t, g, unknown or other
  misc_feature (146)..(146): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (350)..(350): a, c, t, g, unknown or other
  misc_feature (350)..(350): n is a, c, g, or t
tcagtctagcgactcacgaccggtgctcgatttagctcgatatagttgggtttggggggggtctcaggaggcagcactctcgggacgtctccaccatggcctgggctctgcctcctcctcagtccctcctcactcagggcacaggntccgtgggctcactctaccctgactcagcctcgctcagtcgtccggtctctggacngtcagtcnctagtcctcgtgccacgtcggaaccnggtacaggtcgattagttcggttgtacttactaacgtactgtaccttccgtcggtaacctaaacaaccgtacccgggactaacgtaccctaaactttcctagtattagtacgtntacgtactaacgtaacgccggtaccgtcgtaacgggtctacgtcgtacgtcgtcttctacgtcggtcctaccgtaacgtcgttacggacccgtaacgtacccggtcctacccgtacgtaccctacgttccgttccggtcggtacccgtaccctcggttaacgacggttaacggtacggtacggaacggttccttaacggttttaacgttttccggtacttgttacgtaccgttacgtacggtaccggtacggttccgtttacgttactccgttacggtaccggttaggtccgggttccggaacggggttccggaggtacccggtacgtaccccgggtaacctcccgggttaccgaccgtaacccggtactcccgggtccgttaacccccggg

SEQ ID NO: 153136 - DNA, 712 bp, Homo sapiens
  misc_feature: GYAE6OF01CWJFN.40.57.F02.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcaggcacaggatcctgggctcactctaccctgactcacgcctcgctctagtcgtccgggtctccgtggacagtcagtccacatcactgcactggacngcagtgatgtgtnacttataactctgtctccgtaggtaaccaacgaaccgaccggacaaacggtaccctaaacttcctagtactttatcgtattcggtactaaccgtaagccggtccccttcggaacggggttcctcgtcgtacgtccggtactttccgtacgtcggtaccttaccgtaacggttccgtcgggacctaaccggtacccgtcccttacccgtcgaaccttacgtccgttccggtcggtaccctaccgtaggtacgtaacgggaggttacgtacggtacgttaccgtttacttttacgtttttcgaccttacgtctttacgttaacgtcggacgtacggttcttacgttcccgtactttccggtaacggttaacggttccgggttccgggaacggggtaccggtaccgtcggtactacccgggtacccgttacccgtacggtacccgccggtaaacccgtggtccgtaccccccgg

SEQ ID NO: 153137 - DNA, 706 bp, Homo sapiens
  misc_feature: GYAE6OF01BX49P.40.57.F02.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatccgtgggctccacttcctaccctgacctcacgcctcgctgagtcgtccgggtctccgtggacngtcagtcacatctcctgcacgtaggaaccngcgagtgattacgttggntacttataacttctacgtcttccgtcgtaaccaacaaccgccggacgtaaacggtccctaaactttcgtagtatttagagtatgtccaacgtaacgcccggtcccgtacggacggggtcctacgtgtactcgttaccttcgtccgtcggtacctacgtaacggtccgtacggccgaccgaccggtcccctccgtacgaccctacgtcctcgtcggtcctacccagcgtaggacggtagtaggtacgttctttacgttttacgttttcgacgttcgtccgttattaccgtacggacgtaaccgggttcgtttaacgggttcccgttccgttacggtaacggttacgggttcgggtacccgggtaccggggaacgggttaccgacggtccggtaccgtcccggtacccttacgggacctacccgggaccctacgggtcccgttaacccccggg

SEQ ID NO: 153138 - DNA, 734 bp, Homo sapiens
  misc_feature: GYAE6OF01B96Y7.40.57.F02.1.454.CMB.1.raw
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (577)..(577): a, c, t, g, unknown or other
  misc_feature (577)..(577): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcgagggcacaggatccgtgggctcactctaccctgactcacgcctcgctcagtcgtccgggtctcgtggacngtcngtcacctatccgtctgctacgtacggaaccgagctagtagatttagttggtacgtacttaacgtaacttcgttcgtctccgtacggtaaccaaacgtaaccgaacccgggtacgtaaaaccggtaccctaaactttaccggtataacgtttaactacgtagtacgtacgtaacgtaaaccggccggtaccccgtaggtacgggtccgtacgtcggacgttccgttaccgtcgttccgtcgtaccgtaccgtacgttcggtcgtaccgtaccgacccgtcctacccgtacgtaccctacgtccgtccgtacggtcctaccgtaacggtacgtggacggtagcgggttacgtacctttagtttacggtttcncgtttacgtaccgtttagttacgttcgtcgtacgttcgttacgttcggtacgttccgtaacggttcgggtcggtaccggggacgggtacccggaacggtcgtaccggtccgggtacctacggtaccgacgtacgacccgtaccggtccggtaccccg

SEQ ID NO: 153139 - DNA, 498 bp, Homo sapiens
  misc_feature: GYAE6OF02FGLTF.40.57.F02.1.454.CMB.1.raw
  modified_base (332)..(332): a, c, t, g, unknown or other
  misc_feature (332)..(332): n is a, c, g, or t
tcagtctagcgactcacgaccggtgctcgatttagctcgatatagttgggtttggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaaacttctgatttatgatgtcactaagcggccctcaggggtcnctgatcgcttctctggctccaagtctggcgacacggcctccctgaccatctctgggctccagactgaggatgagctacttattttgctgtctcttatgcaggctagttcgctctcgagtgtcggcggagggaccgagctgaccgtcctacgtcagcccaggctccg

SEQ ID NO: 153140 - DNA, 519 bp, Homo sapiens
  misc_feature: GYAE6OF02IFN0N.40.57.F02.1.454.CMB.1.raw
  modified_base (336)..(336): a, c, t, g, unknown or other
  misc_feature (336)..(336): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaaggtcccaaaacttctgatttatgatgtcactaaagcggccctcagggggtcnctgatcgcttctctggctccaagtctggcgacacggcctccctgaccatctctgggctccagactgaggatgaggctacttatttttgctgctcttatgcaggtctagtttcgcttctcgtaagttgttcgggcggacgggaccgagcgtcgaccgttcctacgtcacgcccgaggctcccgg

SEQ ID NO: 153141 - DNA, 510 bp, Homo sapiens
  misc_feature: GYAE6OF02G9RL7.40.57.F02.1.454.CMB.1.raw
  modified_base (334)..(334): a, c, t, g, unknown or other
  misc_feature (334)..(334): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcagggggtcnctgatcgcttctctggctcaagtctggcgacacggcctccctgaccatctctgggctccagactgaggatggaggcttacttattttgcttgcttcttatgctaggctagtttcgctctcgagtgttcggcggngggaccgngtcgtgaccgtctacgtcacgcccaggctcccgg

SEQ ID NO: 153142 - DNA, 507 bp, Homo sapiens
  misc_feature: GYAE6OF02JCV9D.40.57.F02.1.454.CMB.1.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
tcagtctagcgactcacgaccggtgctcgatttagctcgatatagttgggtttggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttangatgtcactaagcggccctcaggggtcnctgatcgcttctctggctccaagtctggcgacacggcctccctgaccatctctgggctccagactgaggatgaggctacttattttgctgtctcttatcgcaggtctagtttcgctctcgaagtgttcggcgggagggaccgagctcgaccgtcctacgtccacgcccaggctccg

SEQ ID NO: 153143 - DNA, 677 bp, Homo sapiens
  misc_feature: GYAE6OF02GVU31.40.57.F02.1.454.CMB.1.raw
  modified_base (307)..(307): a, c, t, g, unknown or other
  misc_feature (307)..(307): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccggtctcctggacagtcagtcaccatctcctgcactggaaccagcagtgattattggtgcttataactctgtctcctggtaccaacaacacccgggacaaacggtcccaaacttctgtatttangatgtcactaagccgccctcgaggggtcgctgatccgcttctcgtcggtcctaccgaagtccgtgggaccgtaccaccgggtcccctcccgtacgaccctactccgtcgtcgggtccctaccgaacgtaccgttcggacggtagtacgggtacggtccgtttaacgtttttaagtttttccggtactttcggtccgtttacgttttaacgttcggtacgtacgggttaccgttacggttttccgtaccgttccgtaccggttagttccgggtttcgggaccggggtaacggggtaccgtaggtcccgtacggtacccggttacccgtacggtcccgaaccggtaccccgtaagggtcccttacccccggg

SEQ ID NO: 153144 - DNA, 609 bp, Homo sapiens
  misc_feature: GYAE6OF02J2YEJ.40.57.F02.1.454.CMB.1.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacgacccgggcaaacggtcccaaacttctagtactttangatcgtcactaagcgccctcgaggggtcnctgatcgcttctcgtggctcgaagtctggacacaccggcctccgngacctatcctcgtggcctccgagtaccgtggagtctggacggtaccttagttttacttttcgccttgtaccttcttagtcgtccgtaaggtccttacggttccaccttccgtacggtaacgtttcggttccggggtacgggaaccggggtccgacgttcccgttacggaacccgtttcccgtaaccggccgtacccggtaccccggtacggtcccgttcccccggg

SEQ ID NO: 153145 - DNA, 509 bp, Homo sapiens
  misc_feature: GYAE6OF02I8OF6.40.57.F02.1.454.CMB.1.raw
  modified_base (304)..(304): a, c, t, g, unknown or other
  misc_feature (304)..(304): n is a, c, g, or t
  modified_base (475)..(475): a, c, t, g, unknown or other
  misc_feature (475)..(475): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacacacccgggcaaaggtcccaaacttctgactttangatgtcactaagcgccctcgaggggtcgctgactcgcttctctggctcaagtctggcgacacggcctccctgaccatctctgggctccagactgagatgagtcttactttatttgctagtcttcttatgcgaggctagttcgactctcgagtcgttcggcggagggaccgnggctgccgtcgtacgtcgacgccacggctcccgg

SEQ ID NO: 153146 - DNA, 639 bp, Homo sapiens
  misc_feature: GYAE6OF02F61KQ.40.57.F02.1.454.CMB.1.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacgacccgggacaaacggtcccaaattctgtatttancgatcgtacactaagcgccctcgaggggtcnctgatcgcttctctggctcgaagtctggccgacgaccggccctcctcgaccactctcgtcgggcctccagactggaggagtggacggtctttaacgttttagttttcgccttaggtcctttacgttaacttcggaccgttacgggtccttaccggttttccgccgtttaccgtacgttaaggttcgggttaccgggtaccgggggtaacggggtacccgtaacgggtcccgttacgggtaccccgttacccggttaaccggtccgtaaccggaccccgtaacgggtcccttacccccggg

SEQ ID NO: 153147 - DNA, 557 bp, Homo sapiens
  misc_feature: GYAE6OF02IRX78.40.57.F02.1.454.CMB.1.raw
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcagtcaccatctcctgcactggaaccagcagtgatattggtgcttataactctgtctcctggtaccaacacaccgggcaaaggtcccaaacttctgatttatgatgtcactaagccggcctcgaggggtcgctgatcgcttctctggctcaagtctggcacacggccctcctgaccactctcgtggctccagactggacggatgacgcttactttattttgactgtcttcttagtcgacaggtctacgtttcgcttcgtcgtaacgttggttaccgggcgggtaacgggaccgtaggccgttacggacccgttccgttaccggtccgaccggacccgtaacggtccgtaccccgg

SEQ ID NO: 153148 - DNA, 584 bp, Homo sapiens
  misc_feature: GYAE6OF02HVAWP.40.57.F02.1.454.CMB.1.raw
  modified_base (447)..(447): a, c, t, g, unknown or other
  misc_feature (447)..(447): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccggcaaacggtcccaacttctgtatttatgatgtcaactaagccggccctcgaggggtccgcgtgatcgtcttctctcgctccaagtctggcacgacggccctcccgtgacctatccgtgtcgggcctcagactggaggatggaggtctacttttagttttgcttcgcttnttatgacgaggtcgtacgtttccgcttccgtacggtagttcgggttcgggacgggtaacgggtaccgacggtccgttacggtaccccgttaccgtaccggtaccgtaccggtaccccgtaggtcccgttacccccgg

SEQ ID NO: 153149 - DNA, 630 bp, Homo sapiens
  misc_feature: GYAE6OF02G3ITB.40.57.F02.1.454.CMB.1.raw
  modified_base (228)..(228): a, c, t, g, unknown or other
  misc_feature (228)..(228): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccngcagtgatagttggtgcttataactctgtctcctggtaccaacaacgacccgggcaaacggtcccaaacttctagtatttagtgatgtcacgtaagccgtcctcgaggggtcgctgatcgcttctctacggtctcccgtaagtcctaggccgtacgaccgggtccctccgtcggtacccacgttccgtcgtcgggtcctccgacgtacctggacggagtggtaggtaccgtttaacttttacgttttagccgttgtcgttcttagtcgtacgtacggtcgttagtttcgcttcgtacggtaacgttcggttccggggacggtaacggggtaccggtaggtccgttacggtaacccggttcccgttacggtaccacgggtacccctaagggtccctacccggg

SEQ ID NO: 153150 - DNA, 564 bp, Homo sapiens
  misc_feature: GYAE6OF02G6IYQ.40.57.F02.1.454.CMB.1.raw
  modified_base (228)..(228): a, c, t, g, unknown or other
  misc_feature (228)..(228): n is a, c, g, or t
  modified_base (349)..(349): a, c, t, g, unknown or other
  misc_feature (349)..(349): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccngcagtgatattggtgcttataactctgtctcctggtaccaacaacacccgggcaaacggtcccaaacttctgtatttatgatgtacactaagcggccctcgaggggtcgctgactcgcttntctggctccaagtctggcgacgccggcctcccgtgaccatcctctcgggcctccgagactggaggatggacggtcttacgtttattttcgctgtcttcttatcgctaggtcttagtttccgcttcgtcgtaagttcggttccgggcgggtacgggaccgtacggtccgtacggtacccgttccgtaccggtcaccggacccgacggcctccccgg

SEQ ID NO: 153151 - DNA, 553 bp, Homo sapiens
  misc_feature: GYAE6OF02JDWAQ.40.57.F02.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (335)..(335): a, c, t, g, unknown or other
  misc_feature (335)..(335): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccngcagtgatattggngcttataactctgtctcctggtaccaacaacacccggcaaaggtcccaaacttctagatttatgatgtcactaagcggccctcgaggggtcgntgatcgcttctctggctcagtctggcacgacgcctcccgtgacccatcctcgtgggcctccgagtctggacggatgaggtcttactttattttcgctgtcttcttagtgcgtaggtctagtttccgcttccgtacgtaagttcgtttcggggacgggtacgggaccggtagtccgtcgtacccgttcgtacgtccgacgtcccgagtcccgtccccgg

SEQ ID NO: 153152 - DNA, 618 bp, Homo sapiens
  misc_feature: GYAE6OF02H71QH.40.57.F02.1.454.CMB.1.raw
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
tcagtctagcgactcacgaccggtgctcgatttagctcgatatagttgggtttggggggtctcaggaggcagcactctcgggacgtctccaccatggcctgggctctgctcctcctcagcctcctcactcagggcacaggatcctgggctcactctaccctgactcagcctcgctcagtcgtccggtctcctggacagtcagtcaccatctcctgcactggaaccagcagtgatagttggngcttataactctgtctcctggtaaccaacaacgacccgggacaaaacggtacccaaacttctagtatttacngatgtacactaagcgcctgagggtcnctgatcgcttcnctaggctacgaagtctgcgtaccncggtcctccgtagaccactctcgtcggtcctacgtacgacttcggagtagttacgaggtaccttacgttactttttgcctacgttcttccgtttaagtcgtacgtaaggtacctcgtttccggtcttaccgtagtaacggttcggttccgggtacgggtaacgggaacccgtacggtccgttaccgggtaacccgttcccgtaacggttcccgaacggttaccccgacggtccttacccccgg

SEQ ID NO: 153153 - DNA, 671 bp, Homo sapiens
  misc_feature: GYAE6OF02II2PI.40.57.F02.1.454.CMB.1.raw
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcagtcaccatctcctgcactggaaccagcagtgatagttggtgtcttataactctgtctcctggtaccaacaacacccggcaaacggtacccaaacttctgtatttatgtatgtacactaagccgccctcgacggggtcgctgactccgctttctcgtcggccttaccgaagtctcggacgaccgaccggtccctcccgtcgaccctacttaccgtccgttcgggaccttcccgaaggtacctagggaacggtagttacggaacggttactttaccgtttttaagttttttcgccgttacggtacctttcgtttaacgttcgaccgtaggtccgttaacgttttccggccttacgttaccgtaaggttccggttccggggacggggtaacgggacccggtaggtcccgttacggaaccccggtttccgtaaccggttcccgacggaccccgtacggccgttacccccgg

SEQ ID NO: 153154 - DNA, 703 bp, Homo sapiens
  misc_feature: GYAE6OF02G30JY.40.57.F02.1.454.CMB.1.raw
  modified_base (246)..(246): a, c, t, g, unknown or other
  misc_feature (246)..(246): n is a, c, g, or t
  modified_base (384)..(384): a, c, t, g, unknown or other
  misc_feature (384)..(384): n is a, c, g, or t
tcagtctagcgactcacgaccggtgctcgatttagctcgatatagttgggtttggggggggttcgtcgaggaggcgagcactcgtcgggacgtctccaccatggcctgggctctgctcctcctcacgcctcctcacctcgagggcacaggatccgtgggctcactcctaccctgactcacgcctcgctccgagtcgtccgggtctcctggacagtcagtcactatcctcctgcacgtaggaaaccngtcaagtcgtaatgttggacgtcttaataactcgtgtctcttcggtaacctaacaaccgacccggacaaaccggtaccctaaaaccttctacgtaacgtttatacgatcgtactacaaacgccgcctacgtagggtcncgtcgacgtcgcttctcgttacggctccgtaacgtcgtacgggcctacgaccgtcccgtacccttacgggaaccctacgttccctacggtccgggtaccctaccgagtaaccgtgggtaacgaacgtttcgggaagtaccgtttaacttttagttttacgtcctttaggcttttaccgttagttccgacgttaaggcccgtttgtttacccgtcggttcccttaggtaaccgggttggtccggggtaacgggagggtacccgagttcggaacggtccgttaacccgtgtaccgtacgcccgtacgggttccctacccgg

SEQ ID NO: 153155 - DNA, 556 bp, Homo sapiens
  misc_feature: GYAE6OF02IHK85.40.57.F02.1.454.CMB.1.raw
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccggacaaacgtcccaaattctgatttangatgtcactaagcggcctcgaggggtcnctgatcgnttcnctgctcaagtcngcacacggccctccctgaccatctcgtggctccagacgtagagatgaggtcttactttatttttcgcttgtcttcttagtcgtactaggtactagtttccgcttacgttcgaacggttggttacggacgggacgggtaccgaggtccgttacgaccccgttacgtaccgttccgacggtacccgaacggtcctaccccgg

SEQ ID NO: 153156 - DNA, 652 bp, Homo sapiens
  misc_feature: GYAE6OF02G4W18.40.57.F02.1.454.CMB.1.raw
  modified_base (229)..(229): a, c, t, g, unknown or other
  misc_feature (229)..(229): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcagtcaccatctcctgcacgtgaaccngcagtgatagttggtgcttaataactctgtccttccgtacggttaaccaacaaccgacccgggactaaacgggtacccctaaacttctagtatttagtgacttgtacctaacgtaagccggtaccctcggaggggtctcgtcgacgtcgtctttcgtcgtcggacctcgaacgttcgtacggccgacgtaccggtccctccgtcgaccctacgtccgtccgtcgggtcctaccgagtacgtacggaggtacgtaggtacggtacgttacttttagtttcgacgttctcttacgtagttcgacgtggtctagttccgtcttcgtacgtagttcggtaccgggtcggaacgggtaccgtacggtcgtaccggtacccgttaccggtaccgtaccgaccggtacccgtaggtcccgtacccccggg

SEQ ID NO: 153157 - DNA, 696 bp, Homo sapiens
  misc_feature: GYAE6OF02IKKNO.40.57.F02.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
tcagtctagcgactcacgaccggtgctcgatttagctcgatatagttggggtttgggggggggtctcaggaggcagcactctcgggacgtctccaccatggcctgggctctgctcctcctcagcctcctcactcagggcacaggatcctgggctcactctaccctgactcagcctcgctcagtgtccggtctccgtggacngtcagtcaccatctcctgcactcggaaccngcagtgatagttggtgtcttatactctgtctcctcgtaccaacaaccgaccggacaacggtaccctaacttctagtattatgtactgtacacgtacgccggacctcggacgggtcgtcgtgacgtcgtctttctcgtcgtactaccgtaacgtcgtacggaccgtaccgaccggtcccctcccgtacgaccctacgttccgtcggtcggtcctccgtaacgtacgtaggtaacggtgtacggtacggttacctttaacgttttagttttcgtcgttacgttccgtttacgttacgttcggtaccggtacggttccgttacgtttcccgtcgttaccgtacggttaacggtttcgggtaccgggtaccggggtaacgggtacccggtacggtacccggtaccggtacccggttacccggttaccggtacccgaccggtacccggtaccggtccccgtacccccggg

SEQ ID NO: 153158 - DNA, 572 bp, Homo sapiens
  misc_feature: GYAE6OF02IB1EU.40.57.F02.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctctggtaccaacaacgaccggcaaacggtccaaacttctagtatttangatgtcactaagcgccctcgaggggtcncgtgatcgnttctctgctcagtctgcgcgacggcctccgtgaccactccgtctcgggcctaccgagactggaggagtggagtcttactttagtttttcgctgtcttcttagttcgcgtagcgttacgtttcgcgttcgtacgtaagttcggttacgggaccgggtacgggaccggtacggccgttacggacccgttacccgtacgtaccgaccgtacccgtaccggtccgtacccccgg

SEQ ID NO: 153159 - DNA, 781 bp, Homo sapiens
  misc_feature: GYAE6OF02IPAK8.40.57.F02.1.454.CMB.1.raw
tcagtctagcgactcacgaccggtgctcgatttagctcgatatagttgggtttggggggggtctcgaggaggcagcactctcgggacgtctccaccatggcctgggctctgctcctcctcagcctcctcactcaggcacaggatcctgggctcactctaccctgactcagcctcgctcagtgtccgggtctcctgacagtcagtcaccatctcctgcactggaaccagcagtgatagttggtgtacttaataacttctgtccttcctggtaacccaaacaaccgaccccgggacaaaacggtcccaaaacttcgtagtactttagcgtatgtaccacgtaacggccggtccctacgacgggggttccgacgtagtaacgtccgtcctttcgtccgttgggtccctaccgtaacgttcgtacggtaccgaaccgtacccgggtcccttacccgtagaacccctagtttaccctccggtgggtaccctaccgtaacgtacgtaggaagggtacttacgggtaaccgggttaccttaaaccgtttttttacgtttttcggacccgtttgttaaccgtttaccgttttaagtacccggtacggttaacgggccttttaaaccgggtttttcccgaccgtttaaccgttacgggtaaaccgggtttcgggtaacccgggtacgggggtaaaccgggtaaccccggtaggttacccgtacggtacccccgtttccgtaacggttccgaaaccccggacccggttaacgggtcccttaaccccccggg

SEQ ID NO: 153160 - DNA, 702 bp, Homo sapiens
  misc_feature: GYAE6OF02IFFW9.40.57.F02.1.454.CMB.1.raw
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (336)..(336): a, c, t, g, unknown or other
  misc_feature (336)..(336): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatccgtgggctcactctaccctgactcagtcctcgctcagtcgtccggtctcctggacagtcagtcaccatctctgctactcggaaccngcgagtgattagttggtntcttataactctacgtctcctacgtaaccaacaaccgaacccgggtactaaacggtaccctaaacttctacgtatttatagtagttntactaacgtaacggccgtcccttacggtacggggtcgcgtagactccgtacttcgtcgtcggtcctacgtaagtccgtaggacgaccgtacggtccctcccgtagacctacgtccgtcgttcggtcctaccgtacggtaacgtcggtacggtacgtcggtacggttactttacgttttacgttttcgtcgttcgttcgttacgtttacacggtacgtacggtccgtttacgtttcccgtcgttacgttacgtaacggtttcgggttaccggggtacgggtaaccgggtacccggttaggtacccgttccgtaaccccggttacgtaccggttaccgaaccgggtacccacggttccgtacccccgg

SEQ ID NO: 153161 - DNA, 660 bp, Homo sapiens
  misc_feature: GYAE6OF02GZ6E3.40.57.F02.1.454.CMB.1.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
  modified_base (346)..(346): a, c, t, g, unknown or other
  misc_feature (346)..(346): n is a, c, g, or t
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatccgtggctcactctaccctgactcagcctcgctcagtcgtccggtctccgtggacagtcagtccaccatcctcctgcacgtggaaccngcagtgattagtggtncttatactctgtcctcctaggtaccaacgtaaccgaccggacaaacggtaccctaaacttctgtatttangattgtacacgtaagccgcctgagggtcntgactcgcttctcgtcgtctaccaagttctcggcgaccgaccggtccctccgtcgacctatcctcgtcggccttccgagtacgtggtaacgacgtggtacggtctttaacgtttgttttcgacttcgtcgtttcgttacgtcggtacgtacggttcttacgtttccggtacttcggttaccgggtaagtttccgggttaccggggtacggggtaacccggggtaccgtacggtacccgtaccggttaccccggttacccggtttcccgtacccggaccggtacccccggtaacgggtccccttaccccccgggg

SEQ ID NO: 153162 - DNA, 712 bp, Homo sapiens
  misc_feature: GYAE6OF02FJUUL.40.57.F02.1.454.CMB.1.raw
  modified_base (240)..(240): a, c, t, g, unknown or other
  misc_feature (240)..(240): n is a, c, g, or t
tcagtctagcgactcacgaccggtgctcgatttagctcgatatagttgggtttgggggggggtctcaggaggcagcactctcgggacgtctccaccatggcctgggctctgctcctcctcagcctcctcactcagggcacaggatcctgggctcactcctaccctgactcacgcctcgctcagtcgtccgggtctccgtcggacagtcagtccaccactcctctgcctacgtcggaaccngcgtagtgtaattagttggtagtcttaatactacgtcgtctccgtacgtaaccaaccgaaaccgacccgggtactaaacggtaccctaaacgttcttagtactttacgagtacgtcgtacgaacgtaacgccggtacccgtcggacgggtcgtcgtgtacttccgtccttcgtcgtcgtcctacgtacgtcggtcgaccggtaccgtaccggtcccttcccgtaccgaccttacgttccgtcggtcggtccctaccacggttacgacgggtacggacgttagggtaaccgttcgtttaacgtttttgtttcgtctcggttcctttaacgtacgttcggcgtacgttcgtttaccgtttcgtaccgttacgtacggtacggttccgggtcggtacggggaccggtaccgacggtccggtacgttaccgtaccggttccggtacccgtacggtacccgacggttccctacccgg

SEQ ID NO: 153163 - DNA, 624 bp, Homo sapiens
  misc_feature: GYAE6OF02IR56E.40.57.F02.1.454.CMB.1.raw
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (238)..(239): a, c, t, g, unknown or other
  misc_feature (238)..(239): n is a, c, g, or t
  modified_base (419)..(419): a, c, t, g, unknown or other
  misc_feature (419)..(419): n is a, c, g, or t
tcagtctagcgactcacgaccggtgctcgatttagctcgatatagttgggtttggggggggtctcaggaggcagcactctcgggacgtctccaccatggcctgggctctgctctcctcagcctcctcactcagggcacaggatccgtgggctcactctaccctgactcagcctcgctcagtcgtccggtctcgtggacagtcagtcacatctctgcnctgaacngcagtnatntggtnntatactctgtctctcgtacacacgaccggacaacgtacctaattctagtattatacgagttctacaacgtacgaccgcctcggaggtcgctgactcgtcttcgtacgtcgtcctaccgtaagtcgtacggtacgtaccgtccggacctcccgtcgtaacctacgtcgtccgtacgtaccncctaacggagttccggaaggtacgtacggtacggttacttttacgtttaagtttcgcgttcgttacttcgttaagcgtgtacgtacgtttactcggtctcgtacgtaggtcggtacggtccgggaagggtacccgtggaccgttacggtaacccgtcccggttacggaccctaaccgggacccgttaccgggcccttaccccggg

SEQ ID NO: 153164 - DNA, 804 bp, Homo sapiens
  misc_feature: GYAE6OF02HEIWL.40.57.F02.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggactcctgggcctcacgtctaccctgactcagcctcgctcaggtcgtccggtctccgtggacagtcagtccaccatcctcctgcactcggaaacncgctagtgtatagttggtcgtcttatactctgtctctacggtaccaacacgaccggacaacgtccaacttcgtntacgtttangagttcgtacactaagtcccggacctcggtacggggtcctcgtaggcttacgtctttcgccgtcgtcttaccaaggttcgtccgggtacgtaccgacccggtcccgtacccgtaccgtaaccctcgtacggttaccggttcccgggtactacccggtaccggtaacggtaacggtaccgggtaaggtttaacggcggtttacgtttaaccgtttttacgtttacggtttcccgtgtttaccgttacgttttacggtaccgtaccgggtacgttacccggttaacggttttccccgtacggtttacccggtaaccgggttttacgggtttaccggggtttaccccgggggacgggggttaaaccccggggtaaccggggtaccggttaaccgggtaccccggttaccccgggtttacccgttaaccccggtaccgggtaacccccggtaaccgggtaccccgggttcggtaaacccccccccgggg

SEQ ID NO: 153165 - DNA, 678 bp, Homo sapiens
  misc_feature: GYAE6OF02F436Z.40.57.F02.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccggtctcctggacagtcagtcaccatcctcctgcactcggaaccagcagtgatattggtncttataactctntctcctggaccaacaacgacccggcaaacggtccctaaattctagtatttatcgtatgtacactaacggtccgcccgtcgaggggtcctcgtgactcgtcttcctcgtcggtctaccgagtcgtcggccgaccgccgtccctccagaccacgttcctcgtcgggtacctccgaacggtcgtacggacggtactagggtaacgttccgtttaacgtttttacgttttcgccgtttcgtccgtttaccgttaccggtacgtaaccggtcggtttaacggtttaccgttccttaaccggttaccgttaaggttaccgggttgggtaacccggggacgggtaacccgggtacggtacggttcccgtacccgttacccgttacgtacccggaccggaccctaaccgggtacccgtcccgtcccccgg

SEQ ID NO: 153166 - DNA, 716 bp, Homo sapiens
  misc_feature: GYAE6OF02H96WS.40.57.F02.1.454.CMB.1.raw
  modified_base (239)..(239): a, c, t, g, unknown or other
  misc_feature (239)..(239): n is a, c, g, or t
  modified_base (432)..(432): a, c, t, g, unknown or other
  misc_feature (432)..(432): n is a, c, g, or t
tcagtctagcgactcacgaccggtgctcgatttagctcgatatagttgggtttgggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcacgtccaccacttctcctcgctacgtcggaaaccnggctagtagtacttagttggtgtacttaataaccttcgttcgtcctccgtacggtaaccaaaccgaaccgaccccgggaactaaaaccggtaccctaaacctttcgtagttactttaagacgtagttacgtaccgtaacgtaacggcccggacccgtacggtacggggtcgtagtcgtacgtccgtctttccncgtcggaccttacgacgtcgtcgaccgaccgccgtccctccgtacgtacctactccgttacgtcggtcctaccgtacgtacgtaggtacggtatccgggaacgttaccgtttaacgttttgtttcgtcgtaccgttcgtttacgttacgtcgtacggttaccggtcgtttacgtttccgcttacggtaccgtaaggtcgggttaccgggacgggaacggtccgtaggtccggttaccgacccggttctaccggtaccgacgtacccggtaccgtccgtccccgg

SEQ ID NO: 153167 - DNA, 745 bp, Homo sapiens
  misc_feature: GYAE6OF02GAPU1.40.57.F02.1.454.CMB.1.raw
tcagtctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtcgtccgggtctcctggacagtcagtcacctatcctctgcacgtggaaccagcagtgattagttggtacgtacttaataaccttctcgttctccgtaggtaacccaaacgaaccgacccggggactaaaaccgggttcccctaaaactttccgtaggtaacttttacgtagtacgtcgtacaacgtaacggcccggtacccttcgggacgggtccgtctacggtaacgtccggtactttccgtaccgttcgggtacccttaccgaaacgtttccgtacggggtacccgaaccgtacccggtccccttacccggtaacgtaccccgtaacttccggttaccgtcggggtacccttacccgagttaccgtcggaacggtacgtacggtaacggttacttttaacgttttacgtttcgtccgttacgttctttacgtagttcggcgtacggtcgttacgttctccgttagtaccgttaggttcgggtccggacggggtacggccggtagtccgtaccggtacccgttcgtaccggtccgaccggtacccgtacggtcccgttaccccgg

SEQ ID NO: 153168 - DNA, 613 bp, Homo sapiens
  misc_feature: GYAE6OF02HORM5.40.57.F02.1.454.CMB.1.raw
  modified_base (247)..(247): a, c, t, g, unknown or other
  misc_feature (247)..(247): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
tcagtctagcgactcacgaccggtgctcgatttagctcgatatagttgggtttgggggggggtctcaggaggcagcactctcgggacgtctccaccatggcctgggctctgctcctcctcagcctcctcactcagggcacaggatcctgggctcactcctaccctgactcagcctcgctcagtcgtccgggtctcctggacagtcagtcaccatctcctgcactaggaaccagcagtgatagttggntacttataactctgttctccgtaggtaaccaacaaccgacccgggacaaacggtaccctaaacttcgtagtaatttagtgtaattcgtacctaacgtaacgccggtccctacggacggggtctcgtgactccgtcttctcgtcgctacagtctgcacgaccggtcctccgtacgacctagtcctcgtcggcctacgagtacgnggaacggtcgtaggacgttctttaacgttttntttcggcttcgtcttacttgtcgagtcgtcgtttagttccgtactgtaccgtaggttcggttcgggacgggtaacggccgtagtcgtaccggaccttcgtacgtccgtacggtacccgagtccctccccgg

SEQ ID NO: 153169 - DNA, 836 bp, Homo sapiens
  misc_feature: GYAE6OF02FKQK2.40.57.F02.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagtctagcgactcacgaccggtgctcgatttagctcgatatagttgggtttgggggggggtctcaggaggcagcactctcgggacgtctccaccatggcctgggctctgctcctcctcagcctcctcactcagggcacaggatcctgggctcactctaccctgacctcagcctcgctcagtcgtccgggtntccgtggacagtcagtcaccatcctccngccacgtggaaccagcgagtgattagttggtntcgttaataaccgttntacgttcctccgttacggtaacccaaaccgtaaccgtacccgggacgaaaacccggttacccctaaaccgttacgtcgtaacttttagtcggaacttcgtacctaacctaacggcccgtacccgtcggtaacggggtccgtcgttacggactccgtctttcgtcgttcggtaccgttcctaaacgggttcgtacgggtacccgaaccggtcccgggttccccttacccgtacggaacccttacggttacccttccggttccgggtacccgttcccgtaacggtaacccgttagggaacgggtaacgtaccggggtagtacccggtttttacgttttaacgtttttcggcccgtttaggttaccctttacggttatccgggtaccggtacgggtaccttttcggtttccggtaccgtttacggtaccggttaaggggtttcccgggttaccgggggtaaccggggtaaccggggtaacccggccgggtaacccggttcggtaacccccggttccggttacccggttaaacccgccgggttaccccgaaccgggttccgttacccccgg

SEQ ID NO: 153170 - DNA, 762 bp, Homo sapiens
  misc_feature: GYAE6OF02FZ0HB.40.57.F02.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (392)..(392): a, c, t, g, unknown or other
  misc_feature (392)..(392): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggactccgtgggctcactctaccctgactcagcctcgctcagtgtccgggtctccgtggacngtcagtcaccatcctcctgcctacgtacggaaccagcagtnaattagttggtgtcttaactactctcgtctccgtacgtaaccaacgaaccgacccgggactaaaccggtacccctaaactttcgtacgttagtttacgacgtagttacggtacctaacgtaacggcccggtaccgtcggacggggttcncgtacgtactcgttacttcgtcggtacgtccgtacgtaacggttcgtacggtacccgtaaccgtacccggtcccctaccgtaccgtaacccgtaccgttccggtaccgggtcggtaccgtccgaacgtacggtacgggacggtacggttacggtacgttacgtttaacgttttagtttcgtcgtacgttcttacgttaggtccgtacgtaacggttccgttacgttccgtaccgttacggttacggttacggttacggggtccgggtaacggggtaccggtaaccggtaggttaccccggttaaccggtacccgtttaccggtacggtacccgtaaccgggaccccggttacggtcccccgtcccccggg

SEQ ID NO: 153171 - DNA, 771 bp, Homo sapiens
  misc_feature: GYAE6OF02H69YT.40.57.F02.1.454.CMB.1.raw
tcagtctagcgactcacgaccggtgctcgatttagctcgatatagttgggtttgggggggggtctcaggaggcagcactctcgggacgtctccaccatggcctgggctctgctcctcctcagcctctcactcagggcacaggatccgtgggctcactctaccctgactcagcctcgctcagtcgtccgggtctcgtggactgtcagtcaccatctcctgacctacgtcggaaaccagccgtagtacgtattacgttggtcgtcttaataactcgtcgttacctccgtacggtaaccaacgtaacccgaccgggtactaaacggtaccctaaacgtttctaggttaacgtttatacgtagtcgtacgaaccgtaacggtccggtaccctcggtacgggggtacctcgttaggtacgttccgttcgtttcgtacgttcggtcccttacgtaacggttcgtacggccgaccgtccggtccctacccgtacgtaccgtacgtccgttacggtcggtaccgtaccgtaggtaaccgtcgggtaacgtacggtacggtacggttacctttaacggttttacgtttttcgaccgtttcgttaccgtttaccggttaacgttccgtaaccgttcgggtcccgtttaaggtttcccgtacgtccgttaacgggtaccggttcggttcggggaaccgggtcgggtaccggttacggtcccgttaccggtacccggttacgtaccggtcccgtaccggacccgtaccggtcccgtacccggg

SEQ ID NO: 153172 - DNA, 708 bp, Homo sapiens
  misc_feature: GYAE6OF02H0WSL.40.57.F02.1.454.CMB.1.raw
  modified_base (233)..(233): a, c, t, g, unknown or other
  misc_feature (233)..(233): n is a, c, g, or t
  modified_base (365)..(365): a, c, t, g, unknown or other
  misc_feature (365)..(365): n is a, c, g, or t
tcagtctagcgactcacgaccggtgctcgatttagctcgatatagttggggtttgggggggggtctcaggaggcagcactctcgggacgtctccaccatggcctgggctctgctcctcctcagcctcctcactcagggcacaggatcctgggctcactctaccctgactcagcctcgctcagtgtccgggtctccgtggacagtcagtccaccatctcctgcacgtggaaccngcagtgattagtggtgtacttataactctcgtcttcctcggtaaccaaacgaaccgacccgggacgtaaacggtacccaaactttctagtatttatgatcgtactaactacggccgtcccgtgacggggtcncgtgatcgtctttctcgtcgactccgaagtcgtggccgaccaccgtcctcccgtacgaccctactccgtcgtcggcctaccgagtaccgtggacgtagtacggtacggtactttacgttttattttacgcgttcgtacctttacgttagtaccgtcgtacgggttccttacggttttccgaccgttacgttacgggttaacgggtttcgggttaccggggtacccggggtaacggggtaacccggtacgggttcccgttaacccggttaccccggttaacccggttaccggttacccggaacccgggtaaccccggtaaccgggtcccccgttaacccccggg

SEQ ID NO: 153173 - DNA, 709 bp, Homo sapiens
  misc_feature: GYAE6OF02GEE6V.40.57.F02.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (349)..(349): a, c, t, g, unknown or other
  misc_feature (349)..(349): n is a, c, g, or t
tcagtctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtcgtccgggtctcctggacngtcagtcacctatctctgcactcggaaccngcagtnatgtggctacttatactntcgtctcctacgtaccaacaaccgaccggacgtaacggtaccctaaattcgtgtactttatgatcgtacactaacgccggcctaggacggggtcncgtgtactcgtcttctcgtcgactacgtaagtcgtcggacgaccgcccggtcccttccgtacgacctacgttcgtcccggtacgggtccctaccggagttaccggtacggacggtacgtaggtacggttacctttacttttaggtttccgtacgtttcgttaccttcggttacgtccggtacgtaccggttaccgtttacgggttacccgttctttaccggtaccggttaacgggtttccgggttaccgggtaccggggtaaccgggttaccgtaccggggttaccgttccggtaaaccccggtttaccgacccgggttaccgaaccggtaccccggtaccgggtccccttcccccgggg

SEQ ID NO: 153174 - DNA, 862 bp, Homo sapiens
  misc_feature: GYAE6OF02HVD51.40.57.F02.1.454.CMB.1.raw
tcagtctagcgactcacgaccggtgctcgatttagctcgatatagttgggtttggggggggtctcaggaggcagcactctcgggacgtctccaccatggcctgggctctgctccctcctcacgccctcctcacttcgagggccactaggactccgtgggcctccactcctaccctgactcacgcctcgctcagtcgtccggtctccgtaggacagtcacgtaccaccacttctacctcggactacgtacggaaccagctaaggtgtattaagttggtactacttaactaacctcgtgtccgtaccgtacggtaaccaaacgaaccgaccccgggaactaaaaccggtccctaaaacgttcctaagttaacgttagtacgtaacgttcgtaaccaacggtaacgggtaccggtacccccgtagggtacgggggtctaacggtcgtaacttaccgttaccgttcgttaccggacggtacccgtaaccgtaaccgttcggtaaccgggcccgtaaaaccggtcccggtacccttcccggaaccggtaaccctaagtcccggtaccggttaccgggtaacctaacccggtaagtaccgtgggtaacggtccgtaaggtaaccgtttaccgtttttaacgtttacgtttaacgtccggttaaagttcccgttttagttaacggtacccggtagtaaaccggtttacgtttaccggtttacccgccgttaccggtttaacgggttaaccgggttgggtaccggggtaccggggtaacccgggtaccggacgggttaccccgtaacggttccccggtaacgttaccgggaaaccaccccgggtaaccgtacgggttcccccgttacccg

SEQ ID NO: 153175 - DNA, 829 bp, Homo sapiens
  misc_feature: GYAE6OF02FFWMU.40.57.F02.1.454.CMB.1.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
tcagtctagcgactcacgaccggtgctcgatttagctcgatatagttgggtttgggggggtctcaggaggcagcactctcgggacgtctccgaccatgtcctgggctctgctctcgtcagcctcctcgactcagggccacgaggatccgtgggctcacttctacccttgactcacgcctcgactcagtcgtccgggtctccgtggacagtcacgtcaccatcctcntcactggaaccngcagtcattattggctnttataactcgtagtcctccgttacggtaacccaacgaaccgtaccccggggtactaaaaccgggtccccttaaaactttccgtagtaacgtttttacgtacgtaacgtttcgttacgaaacccgttaaaggtccccgggtacccccttacgggtaaccggggggtttcctaccggtttaacgggacctttccgggtaccgtttttcccgtccggttccggggtacccctttaacccggtaaacggttaccggtccggggttaaacccgaacccggtaacccgggttccccctttaccccggtacggtaacccgttacgtccggtttaccgtcgggggtacccttaccggaacgtaccgtgggaaggtacgtacggtacggtactttacgttttacgtttttcggcttacgtaccgtttccgttacgtccggtacgtaacggtacgttaacggtttccacgtcgttacgtaaccggtttcggtaccgggcgggtaacggtaccgtacgtaccgttaccggtacccgttaccgtaccgtaccggaccggtacccggtacgtcccggttacccccgg

SEQ ID NO: 153176 - DNA, 707 bp, Homo sapiens
  misc_feature: GYAE6OF02GULK7.40.57.F02.1.454.CMB.1.raw
tcagtctagcgactcacgaccggtgctcgatttagctcgatatagttgggtttggggggggtctcaggaggcagcactctcgggacgtctccaccatggcctgggctctgctcctcctcagcctcctcactcaggcacaggatcctgggctcactctaccctgactcacgcctcgctcagtgtccgggtctctggacagtcagtcaccatctctgcactggaaccagcagtgattagttggtgacttataactctcgtctcctggtaccaaccaaccgacccgggcaaacggtaccctaaacttcgtagtattttagagactacgtcaacgttaacggccggtcccgttacggacggggtcgtactcggtactccggtcctttacgtcgttacggtccctaccggtaacgttcggttcggaccgtaccgaccggtcccgtacccgtcgtacctacgtccgttcgtaccggggtcctaccggaacgtacgttacggacggtaggttaccggtagttacctttacgtttttagttttcgtacgttcgttccgttacgttacgtcgggtacgtacgggttcgtttacgtttccggtaccttacgttacgggttacggttcgggttcccgggtacggggtaacggaccggttcggtaccggtccgtaccgttccgttacgtcgtaccggaccgtaccggtccgtaccccgg

SEQ ID NO: 153177 - DNA, 720 bp, Homo sapiens
  misc_feature: GYAE6OF02GS7TH.40.57.F02.1.454.CMB.1.raw
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
tcagtctagcgactcacgaccggtgctcgatttagctcgatatagttgggtttggggggggtctcgaggaggcagcactctcgggacgtctccaccatggcctgggctctgcctcctcctcacgcctcctcactcgacggcacaggactccgnggctcacgtcctacctgactcagcctcgctcagtcgtccggtntcctggacngtcagtcactatcctcngcacgtcggaaccngctagtgaacttagtggctacttataactctcgttctcgtacggtaccaacaacgacccggacaaacggtacccaaacgttcctagtaacttttagtacgtactcgtactaacgtaacggtccggaccctcggtaacggggtcacgtcgtaagtccgtactttacgtccgttcggtctaaccgtacgttcgaacggtccgaaccgtcggccctacgtccgaacttacgtctaccggtcggaccttaccgagtaccgtacgacggtacgacggtacgtacgtttaaccgttttgtttacggtctccgttacgtttccgttaaggtccgtaaccggtacgtaccgtttaacggtttcccacgtttaccggtaacggttacgtttcgggtaccgggtaacggggtaacggtaacccggtcgtacccggttacgtacccggttacccgttaccggtacgacccgtacccggaagttccccgtacccgg

SEQ ID NO: 153178 - DNA, 930 bp, Homo sapiens
  misc_feature: GYAE6OF02J1M7U.40.57.F02.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (465)..(465): a, c, t, g, unknown or other
  misc_feature (465)..(465): n is a, c, g, or t
tcagtctagcgactcacgaccggtgctcgatttagctcgatatagttgggtttggggggggtctcaggaggcagcactctcgggacgtctccaccatggcctgggctctgcctcctcctcacgcctcctcactcgagggcacaggactccgtggctcactcctacctgactcgacgcctcgctcgagtcgtccggtctcgngacngtcacgtcaccgtctctacctgacctacgtacggaaccagctaggttagtacttaggtttcggtcgtaactttaactaaccgtcgttacgttcccgttacgtaccgtaaccaaaccgacccggtaacccgggaacgttaaaacccgtaccttaaaccgttcgggtaatttaagtttcgaacggtagttccgtaacgtaacggtaccgggtccccggaacccgttggggtaccgggtacctaggttaccgacgttcccgtntttccccgtcgggttaccaccgtttaccgacgttccggtaagggaccctacccggtcccggtcctaaccggtcgtaacctccgttcggtacggttacccgggtacctaccggtaacggtacggtaacgggttacggtacgggtaacgtttaccggtttaccgttttaaacgttttccgtttacggaccttttcggttaccgtttacgttaaccgggtcgtaacccgggttaaggttcccgtttaaacccgggtttcgttaaacccggtttccgggttaaacgggtttacggggtcccggggtttaacgggggtaccccggggtaacgggtacccgggttaaaccggttacccgggtttaaccccggggtttcccggttaaccgggtttaaaccccggtaccccggggttaaacccccggtaccccggggtttaccggtaaccccccccggttttccccccggggg

SEQ ID NO: 153179 - DNA, 654 bp, Homo sapiens
  misc_feature: GYAE6OF02IF4XR.40.57.F02.1.454.CMB.1.raw
  modified_base (190)..(190): a, c, t, g, unknown or other
  misc_feature (190)..(190): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
  modified_base (556)..(556): a, c, t, g, unknown or other
  misc_feature (556)..(556): n is a, c, g, or t
tcagtctagcgactcacgaccggtgctcgatttagctcgatatagttgggtttggggggggtctcgaggaggcagcactctcgggacgtctccaccatggcctgggctctgccttcctcctcacgcctcctcactcgaggcacaggctccgtggctccactcctacccgtgactcacgtcctcgctacgngtcgtccggtctcgtaggacagtcgactcaactatctcgtgactanacggaacncgntacgtagattcgtggtatctaatctcgtcgctacgacgtaacgaactaaccggccgaagtaaaccgtccctaacgttnacgtttaattacgngtacgtataccgaacgttaccgacggttcccgtacggaacggttccgngtaacgtctccgttagttcccgacgtaccgtcttaggaacccgttgaccgggtccaaccgggtcccgtacctttcccaagaccgtcgtacgtccgtccgacctagaaccgtcgacgagtacgagtacgtacttagtttacgtgtcgtactcttcgagtcgtacgtacgngtttaccgtctacgttctacgtcggtcgacgggtacgtacggacgcgtcggtaccgcggttacacccggttagaccgtacgggtcccaccggtccccg

SEQ ID NO: 153180 - DNA, 109 bp, Homo sapiens
  misc_feature: GYAE6OF01D095R.47.82.H05.1.454.CMB.1.raw
tcagagctcacgtacacgaccggtgctcgatttagtcgagctctctcgcgggctgcctggtcaaggactacttcctacgtgagcctgagcgggctggcaaggcgcatag

SEQ ID NO: 153181 - DNA, 110 bp, Homo sapiens
  misc_feature: GYAE6OF01AQKZB.47.82.H05.1.454.CMB.1.raw
tcagagctcacgtacacgaccggtgctcgatttagtcgagctctctcgcgggctgcctggtcaaggactacttcctacgtgagctctgagcgggctggcaaggcgcatag

SEQ ID NO: 153182 - DNA, 722 bp, Homo sapiens
  misc_feature: GYAE6OF01DEKXD.47.82.H05.1.454.CMB.1.raw
  modified_base (126)..(126): a, c, t, g, unknown or other
  misc_feature (126)..(126): n is a, c, g, or t
tcagagctcacgtacacgaccggtgctcgatttagtcgagctctctcgcgggtagaagtcacttatgagacacaccagtgtggccttgttggcttgaagctcctcaggaagcagcagtcgggggtnccgcagccatggcctggaccgctctccttctgacgcctcttgctctactttacagtttctgtcgtccttccttgacctgactcacgcctactctcgagtcgtccgtcggcccgtgggaccaggaccgaccaagtaccttaccgtgggtaggggaactacgaactagttaggaaacgtaaaagtcgtagactacgtacggtaaccaacgagaacgccgacggaccgaccggtcccctacgtccgtggtactagtactaagtaaaggaactaaccgaaacccggtccctacgtacgggactccgtacgtaacgtacttcctcgtcggtctacctaacgttaccgaaccaaccgacccggacccctacccgttacgaaccctacgtaccaacgacgaccggaccgaaccccgtaaggtacgggaacgtacgtacggacggtacgtacggtactttacgtttacgtacggttaacttaaacggttcgggaacttacttccgtccgtcgttcgggtaccggtttagttccgggccggtaccgggtaaccgggacccgtaacgggtcctaaccggtaccccgttacccgtaaggtaccccgg

SEQ ID NO: 153183 - DNA, 654 bp, Homo sapiens
  misc_feature: GYAE6OF01A8UHZ.47.82.H05.1.454.CMB.1.raw
tcagagctcacgtacacgaccggtgctcgatttagtcgagctctctcgcgggggggtgccgcagccatggcctggaccgctctccttctgagcctccttgctcactttacagtttctgtggcctcctttgacctgactcagccactctcagtgtccgtggccccaggacagacggccaggattacttgtgcgggagccagtgttggagaaagaagtgtacactggtaccaacagatgccaggccaggcccctgtgctggtcgtctatgatgatagtgaccggccctctgggactccccgagcgattctcgtggctccaagtctacgggaacacggccacccgtgaccgtcagcgagggtcgacggtcggggatggacggcgttattagttttcgtcgtagggtggtgggacgtacttaagttttgggtctagttagttggtttaggttcggggtacgggtaacgggtaccgtaaaggtttcggtacccggttccgtccgggttacgacggtacccgaagggtccgtccggtcccccgttcgggtcctacccttccgttcgttaccccctaccccttcccgttaccgttaccggtgtacggccttaccgtcggacggtcccggggtcgttacggggaccgaacgggtccgtaccg

SEQ ID NO: 153184 - DNA, 554 bp, Homo sapiens
  misc_feature: GYAE6OF01BK153.47.82.H05.1.454.CMB.1.raw
  modified_base (308)..(308): a, c, t, g, unknown or other
  misc_feature (308)..(308): n is a, c, g, or t
tcagagctcacgtacacgaccggtgctcgatttagtcgagctctctcgcggggggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggccctctgggatccctgaacgattcnctggctccaattcggacaacacggccaccctgaccatcagcagacgcccaagtcggagagtggaggctagacttatttctgtactaaagtttgggactatcctccgctgcggttatcggcgcgagggaccaagctacgaccgtctaagcacgacccaaggccgtcgcccccgtcggtcacctccgtcgttccccgccctcctcgtacgtcgacgtctcgtgacggtcggacgtcggcgaggcgacg

SEQ ID NO: 153185 - DNA, 539 bp, Homo sapiens
  misc_feature: GYAE6OF01BBOWW.47.82.H05.1.454.CMB.1.raw
  modified_base (392)..(392): a, c, t, g, unknown or other
  misc_feature (392)..(392): n is a, c, g, or t
  modified_base (427)..(427): a, c, t, g, unknown or other
  misc_feature (427)..(427): n is a, c, g, or t
tcagagctcacgtacacgaccggtgctcgatttagtcgagctctctcgcggggggggtgccgcagccatggcctggaccgctctccttctgagcctccttgctcactttacagtttctgtggcctcctttgacctgactcagccactctcagtgtccgtggccctgggacagacggccagacttacctgtgggggaatcaaacattggacgtaaaaaatgtgcactggtacaacagaagccaggccaggcccctgtcctggtcatctaataaggatacaaaaccggccctactgggatccctgaacgattctctggctccaaattcggaacaacacggccaccctgaccaatcagcagagcccaaagtcggaagatgaggctgactatttcngtcaaatttgggacatctccgctgcggtattcggncagggaccaaagctgacccgtctaagtcaagcccaaaggcctgccccctcggtcactctgttccccaccctacctctaccgtgaggctctgagtcgggctgggcaaggcacg

SEQ ID NO: 153186 - DNA, 700 bp, Homo sapiens
  misc_feature: GYAE6OF01BSYVA.47.82.H05.1.454.CMB.1.raw
  modified_base (127)..(127): a, c, t, g, unknown or other
  misc_feature (127)..(127): n is a, c, g, or t
  modified_base (148)..(148): a, c, t, g, unknown or other
  misc_feature (148)..(148): n is a, c, g, or t
  modified_base (158)..(158): a, c, t, g, unknown or other
  misc_feature (158)..(158): n is a, c, g, or t
  modified_base (182)..(182): a, c, t, g, unknown or other
  misc_feature (182)..(182): n is a, c, g, or t
tcagagctcacgtacacgaccggtgctcgatttagtcgagctctctcgcgggtagaagtcacttatgagacacaccagtgtggccttgttggcttgaagctcctcaggaagcagcagtcggggggtnccgcagccatggcctggaccnctctccttcngacgcctccttgctctactttacngtttctgtcgccttctttgacctgactcagccactctcagtcgtccgtcggccctgggacagaccggccagacttaccgtggtggggaatcaacagttaggaacgtaaaaagtgtgcacgtggtaaccaacgagaacgccgaggccgacggcccctgtccgtggtcatacgtagtaagactaaccgaacccgccctcgtcgggacctcccgtagaactagttcctcgtcgtcctacctaacgttccgaaccaaccgccgggacccctacccgtacgaacccataccgacggtacgaacggaaccgacccgaaacgggtcggaaggaacgtacggacggtcttacgtactttacgttttaccgttagttaaccttaagggtttacgggtaactacgttcccgtaccgtccgttacgggtccggttaacggttcccggggacggaccggtaaaccggggaacccgtaaacggtccccggttaccggttaacccccggttaccgttaacggtaaccccggg

SEQ ID NO: 153187 - DNA, 637 bp, Homo sapiens
  misc_feature: GYAE6OF01BW64K.47.82.H05.1.454.CMB.1.raw
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
  modified_base (403)..(403): a, c, t, g, unknown or other
  misc_feature (403)..(403): n is a, c, g, or t
tcagagctcacgtacacgaccggtgctcgatttagtcgagctctctcgcgggtagaagtcacttatgagacacaccagtgtggccttgttggcttgaagctcctcaggaagcagcagtcggggggtgccggcagccatggcctggaccgctctcctcctcggcctcctctctcactgcacaggctctgtgacgtccgacgagctgattcaggccacctcgatgtcagtcggcccaggacagacggccaggattacttggnggcggagccagtgtgaagaagagtgtacacgtggtaccaanagactcgaccgacggccacggcccctggtcgcgttggtctctatggatgaactggtccgacccgtccttcggtcgggacctccccggagtccgtactttccncgttcggcctaccgaagttcgtacgggaaccgccggtaccctacccgtcgtaccgtcacggcgacggggtcgaccgggtacggggacgttacgggacgggttaccgttaagtttacgttttcggacgtagggttgggtcgggtaacgtacgttttaacggttttgacggttattcgggtttggtttcggttaccggggtacgggtacgggtaaccgaagggttcgttaccgggg

SEQ ID NO: 153188 - DNA, 764 bp, Homo sapiens
  misc_feature: GYAE6OF01ANSPA.47.82.H05.1.454.CMB.1.raw
tcagagctcacgtacacgaccggtgctcgatttagtcgagctctctcgcggggggggtgccgcagccatggcctggaccgctctccttctgagcctccttgctcactttacagtttctgtggcctcctttgacctgactcagccactctcagtcgtccgtggcccgtgggacaggaccggccagacctttaccgtggtagggggaatcgaactagttagggaacgtaaaaatgtacgcacgtacggtaaccaacagaacgccgacggccgacggccccgtgtcctcggtcatacgtaagtaacggtaactaaccgaaacccggtccctcgtacggtacttacccgtacgtaaaccgtactttaccgtcgttaccggaccttaccgtaaacgttccgggaaccaaaccgaacccgaacccctacccgtacgtacctactaccgaacgaccgaacgaccgacccgtaacggtacggagacgtaggacgtacgtacgtactttactttacgttagttacgttaaacgtttacgggtactaacgttccgtccgtcgttcggtacggttacgttccgggacgtaccggacgggtaaccgacgtcgtaccgtacccgtacctaacgtcgaaccgtaccggtaccggtccgtacccggtccccgtacggtacctaccgttcccgtcccgttaccccgtacccttcccgttaccgtaccggttcgaccgtcgtacgtcggacgggtcggtacggacggacggcggcgtacgg

SEQ ID NO: 153189 - DNA, 786 bp, Homo sapiens
  misc_feature: GYAE6OF01AE6SA.47.82.H05.1.454.CMB.1.raw
  modified_base (129)..(129): a, c, t, g, unknown or other
  misc_feature (129)..(129): n is a, c, g, or t
  modified_base (163)..(163): a, c, t, g, unknown or other
  misc_feature (163)..(163): n is a, c, g, or t
  modified_base (193)..(193): a, c, t, g, unknown or other
  misc_feature (193)..(193): n is a, c, g, or t
tcagagctcacgtacacgaccggtgctcgatttagtcgagctctctcgcgggtagaagtcacttatgagacacaccagtgtggccttgttggcttgaagctcctcagggaagcagcagtcggggggtcnccgcagccagtcggcctggaccgtctctccttcngacgtcctcttgctctactttacagtttcnggtcgtccttcctttgacctgacctcgacgcctactcacgtacggttcgtccggtacggccccgtaggggaaccacggaccggacctacgtacctttaccgtgggtaggggaactacaaacgtagttaggaaacgttaaaatcggtacgactaacgtacggtaaccaagacgtaacgccggaacggacccgaaccggtccccgttagtcccgtaggtactacgttaacgtaacgtaaacggaaccgtaaaccgaaacccgggtcccttacggttacgggacccttacccgtacgggtaacttacttccgtacgttacggaccttaacccgtaacgttccggaaacccaaccggtaccccggtaaccccgtaaacccgtaccggaaaccctagtacccgaaacgtccgaaacgaccggaacccgtaacgtaccgggatacgtacggacgtactacgtactttacgttacgtacgttaacgtacgttcgaactcgtaccgtccgtacggtccggtacggttacggtccggacggtacccggaacgggacctacggtaccgtacccgggtaacccttaaggtacccgtaaccccgg

SEQ ID NO: 153190 - DNA, 767 bp, Homo sapiens
  misc_feature: GYAE6OF01BVTJO.47.82.H05.1.454.CMB.1.raw
  modified_base (106)..(106): a, c, t, g, unknown or other
  misc_feature (106)..(106): n is a, c, g, or t
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
tcagagctcacgtacacgaccggtgctcgatttagtcgagctctctcgcgggtagaagtcacttatgagacacaccagtgtggccttgttggcttgaagcctcctnaggaagccagcacgtcgggggtcaccgcacgccagtggcctggaccgcttcctccgttcgtgacgtcctccttagcctntaacctttacgagttttcngtcggtcccttcgtttcgacctgactcacgtcctactctcgagttcggtaccgcggtccgtagggaccaggcccgtacagtaccgttacggtaggacgggtaactacgtaacgtaagtaacggtaaacgttaaagtggtacgaccgtaccgttacgaaccgaacgtacggaccgaccgaccggaccgtaccggtcccgtcgtacgtacgtacctaacgttaacgtaacgtaacggtaccgtaaccggtaacccgtaccgtacggtacccgtaccgtaccgtacggtacgttcttaccgtacggtaccgtaccgtaccgtaacgtaaccgaaccgacccgaccgtacccgtaccgtacgaaccgtacgacgtacgaccgacggacctacggtaacgtacggacgacggtacgacgttactacgttacgtttacgttccgttaacttaacgttacggttacgacgtcgttaccgtccggtaccgttacgggtaccgtacggtccggtccggaacggtaacccgacgtaccggtacgtacccggtacttaaccggtaacgaccccg

SEQ ID NO: 153191 - DNA, 112 bp, Homo sapiens
  misc_feature: GYAE6OF02FTJ1R.47.82.H05.1.454.CMB.1.raw
  modified_base (111)..(112): a, c, t, g, unknown or other
  misc_feature (111)..(112): n is a, c, g, or t
tcagagctcacgtacacgaccggtgctcgatttagtcgagctctctcgcgggctgcctggtcaaggactacttcctatgtatactctgagcgggctggcaaggcgcatagnn

SEQ ID NO: 153192 - DNA, 110 bp, Homo sapiens; identical to SEQ ID NO: 153181
  misc_feature: GYAE6OF02FYLMP.47.82.H05.1.454.CMB.1.raw

SEQ ID NO: 153193 - DNA, 111 bp, Homo sapiens
  misc_feature: GYAE6OF02FNX3X.47.82.H05.1.454.CMB.1.raw
  modified_base (111)..(111): a, c, t, g, unknown or other
  misc_feature (111)..(111): n is a, c, g, or t
tcagagctcacgtacacgaccggtgctcgatttagtcgagctctctcgcgggctgcctggtcaaggactacttcctatgtatactctgagcgggctggcaaggcgcatagn

SEQ ID NO: 153194 - DNA, 668 bp, Homo sapiens
  misc_feature: GYAE6OF02I1XJ8.47.82.H05.1.454.CMB.1.raw
tcagagctcacgtacacgaccggtgctcgatttagtcgagctctctcgcgggtagaagtcacttatgagacacaccagtgtggccttgttggcttgaagctcctcaggaagcagcatcgggggtgccgcagccatggcctggaccgctctccttctgagcctccttgctcactttacagtttctgtgccttcctttgacctgactcagccactctcagtgtccgtggccctgggacaggacggccagacttaccgtggtagggggaatcaacagttaggaacgtaaaaatgtagaccacgtaggtaacccaacagaacgccgaggcccacggcccctgtccctggtcactactaagtaaggaactaaccgaaacccggtccctcgtacgggactcccgtagaaccgtattctaccgtggtacctacctaagttccggaactaaccgaccggtacccacccgtagaacccatcgacgcaacggacgacccgaaggtccggaagacgtaggacggtctacggtaccttagttttccgttagttaccgttaaagtttcgggaacctacgtttaccctcccggtacgttcgggtaccgggttacgttccgggaccgtaccggaaccgggtaccaaggtcccgtacggtaccccgttaccgtaacgtacccgg

SEQ ID NO: 153195 - DNA, 596 bp, Homo sapiens
  misc_feature: GYAE6OF02HG047.47.82.H05.1.454.CMB.1.raw
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
tcagagctcacgtacacgaccggtgctcgatttagtcgagctctctcgcgggtagaagtcacttatgagacacaccagtgtggccttgttggcttgaagctcctcaggaagcagcatcggggggtgccgcagccatggcctggaccgctctcctcctcggcctcctctctcactgcacaggctctgtgacgtccgacgagctgattcaggccaccctcgatgtcagtcggccccaggacagacggccaggattactgtgcggagcagtgttggagaaagagtgtacacgtggtaaccaanagatgccgaggccacggcccctgtcgctggtctctatgatgatagtcgaccgcctgnggactcccgagcgtattctcgtcgctacgagtcgtacgggaacnccgccacccgtgaccgtcacgcgacgggtcgacggtcgggtacgtggacggtccgttagtttacgttttcggtacgtagggttcggtagggtacgttaccgtttaagttttcgggtacctaaggtttacgtttgggtttacgggtttaccgggaccggggttaacggggtaccgtaacgggtccgttaacccggg

SEQ ID NO: 153196 - DNA, 851 bp, Homo sapiens
  misc_feature: GYAE6OF02IV2P0.47.82.H05.1.454.CMB.1.raw
tcagagctcacgtacacgaccggtgctcgatttagtcgagctctctcgcggggggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccacggcccctgtcctggtcatctataaggataccaaaccggccctcgtgggactccctagaacgtacttctcgtcggcctaccgtaacgttaccgggaaccaaaccgacccggaccccctaaccccgtaccgaacccgacttaccgaacgaccgaacggaaccggtaccccgaaaacgggttccgggaaacggtaacggttacggaacgggtccgtaacggttaaccttttaattttaccggttacgtttaacgtttaaaggttttacgggaaccttagtaccccgttccggtcgttacgggtaccgggtttacgttaccggggacccgtacgggaaacggggtaacccaaacgggtcccgttaccggtaaccccggttaccttaaacggtcctaaccgggtaaccccgaaagggtccccgttacccggtcccccgttaccgggttaaccctacccggtttccgttacccgtttaccccccgtaccccccgttccccggttaccccccgttcccctttaccccgttaccggggttaccgacccggttaccgtttccgtaacggggtcccgggtaccggggtacccggttcggggaaccggaaccggg

SEQ ID NO: 153197 - DNA, 603 bp, Homo sapiens
  misc_feature: GYAE6OF02HKJOJ.47.82.H05.1.454.CMB.1.raw
  modified_base (441)..(441): a, c, t, g, unknown or other
  misc_feature (441)..(441): n is a, c, g, or t
tcagagctcacgtacacgaccggtgctcgatttagtcgagctctctcgcgggtagaagtcacttatgagacacaccagtgtggccttgttggcttgaagctcctcaggaagcagcatcgggggtgccgcagccatggcctggaccgctctccttctgagcctccttgctcactttacagtttctgtgccttcctttgacctgactcagccactctcagtcgtccgtggccctgggacaggacggccagacttacctggtgggggaatcaacattggaacgtaaaaatgtgacactggtaaccaacagaacgccgaggccacggcccctgtcctggtcatctaataagactacaaaccggcctacgtgggactcctagaacgtattctctcggctaccgaattccggaacaacaccggcccaccctgaccatcagcacgacncccgaagtcggagatgaggtctagtacttatttctagtacttaaacgtttggactacgttaccgtccgtcgttcggtacgggttacgttccggggccgtacgggtaccgggaacccgtaacggtcccggttaaccggtaacccgttaccgtaaccgtaccgg

SEQ ID NO: 153198 - DNA, 555 bp, Homo sapiens
  misc_feature: GYAE6OF02FWMWX.47.82.H05.1.454.CMB.1.raw
  modified_base (376)..(376): a, c, t, g, unknown or other
  misc_feature (376)..(376): n is a, c, g, or t
tcagagctcacgtacacgaccggtgctcgatttagtcgagctctctcgcgggtagaagtcacttatgagacacaccagtgtggccttgttggcttgaagctcctcaggaagcagcatcgggggtgccgcagccatggcctggaccgctctccttctgagcctccttgctcactttacagtttctgtggcctcctttgacctgactcagccactctcagtgtccgtggccctgggacaggacggccagacttacctgtgggggaatcaacattggacgtaaaaatgtgcactggtaccaacagaagccaggccaggcccctgtcctggtcatctataaggatacaaaccggccctctgggatcccgtgaacgattcnctggctcaattcggacaacacgccaccctgaccatcagcagagcccaagtcggagatggagctgactatttctagttcaaaagttttgggaactagttcctaccgcgtacggcggttaacgtttccgggccgtccgaagggacccaaggccgttacggacccgttaccgtaagtacccg

SEQ ID NO: 153199 - DNA, 647 bp, Homo sapiens
  misc_feature: GYAE6OF02F0SSW.47.82.H05.1.454.CMB.1.raw
  modified_base (125)..(125): a, c, t, g, unknown or other
  misc_feature (125)..(125): n is a, c, g, or t
tcagagctcacgtacacgaccggtgctcgatttagtcgagctctctcgcgggtagaagtcacttatgagacacaccagtgtggccttgttggcttgaagctcctcaggaagcagcatcgggggtnccgcagccatggcctggaccgctctccttctgagcctccttgctcactttacagtttctgtggccttctttgacctgactcagccactctcagtcgtccgtggccctgggacaggacggccagacttacctggtgggggaatcaacattggaacgtaaaaatgtgcactaggtaccaacagaacgccaggccacggcccctgtcctggtcatctataaggataacaaaccggccctcgtcgggactccctagaacgtacttctcgtcggcctacctaacgtttccggaactaaccgaccggcccacccctcgacccactaccagccaacgacgacccaaggtccgggaagtacgtaggacggtcgtacgtactttacttttcgtacgttacgttaaagtttacgggaacttacgttccttaccgtcgttgggttacggttacgtttcgggacccggtacggtaaccgggggaccctaacgggtaccttaccggtaaccccggttaccgttaacggtacccgg

SEQ ID NO: 153200 - DNA, 530 bp, Homo sapiens
  misc_feature: GYAE6OF02IPA3Q.47.82.H05.1.454.CMB.1.raw
  modified_base (125)..(125): a, c, t, g, unknown or other
  misc_feature (125)..(125): n is a, c, g, or t
  modified_base (177)..(177): a, c, t, g, unknown or other
  misc_feature (177)..(177): n is a, c, g, or t
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagagctcacgtacacgaccggtgctcgatttagtcgagctctctcgcgggtagaagtcacttatgagacacaccagtgtggccttgttggcttgaagctcctcaggaagcagcatcgggggtnccgcagccatggcctggaccgctctccttctgagcctcttgctcactttacngtttctgtggccttctttgacctgactcagccactctcagtgtccgtggccctgggacagacggccagcttacctgtgggggaatcaacattggacgtaaaaatgtgcactggtaccaacagaagccaggccaggcccctgtccctggtcatctaataaggataacaaaccggccctctgggatccctagaacgtattctctggcctcattcgacaacaccgcaccctgaccancagcagacgccaagtcggagangaggctgacttatttctgtactaagtttcggactagtcctccgctggtcggttactcggtcgcgagggaccaggcctagacccgttcctaagtaccg

SEQ ID NO: 153201 - DNA, 813 bp, Homo sapiens
  misc_feature: GYAE6OF02JQ9CM.47.82.H05.1.454.CMB.1.raw
  modified_base (126)..(126): a, c, t, g, unknown or other
  misc_feature (126)..(126): n is a, c, g, or t
  modified_base (192)..(192): a, c, t, g, unknown or other
  misc_feature (192)..(192): n is a, c, g, or t
  modified_base (316)..(316): a, c, t, g, unknown or other
  misc_feature (316)..(316): n is a, c, g, or t
tcagagctcacgtacacgaccggtgctcgatttagtcgagctctctcgcgggtagaagtcacttatgagacacaccagtgtggccttgttggcttgaagctcctcaggaagcagcagtcgggggtnccgcagccagtcggcctaggaccgctctccttcgtgacgccttcctgcctacactttacagtttcnggtcgcccttctttgaccttgactcacgccactctcagtcgtccgtgccctgggacaggaccgcagacttacgtggtcggggatcaacagttaggaacgtaaaatgtgctacgtcggtaccaanagacgaccaggaccacggcccctagtccgtcggtactagtactaagtaaacggaactaacccgaaaccggtcccgtacgtacgggactacccgtaaggaacgtacttcgtccgtacggtacctaccgtaacgtttaccgggaaaccaaacccgtaccgggtaccccgtaaccccgtacggaaaccctaacgttaccgaaaccgtaccgaaaccggaacccggtacccccgtaaagggttacccggggaaagtaaccgggtttaccgggaacggggtccgttttaaacggtaaacccgtttttaccgtttttaccggttaacggtttaaaccgttaaaaccggttttttcgggaaacccgttaaccgtttccccggtaccgtaccggtttaccgggtacccgggtttaccgtttacccgggggccggttacccggaaaccgggtaccctaaacggtccccggttaacggaaccccggtttacccgtaaacggtcccgg

SEQ ID NO: 153202 - DNA, 645 bp, Homo sapiens
  misc_feature: GYAE6OF02F1JY4.47.82.H05.1.454.CMB.1.raw
tcagagctcacgtacacgaccggtgctcgatttagtcgagctctctcgcgggggggggtgccgcagccatggcctggaccgctctccttctgagcctccttgctcactttacagtttctgtggcctcctttgacctgactcagccactctcagtgtccgtggccctgggacagacggccagacttacctgtgggggaatcaacatggacgtaaaaatgtgcactggtaccaacagaagccatgccaggcccctgtcctggtcatctataaggataacaaacccggcctctgggatccctagaacgattctctggctccaattcggacaacacggccaccctgaccatcagcagacgcccaaggtcggagatggacggctgactattttctagtacctaaatttgggactactctacccgcgtcgtccgggttaacttccgggccggtccgaaacggggaacccaaaggtcctacggtacccggtacccttaaacggtccaacggaccccgaaacggcccgttccggccccccgttccggtcctaacccgttccttccgtttaccccctaccccgttcccgtccttaaccggtcgtacgtccttaccgtcggaccgggtaccgggccgtagggaccgaacgggccg

SEQ ID NO: 153203 - DNA, 616 bp, Homo sapiens
  misc_feature: GYAE6OF02IPNGW.47.82.H05.1.454.CMB.1.raw
  modified_base (125)..(125): a, c, t, g, unknown or other
  misc_feature (125)..(125): n is a, c, g, or t
  modified_base (180)..(180): a, c, t, g, unknown or other
  misc_feature (180)..(180): n is a, c, g, or t
  modified_base (405)..(405): a, c, t, g, unknown or other
  misc_feature (405)..(405): n is a, c, g, or t
tcagagctcacgtacacgaccggtgctcgatttagtcgagctctctcgcgggtagaagtcacttatgagacacaccagtgtggccttgttggcttgaagctcctcaggaagcagcatcgggggtnccgcagccatggcctggaccgctctccttctgacgtcctccttgctcactttacngtttctgtgccttcctttgacctgactcagccactctcagtgtccgtggccctgggacagaccggccagacttacctggtggggaatcaacattggaacgtaaaaatgtagcactggtaaccaacagaagccaggccacggccctgtcctggtcatctataaggatacaaaccgcctctgggactcccgtagaacgtacttctctggctaccaattcgactaacncggcccacctgaccatcagcagacgcccaagtcgagatcgagcctagacttatttcgtacgttacttaaagtttcgggaactacttaccgtccgtaccgtcggttccgggttaacttcccgggggacccgttacggaaacccggggtaacccttaacgggtacccgttaccggtaacccccgggttttaccccgtaaaccggttaccccgg

SEQ ID NO: 153204 - DNA, 553 bp, Homo sapiens
  misc_feature: GYAE6OF02GJX02.47.82.H05.1.454.CMB.1.raw
tcagagctcacgtacacgaccggtgctcgatttagtcgagctctctcgcggggggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggccctctgggactccctgaacgattctctggctccaattcgacaacacggccaccctgaccatcagcagacgccaagtcgagatgaggctgacttattctgtactaagttggacatctcgctgcgtagttcggcgcgagggacaacgctcgaccgtctaagtcacgaccgacggcctcgtccccctcgtccactccgttccgttccccaccctcctaccgtccgtcgtacgtccttcgtcggtacggccgggcgtcggaccgaggccgacg

SEQ ID NO: 153205 - DNA, 692 bp, Homo sapiens
  misc_feature: GYAE6OF02HAGYR.47.82.H05.1.454.CMB.1.raw
tcagagctcacgtacacgaccggtgctcgatttagtcgagctctctcgcgggtagaagtcacttatgagacacaccagtgtgccttgttggcttgaagctcctcaggaagcagcagtccgggggtgccgcagccatggcctggaccgctctccttctgacgcctccttgctctactttacagtttctggtcgccttcctttgacctgacctcagccactctcagtcgtccggtggcccgtgggacaggaccggccagtaccttaccgtgggtagggggaactcaacgtagttacggaacggtaaaaatggtgactactacggtaaccaaacgaaggaacgaccgacggaccgaccggcccctcggtcctggtactatactaagtaacggaactaccgaaaccggccctacggtacgggtaccttacccgtaggaaactcttccgtacgtcggtcctaccgtaacgttaccggaaccgtaaccgaaccggtcccctacccgtcgacccgtacgacggccggacggggtccggacgggtcggggtacgtggacgggtaccgtatttagtttcgtggtaggtggtggtagtatttaggttgacttgtagttggtttggtaccgggtacggggacggtacgaacggtccgtacggtcccgttccggccggttaccgaccggtaccgacgtccccgg

SEQ ID NO: 153206 - DNA, 776 bp, Homo sapiens
  misc_feature: GYAE6OF02GMDKG.47.82.H05.1.454.CMB.1.raw
tcagagctcacgtacacgaccggtgctcgatttagtcgagctctctcgcgggggggggtgccgcagccatggcctggaccgctctccttctgagcctccttgctcactttacagttttctgtggcctcctttgacctgactcagccactctcagtgtccgtggccctgggacagacggccagacttacctggtagggggaatcaacagttggaacgtaaaaatgtgcacgtacggtaccaacagaacgccacggccacggccctgtccgtgtcatctagtaaggactaaccgaaaccggtccctacgtcgggactcccgtagtaacgtattcctcgtcggtacctaccgtaacgttaccggaaccaaaccgacccggaccctaacccctacgaaccctacttaccgacggaccaacggaaccgtaccccgtaaaggtccgggaagtacgtacggacggtacttacgtaaccgttacttttcgttaggtaaccgttaaaggtttacgggtaactaacgttcccgtccgtacgtacggtacggttacggtccggtcggacggaacgggaaccaacggtccgtacggtacccgttaccgtaacgtacgaccggaccgaccggtccgtacccggtcccccgttacggtaccctacccgttccgttacccgtcccccgtaccccgttcccgttaccgtaccggttcggtaccggtccgttaccggtacgggtaccgggtacggggtcccggttacggacccggtacgggtcccgtaacggg

SEQ ID NO: 153207 - DNA, 823 bp, Homo sapiens
  misc_feature: GYAE6OF02FJB82.47.82.H05.1.454.CMB.1.raw
tcagagctcacgtacacgaccggtgctcgatttagtcgagctctctcgcgggggggggtgccgcagccatggcctggaccgctctccttctgagcctccttgctcactttacagtttctgtggcctcctttgacctgactcagccactctcagtcgtccggtggccctgggacagacggccagtacttaccgtggtaggggaatacaactattaggaacgtaaaatgtagcacgtaggtaaccaacgaagaacgccgacggaccgacggtcccctgtccgtaggtacaactacgtaaagtaaggtaactaaccgaaacccggtcccgtacgtacggtacctacccgtagtaactcttccgtcgtcggtaccttaccgtaacgttccggaaactaaccgaccggacccctaaccggtacaaccgtactacgaacgcgtaacgacgacccgaaggtcggaacgacgtacggtacggtaccgtaagttaacgttacgtttaccgtagttaaccgttaaagggttttacggaccttaaacgttccccggtaccgggacttacggggtaccggttaacgttaccgggaccggtaaccggtaaccgggaaccttaaccggccggttaaccgacccgttaacgtaacggtaaccgacccggtaacccggttacggacccgttccccggtaccccggttacggttaaccccttccttacccggtttacccgttaccccccaccgtttcccgttaacggtaccggttcgacccgtttcgtacggtaacggcgggttacccggtcggacgggaaccggtacgggtacctaacg

SEQ ID NO: 153208 - DNA, 725 bp, Homo sapiens
  misc_feature: GYAE6OF02JKJJR.47.82.H05.1.454.CMB.1.raw
  modified_base (122)..(122): a, c, t, g, unknown or other
  misc_feature (122)..(122): n is a, c, g, or t
tcagagctcacgtacacgaccggtgctcgatttagtcgagctctctcgcgggtagaagtcacttatgagacacaccagtgtggccttgtggcttgaagctctcaggaagcagcatcggggtnccgcagccatggctggaccgctcgtcctcgtgagtcctccttgcctcactttacagtttcgtcgccttcttgacctgactcgagcccacttctcagtgtcccgtggacccctgggacagacggccagtacttccgtgtcggggaatcaactagttaggaacgtaaaattgtcgcgacctaggtaaccaacgaataacgccgtaggacccgacgggtcccccttcgtacccgtcggtaccacttcgttaagtaacggaactaacccgtaaacccggccccgttacggtaccggtacgtacccgtttaggaaaccgttagttcccgttacgtcggaccctttaaccggagtttaccgaaccgtaaccgtacggtacccccaacccgtacaaccgtacgtaccgacgacctaaggacccgaacccgtaacgggtaccggaagaccgtacgggtagtacccgtacgtaccgtttagttccgttaacggtaacgttaaggttacggaacgtagttcccggtaccttcgtacgttccgggttaacgtaccggtccgacggtaccgaacccgtcgtaccgtacccggtaccgttaccggtaacgtacccg

SEQ ID NO: 153209 - DNA, 883 bp, Homo sapiens
  misc_feature: GYAE6OF02I7WRH.47.82.H05.1.454.CMB.1.raw
tcagagctcacgtacacgaccggtgctcgatttagtcgagctctctcgcggggggggtgccgcagccatggcctggaccgctctccttctgagcctccttgctcactttacagtttctgtggcctcctttgacctgactcagccactctcagtgtccgtggccctgggacagacggccagacttacctggtggggaatcaacattggacgtaaaaatgtgcactggtaccaacagaacgccgaggccacggcccctgtccgtggtcatctaataaggactaaccgaaacccggccctcgtagggtacctccccgttagaaccgttacttccgttaccgtacgggccttaccgtaacgtttccgggaaccgaaaccgacccgggaccccctaaccccctacggacccctaataccgacggaccgaacggaacccgaccccgtaaagggtacccggggtaagaacgttcgggaaccggtccgttaacggttaacttttaacgttttcccttagggtttaaacccgttaaacggttttaacgggggtaaccttaaccggtttacccgttaccccgggtacgtttacgggttaaccgggtttacggtttaccgggacccgggtaccggttaacccggggtaaacccgaacggttaccgttaccggtaaccccgtttaccgttaaacccgggttcgaacccgtaaccccgaccgggttaccccgtccccgggttaacccccccgttccggtcccgtacccgttacccggtttcccggtttaccccccgttccccgttaccccgttaccggtaaccggttaccggttacggtcgtttaccggtacggttaccgggccgggtacgccgggtaggaccgggaccccgtaag

SEQ ID NO: 153210 - DNA, 601 bp, Homo sapiens
  misc_feature: GYAE6OF02HWMU3.47.82.H05.1.454.CMB.1.raw
  modified_base (126)..(126): a, c, t, g, unknown or other
  misc_feature (126)..(126): n is a, c, g, or t
  modified_base (188)..(188): a, c, t, g, unknown or other
  misc_feature (188)..(188): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
tcagagctcacgtacacgaccggtgctcgatttagtcgagctctctcgcgggtagaagtcacttatgagacacaccagtgtggccttgttggcttgaagctcctcaggaagcagcagtcgggggtnccgcagccatggcctggaccgctctccttctgagccctccttgctcactttacagtttctgngccttctttagacctgactcacgccactcgtcagtgtccgtgcccgtggacagcggcagactacngngggatcaanatgaataaangngnacncggtacaagagaacgcagccacgccctgtccgngttcatctaataggaactaccgaaaccgccttgacgggtacnccgtacgacgtacttctcgtcgctaccgtacgttcgaacaaccgacgacctaccagaactagaccngactaacgaccgtaccgaaggtaccgaagtagngaggccgtaacgttacttacgtttcgtactaaagttaacgtttgggaactccgttcgtacccgcgttagggaacggttacgttccggaccggaaccggtgggaaacccgagtccgacccggtaaccgttaccgtaacggtaacccg

SEQ ID NO: 153211 - DNA, 757 bp, Homo sapiens
  misc_feature: GYAE6OF02IEIK1.47.82.H05.1.454.CMB.1.raw
  modified_base (125)..(125): a, c, t, g, unknown or other
  misc_feature (125)..(125): n is a, c, g, or t
  modified_base (156)..(156): a, c, t, g, unknown or other
  misc_feature (156)..(156): n is a, c, g, or t
  modified_base (246)..(246): a, c, t, g, unknown or other
  misc_feature (246)..(246): n is a, c, g, or t
  modified_base (490)..(490): a, c, t, g, unknown or other
  misc_feature (490)..(490): n is a, c, g, or t
tcagagctcacgtacacgaccggtgctcgatttagtcgagctctctcgcgggtagaagtcacttatgagacacaccagtgtggccttgttggcttgaagctcctcaggaagcagcatcgggggtnccgcagccatggcctggaccgctctccttcngacgccttccttgctaccgtactttacgtacgtttctggtcggtcccttccgttttacgaccttcgaaccttcgacgtcctacgtctacngttcgtccggtgcccgtgggacaggccgcaacgtacttaaccgtggtacgggggaactacgaacgtagttaacgggtaaacgttaaaaaatcggttagacctacgtaccggttaaacccaaacgaacggaaacgacccgacggacccgaccggtccccgtcgttccgtcgggttacacgttactaagtaagtacgtaacccgaaaccggtcctacggtcggacttcgacgtacgtattaccgtntccgtctaaccgtacgttaaccgaacgaaccccgtaccccggaccctaacccgttcgaaaccctcgtaaccgacgtaaccgacggaacccgtaacccggtacggtaaccgggaacggtacgtaacgggaggttaccgtacgttactttacgtttacgttcgtaagtttacgttcggtactactcgtactcgtacggtcttccggtacggccgaccggtaacgaccgtacggtacccgttaccggtaccgtacccgtacgtaacccgg

SEQ ID NO: 153212 - DNA, 822 bp, Homo sapiens
  misc_feature: GYAE6OF01BU4BA.9.66.F11.1.454.CMB.1.raw
  modified_base (235)..(235): a, c, t, g, unknown or other
  misc_feature (235)..(235): n is a, c, g, or t
tcagtgatacgtctcacgaccggtgctcgattagtcacgcgagaaggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcaatgacattggtntctaataactatcgtctcctaggtaaccaaacaactaaccccggacaaaaccgccccctaaaacttctttaggttatacgtaatgtactaagtcgttaccggccctacgaggtacgtttctcgtactcggtctttcgtcgtcggtacgacctaacgttcgtacggtcctaaccgaacccgggttccctttacccgtacgtaaccctagttcccgtcgtacgggtcccgtacccgagggtaccgttacgggaacgggtaacggtacgggtaccgttaggttaacttttaacgttttcgtacggtacgtacgtaaacccgttaaacgtaaaaaacggtaaacgttaccggtacccgtttcggtttaccggggtttaccgggggttttaccgggggtacccgggggggtaaccgtaaacggggttcccggtaacccggttacccgtacggtaaccggtaccgtaacccgggtaccccggtaaaccgggtcccgttaccccggttcccccggttcccgggttacccgttaacccgttccccggtttcccgttaccccccgggttccccttcccggttaccgtaaacccggg

SEQ ID NO: 153213 - DNA, 640 bp, Homo sapiens
  misc_feature: GYAE6OF01B10J2.9.66.F11.1.454.CMB.1.raw
  modified_base (236)..(236): a, c, t, g, unknown or other
  misc_feature (236)..(236): n is a, c, g, or t
  modified_base (318)..(318): a, c, t, g, unknown or other
  misc_feature (318)..(318): n is a, c, g, or t
tcagtgatacgtctcacgaccggtgctcgattagtcacgcgagaaggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaaccagcaatgacattggtntctataactatgtctctggtaccaacaactacccggacaaacgcccccaaactcttggttatgatgtcaatgttccggcctnaggtatttctgacttcgtctttctcgtggccgctaagtctcggctacgaccggtccttcctgacctatctccgtggcctccgaggctggacggacggaggacttggtatttatttcgtcgactacgtactaacaaaaaggtacgtaacgtcccgttacgttccgggttggggttttacccggggacggggggtaaccgtaacgggtccggacccgttcccgtacgtacggtccgaccggtaccgaacgggtcctacccggtcccccgttcggtaccctaccgttcccttccgttaccccctacccctcccgtacgtaacccg

SEQ ID NO: 153214 - DNA, 771 bp, Homo sapiens
  misc_feature: GYAE6OF01AP6VB.9.66.F11.1.454.CMB.1.raw
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
  modified_base (468)..(468): a, c, t, g, unknown or other
  misc_feature (468)..(468): n is a, c, g, or t
tcagtgatacgtctcacgaccggtgctcgattagtcacgcgagaaggggggggtctcgaggaggcagcgctctcgggacgtctccaccatggcctgggctctgctattcctcaccctcctcactcgagggccacgaacggttcctcggaccctagtctcgccctgacctcaacctcgcctccgtgtcgtggtcctcgtagacnggtcgatcacctatcctctncacgtaggaaccngacaatcgactagttggtctataataaactnttcgttacctcgttacgtaaccaacgtaactaccccggacaaaccgtacccctaaacgtttccgttaggttaatcgagttcgtactaacgtcgttacccgccgttagtacggtagtttcgtgacgttccgttaccttgtccggtggtacccgacgtacgttcgacggtacctaaccggtccgtcccttccgagtacccgtntccgtacgtccggtacctacgaggtcgtacgggacggacgtacggtcttaccgtttaatttccgtacgtcacgtaaccgtactaaacggtaaaacggtcgtacccgttcccggttgtttaccggggtttacggggtaccgggggaaccggggtaccgtaaacggttcccggtaccttaccgtagtaccggtacccgaccgttaacccgggagttaccccgtcccggtacccccggtttacggacctttccccgttaaccggtttccccgtaaccccgtaaccccttcgaaccggttaaaccgg

SEQ ID NO: 153215 - DNA, 845 bp, Homo sapiens
  misc_feature: GYAE6OF01BHFMQ.9.66.F11.1.454.CMB.1.raw
tcagtgatacgtctcacgaccggtgctcgattagtcacgcgagaaggggggggtctcaggaggcagcgctctcgggacgtctccaccatggcctgggctctgctattcctcaccctcctcactcgagggcacgacgggtcctggacccagtctcgccctgactcaacctgcctcgtgtcgtgggtctcctggacagtcgatcacctatcctcctgaccacgtacggaaccagacaatgactagttggtatacgttactaacttatcgttccgtaccgttacggtaacccaaaccgtaacccgtaccccggaaccaaaacccgtacccccttaaagttccgtttaggttactgtactcgtactaagttcggtcccggtcctacgtaggttacgtttcaggtaccttcgtccgttacgtccggtcggacccgtaccgtaacggttcccggtaccggtaccctaacccgggtaccccggttccctttaccgtaccgtacccgttacgttcccgttccgggtacccgggttacccgtacccggtaggggtaccggttaaacgggggtacgggtaaccgggttaccggtacgtttacggtttaaactttttccggttacgacccgaacgtaacggtaaacccgttaaaacgtaaaacgggtccgttacccgttcggtacccggtttggggtttacccgggggttaccggggaccgggttaaccgtaggttaaccccgtacgttaaccgtacggcccgtaccggaccggtacggtccccgtcccggccccggttactccctacccggttcccgttccccgaccccttacccgtcctacggtacgtaccccg

SEQ ID NO: 153216 - DNA, 662 bp, Homo sapiens
  misc_feature: GYAE6OF01AMKJL.9.66.F11.1.454.CMB.1.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
  modified_base (453)..(453): a, c, t, g, unknown or other
  misc_feature (453)..(453): n is a, c, g, or t
tcagtgatacgtctcacgaccggtgctcgattagtcacgcgagaaggggggggtctcaggaggcagcgctctcgggacgtctccaccatggcctgggctctgctattcctcaccctcctcactcagggcacagggtcctggacccagtctgccctgactcaactgcctccgtgtctgggtctcctggacagtcgatcaccatctcctgcactggaaccagacaatgactagttggtgtctaataactatgtcctccgtacggtaaccaacaacgtaccccgacaaaccgaccccctaaactctttaggtttaangtatgtacaagttcgttccgccctcgaggtacgtttcgngtactcgtcttctcgtcggcnccaagtctgctacnccgtcttccacgctactctcgtcggctcgngctaggacggacgagtntagttactttacgttcgngactaagtacgtaaacgtaaaagtcgtaaccgtcccttggttaccgggtttcggggtttacggggaccgggggtaactaacgggttcccgtaccgtaccgtgaccggttccgacggtaacccggacggtcccgttacccggtccccccgttcggtacccttaaccgttccccgtttacccgtaccccctcccgttaccgcgtaacccgg

SEQ ID NO: 153217 - DNA, 531 bp, Homo sapiens
  misc_feature: GYAE6OF02GNGZ5.9.66.F11.1.454.CMB.1.raw
  modified_base (520)..(520): a, c, t, g, unknown or other
  misc_feature (520)..(520): n is a, c, g, or t
tcagtgatacgtctcacgaccggtgctcgattagtcacgcgagaagggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcaatgacattggtgtctataactatgtctcctggtaccaacaataccccggcaaagcccccaaactcttggtttatgatgtcaatgttcggccctcaggagtttctgatcgcttctctggcgcaagtctggctacacggccttctgaccatctctggctccaggctggaggacgaggctgattatttctgcagctacaaaagagtacgccctctcggttggtttcgggcgggggtaccaagggtcgaccgttcctcgagtcgacgcccgaaggcctcgcccctcggtcactctcgtcccncctcctctacg

SEQ ID NO: 153218 - DNA, 574 bp, Homo sapiens
  misc_feature: GYAE6OF02IW9EJ.9.66.F11.1.454.CMB.1.raw
  modified_base (235)..(235): a, c, t, g, unknown or other
  misc_feature (235)..(235): n is a, c, g, or t
  modified_base (273)..(273): a, c, t, g, unknown or other
  misc_feature (273)..(273): n is a, c, g, or t
  modified_base (342)..(342): a, c, t, g, unknown or other
  misc_feature (342)..(342): n is a, c, g, or t
  modified_base (364)..(364): a, c, t, g, unknown or other
  misc_feature (364)..(364): n is a, c, g, or t
tcagtgatacgtctcacgaccggtgctcgattagtcacgcgagaaggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcaatgacattggtntctataactatgtctcctggtaccaacaataccccggnaaacgcccccaaactcttggttatgatgtcaatgtcggccctcaggtatttctgatcgcttctctggcncaagtctggctacacggcttcngaccatctctggctccagctgaggacgaggtctgtattattctgcgacgctacaaaagtagtacgcctcgtcgttggtttcgggcggggtacgaacgggtcgtaccgtccgtcgtacgtccgacgtcccgaagggtccttccggacccccgttcgggtaccctaccgtttccgtaccggtttcccccgcccgttacccgtccgtaaccgg

SEQ ID NO: 153219 - DNA, 623 bp, Homo sapiens
  misc_feature: GYAE6OF02HFVHJ.9.66.F11.1.454.CMB.1.raw
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
tcagtgatacgtctcacgaccggtgctcgattagtcacgcgagaaggggggggtcgtcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcaatgacattggtgtctataactatgtctcctggtaccaacaactaccccgganaaacgccccaaactcttggtttangatgtcaatgttcgcctnaggtagtttcngatcgcttcncgtgcncagtctggctacacggtccttctgacctatcctcgtgggcctccgacggtctaggaggacgaggctagtattttaacttcgtagctagtactaaacgaaaaaagtacgtacgtccccgttcgtttccgggtttacgggttttccgggggtacggggggaacctaagggtccggtacccgttccgtacgtacgtccgaacgacccgaagggtcctaccgtcccccgttggtaccgtaccgttccgtccgttcccccggacccttccgtaccgtaaccgg

SEQ ID NO: 153220 - DNA, 761 bp, Homo sapiens
  misc_feature: GYAE6OF02GDM8G.9.66.F11.1.454.CMB.1.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
tcagtgatacgtctcacgaccggtgctcgattagtcacgcgagaaggggggggtctcaggaggcagcgctctcgggacgtctccaccatggcctgggctctgctattcctcaccctctcactcagggcacagggtcctggacccagtctgccctgactcaacctgcctccgtgtctgggtctcctggacagtcgatcaccatctcctgcactggaaccngccaatgacagttggtcgtctataactntcgtctcctggtaccaacaactaccccggacaaacgcccccaaacttccttaggtttactacgtatcgtactaattccggttccggccctgaggtacgtttcgtagacttcgtcctttctccgtcgggccgtaccctaacggttcctcggtacctaaccgtaccgggttccctttcccgtacgaccccgtacgttccgttaccggtcgggtacctcccgtacgggtcttacgggacgggtaacggacggtcttacggttacttttacgtttacgtcgcgtaacgtaccttaaacgaaaacgtaacggtaacgtcccgttacgttcgggtttaccgggttttcgggggtaaccgggggtacctaacgggggttacctacccggtcccgttaccgtacggtcccgtaacggtacccggaacgggttaccgtccccgttcccccggttacccggttaccctaacccggttcccgtttcccggttcccccgtttccccgttacccgtcgttaacccgg

SEQ ID NO: 153221 - DNA, 705 bp, Homo sapiens
  misc_feature: GYAE6OF02JHN21.9.66.F11.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
tcagtgatacgtctcacgaccggtgctcgattagtcacgcgagaaggggggggtctcaggaggcagcgctctcgggacgtctccaccatggcctgggctctgctattcctcaccctcctcactcagggcacagggtcctggacccagtctcgccctgactcacctgcctcgtgtctgggtctcgtggacngtcgatcacntcnctgcntcggaacngcaatcgacnttggtntactatatatgtccnctgtaccaanaactacccgacaacgcccctaaatcgttggttangtactgtactagtcgttccggcctacgtacggttagttaccgtgtactcgtacttctcgtcggaccgactacgtcgtgctacgtaccgttccttccgtacgacctcttccgtacggtccggtccgtcgtacgtcggtacgcgggacgtcgtacttagttacttactttcgacgtctaccgtaacgtaaacgtaaacgtacgttacggtcccttacggtttaccggtttccgggggttttaacgggggacccgggggtaacgttaaccggggttaccgttaccccggttccgttccggaacgtttcccgacgggtacccggtaccggttaccgtccccggggttaccccgttccggttacccgtcccgtttaacgttcccccgttaccctcccggttccctaacccggttacccg

SEQ ID NO: 153222 - DNA, 542 bp, Homo sapiens
  misc_feature: GYAE6OF01DNKEF.10.73.G07.1.454.CMB.1.raw
  modified_base (268)..(268): a, c, t, g, unknown or other
  misc_feature (268)..(268): n is a, c, g, or t
tcagcatagtagtgcacgaccggtgctcgatttagctctacgctcagggggagtcagtctcagtcaggacacagcatggacatgagggtcccgctcagctcctggggctcctgctactctggctccgaggtgccagatgtgacatccaaatgacccagtctccatcctccctgtctgcatctttaggcgacagagtcaccattacttgccgggcaagtcagagcattaccaacttctttaaattggtttcaacagaggccagggaaancccctaagctcctggtctatggtgcatccactgtgcaaacgtggggtcccatccaggttcagtgcagtggatttgggacagtatttcactctcaccatacaacaatctgcagtcctgatgactttcgactaacttactactgtacaacagagttaccacgaccgcctaatcctacgtttaccggccctagggaaccctaaagtcgggtaataagtacgaaaggccgtaaacgttggtacggccttaggaccaaccgtaattccgttggttaccc

SEQ ID NO: 153223 - DNA, 893 bp, Homo sapiens
  misc_feature: GYAE6OF01DTBK5.10.73.G07.1.454.CMB.1.raw
tcagcatagtagtgcacgaccggtgctcgatttagctctacgctcagggggagtcagtctcagtcaggacacagcatggacatgaggtccccgctcagctcctggggctcctgctactctggctccgaggtgccagatgtgacatccaaatgacccagtcctccatccctccctgtctgcatctttaggcacagagtcaccattacttgccgggcaagtcagagactaattaaccaacttactttaaaatttcggtttacaaacgagacgggaccgaaggggaaacgacccccgtaaagcctccgtgggttacctaagtcgggttagcctactccctacgtgtacgactaaacggttcggggtacccctacgtccgtaagggtttcgtaaggttcgggacgtagggttagggtaacggttttacggggaactaacggttacgttttacctaactttcccttaacctaacccggtaactttaaccaaaacctaaacttacccgttacgaccgtaaccggtaccccgttagggtaactttaccgggttaaactttttacccggtaacccttaaaacctttttaacccgttaaaccgtttaccgtaacgtaaaaccgtaacggttaacggtttaacccgtaaaccggaaccccggtaacccctaaaaccggtttaacccccttaacccgggtttttacccccggggtaacccccggttaaccggggggtaaaccccgttaaaaacggggttaaccgggttaaaacgtttaaccggtaaacccggtaaaaccgggtacccggttaaaaccggtttacggggttaaccggggttcccgttaaccgggtacccctaaaccccgttaaccgtttacccggtttccggtttttaaaccccg

SEQ ID NO: 153224 - DNA, 567 bp, Homo sapiens
  misc_feature: GYAE6OF01COR7K.10.73.G07.1.454.CMB.1.raw
  modified_base (270)..(270): a, c, t, g, unknown or other
  misc_feature (270)..(270): n is a, c, g, or t
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaacttctttaaattggttacaacagaggccaagggaacnccctaagctctggtctatggtgcatccactgtgacaaacgtcgggtacccatccgaggttcaggtggctaggtggtatttgggactagtactttcactctacaccatacaaactatctcgcacgtcctagattagtactttacgactaactttactactgtacaactagtacgttaaccacggtaccgacctaacttcctaccgtttccggacccgtagggaaccctaaaggtgtaactacgtaccgaaagtcgtaaacgtggtaggcctacggaccaacctattccgttgttaccc

SEQ ID NO: 153225 - DNA, 504 bp, Homo sapiens
  misc_feature: GYAE6OF01AT983.10.73.G07.1.454.CMB.1.raw
  modified_base (428)..(428): a, c, t, g, unknown or other
  misc_feature (428)..(428): n is a, c, g, or t
  modified_base (496)..(496): a, c, t, g, unknown or other
  misc_feature (496)..(496): n is a, c, g, or t
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcacaattacttgccgggcaagtcagagcattaccaactctttaaattggtttcaacagaggccagggaagcccctaagctcctggtctatggtgcatccactgtgcaaactggggtcccatccaggttcagtgcagtggatttgggacagatttcactctcaccatcaacaatctgcagccctgatgatttcgactaacttactactgtacaacagagttaaccacggacncctaatctaacctttcgcccgtagggaccaaagtcggaattatcgaagacgaactgtggctgaccacntcctgtcc

SEQ ID NO: 153226 - DNA, 726 bp, Homo sapiens
  misc_feature: GYAE6OF01AH76E.10.73.G07.1.454.CMB.1.raw
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacataccaaatgacccagtctccatccctcctgtctgctatcgtttaggcgacagacgtccacctattacgttcggccgggacaagtcaggacgtcctaacttaccaacttactttaaagttcggtttacaacgagtacggaccgaaggggaaaccgtccccgtaagccttaccgtggtcctagtggtcgcctactcctacgtgtacgaaccgtaaacggtcggggtaccctacgtaccgtaggttcgaggtcggacgtaggtggtagtttacgggactaagtactttacacttcctaccacctactacaactatccgtagtaccgagtacccgtagtattacgttacgtttaccgaccttaaaccgttacttacgtacgtaacctaacgtaacgtaacgttaacccgaaccgtacctaaccgttaacgttacccgttaccggtttaccccgggtacccggtaacgggtaaacccgtaaagggttcgggaaactttaacgtaccgtaaaggtcccggtaaacggttcgggtaccggtacccgttaccgaccctaacccgtttacgttccgttccgtttaccccg

SEQ ID NO: 153227 - DNA, 564 bp, Homo sapiens
  misc_feature: GYAE6OF01AE14K.10.73.G07.1.454.CMB.1.raw
  modified_base (266)..(266): a, c, t, g, unknown or other
  misc_feature (266)..(266): n is a, c, g, or t
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatcttaggcgacagagtcaccattacttgccggcaagtcagagcattaccaacttctttaattggttacaacagaggccagggaacncccctaagctcctggtctagtggtgcactccacgtgtacgaccaaacgttcggggtaccccagtccgtacggttacaggtcggcgtaggtggtagttttacgggactagtatttcacttctacacctatacaactaatcgtgcagtcctagtatcgtattcgactaacttactactcgtacaacgagtacgtacacgaccgacctaactcctaccgttccggacccgtacggtaaccaaggtcggtaactagtacgaacggcgtaacgttgtacgctacgaccacctactctcgttcc

SEQ ID NO: 153228 - DNA, 697 bp, Homo sapiens
  misc_feature: GYAE6OF01COE49.10.73.G07.1.454.CMB.1.raw
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
tcagcatagtagtgcacgaccggtgctcgatttagctctacgctcagggggagtcagtctcagtcaggacacagcatggacatgacgggtccccgctcagctcctggggctcctgctactctggctccgaggtgccagatgtgacataccaaatcgacccagtctccatccctcctgtctgctattcgtttaggcgacagacgtcacctatttacgttgccgggacaagtcagagactattaccaacttctttaaagttggtttacaacgtagacggaccaagggaacnccctaagctcgtggtactatggtncatccatgtgactaacgtcgggtacccagtaccgtaggttccaaggtcggacgtagggttggtagttttacggggaactaggttactttcgacttcctacgaacctatacctaaataacttcgtacgacgtacgtacgttagtacttacggttaactttccgaacctttaaacttacctaacgttcgaaacctaacgtaacgttaacgtttaacccgaacgtaccgtaacctaactttccgttaacccgtttaccgggaccccgtaagggaaacccgtaaagggtaccggttaaataaccgtaaccggtaacggtaaccggtaacgttcgggtaaggtcccttacggaacccctaaaccgttcttccggtttaccgtttacccc

SEQ ID NO: 153229 - DNA, 655 bp, Homo sapiens
  misc_feature: GYAE6OF01CHXDP.10.73.G07.1.454.CMB.1.raw
tcagcatagtagtgcacgaccggtgctcgatttagctctacgctcagggggagtcagtctcagtcaggacacagcatggacatgacgggtccccgctcagctcctggggctcctgctactctggctccgaggtgccagatgtgacataccaaatcgacccagtctccacttcctcctgtctgctattcgttaggcgacagacgtcaacctattacgttcggccgggacaagtcagacgctaacttaaccaactttactttaaagttcggtttacaacgtaggacggaccggaaggggaaccgtaccctaagtcctccgtggttactaagttcgggtcactacgtccaacgttcgtacgaccgtaaacgttccggggtaccctagtacccgtaggttccgaggtcggcgtagggtaggtagtttcgggaactagtacgtttaccactcctacaacctatacaactaacttcgagaccagtccgttaagtctacgtactttccgaacttaacttactactactaacaactacgtaacttacgaacctaccgactaactcgttaccgttccggaccgtaacggaactaacggtgaactagtaaccgacgggtactaacgtgggaacgtccgtacaccgttactcgttgttcttacccg

SEQ ID NO: 153230 - DNA, 624 bp, Homo sapiens
  misc_feature: GYAE6OF01CBZRB.10.73.G07.1.454.CMB.1.raw
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
tcagcatagtagtgcacgaccggtgctcgatttagctctacgctcaggggggagtcagtctcagtcaggacacagcatggacatgagggtccccgctcagctcctggggctcctgctactctggctccgaggtgccagatgtgacataccaaatgacccagtctccatccctccctgtctgcatcgttaggcgacagagtcacctattacgttggccgggacaagtcagagcaattaaccaacttacttttaaaagtttcggtttacaacaggacggaccgaaggggaaacgacccctaagcctccgtggtctagtcggtcgcactccacgtggtacgacgtaaacggtcgggtacccagtcccgtaggttcaggtggactaggtggtagtttgggactagtattcactcacactactacaactatcngcagtctagactntactttcgaacttaacttactactacgtaacaagtacgtaacgtaaccgacgtaaccaccgtaacttaccgttaccgtttaccgggacccgttaacgggaaacctaaagggtgtaacttacgaacggtaacgacggtaacgttcggacggtactaccgacctaaccgtcttcgttacgttacc

SEQ ID NO: 153231 - DNA, 483 bp, Homo sapiens
  misc_feature: GYAE6OF02G40FT.10.73.G07.1.454.CMB.1.raw
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaacagaggccagggaaagcccctaagctcctggtctatggtgcatccactgtgcaaactgggtcccatccaggttcagtggcagtggatttgggacagatttcactctcaccatcaacatctgcagcctgatgatttcgctaacttactactgtcaacagagttacacgacgccaatcactttcgccctaggaccaagtggatagtcaagcgaactgtgctgcaccatctgtc

SEQ ID NO: 153232 - DNA, 528 bp, Homo sapiens
  misc_feature: GYAE6OF02HUVZS.10.73.G07.1.454.CMB.1.raw
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaaattggttttcaacagaggccagggaaagcccctaagctcctggtctatggtgcatccactgtgcaaactggggtcccatccaggttcagtggcagtggatttgggacaggatttcacttctcaccatcaacaatctgcagcctgatgattttcgactaactttactacttgtacaacagtagttaccacgacgacccaaagtccagttttcccggccttacgggaaccaagtggactagtccaaaggcgtaaacttggtggctcgcctaaccattcctggttaccc

SEQ ID NO: 153233 - DNA, 528 bp, Homo sapiens
  misc_feature: GYAE6OF02JF3G5.10.73.G07.1.454.CMB.1.raw
  modified_base (377)..(377): a, c, t, g, unknown or other
  misc_feature (377)..(377): n is a, c, g, or t
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaactagaggccagggaaacgcccctaagctcctggtctatggtgcatccactgtgcaaacgtggggtcccatccaggttcagtggcagtggatttgggacagattcactctcaccatcaacaatccngcagcctgatgactttcgcttaacttactactgtacaacagacttacacgacgaccaactcctacgtttccggcccttagggaaccctaaaggtcgaatacgtacaagccgtaaacgtcggtaggcttgacctaccacttctacggttacc

SEQ ID NO: 153234 - DNA, 536 bp, Homo sapiens
  misc_feature: GYAE6OF02IHZ8R.10.73.G07.1.454.CMB.1.raw
  modified_base (215)..(215): a, c, t, g, unknown or other
  misc_feature (215)..(215): n is a, c, g, or t
  modified_base (348)..(348): a, c, t, g, unknown or other
  misc_feature (348)..(348): n is a, c, g, or t
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcacagagtcaccattacttgcccgggnaagtcagagcattaccaacttactttaaattggtttacaacagaggccaaggaaacgccctaagctcctggtctatggtgcatccactgtgacaaacgtcgggtacccatcctaggttcaggtcggcagtggntttgggactagtattcactctcacactacaacaatctgacagtcctagatgtactttcgacctaaactttactacttagtacaacagtacgttacaacgaccactaatcctacgtttccggacccgttaggaacctaagtgaactatacgaagtcgaacgttgtcgctcgaccacctatcctagttcc

SEQ ID NO: 153235 - DNA, 489 bp, Homo sapiens
  misc_feature: GYAE6OF02I6F94.10.73.G07.1.454.CMB.1.raw
  modified_base (453)..(453): a, c, t, g, unknown or other
  misc_feature (453)..(453): n is a, c, g, or t
tcagcatagtagtgcacgaccggtgctcgatttagctctacgctcagggggagtcagtctcagtcaggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaacagaggccagggaaagcccctaagctcctggtctatggtgcatccactgtgcaaactgggtcccatccaggtccagtggcagtggatttgggacagatttcactctcaccatcaacaatctgcagcctgatgatttcgcaacttactactgtacaacagagttacacgacgcaatcactttcgcctgggaccaagtgatancaagcgtaactgtggctcgaccacgactctgttacc

SEQ ID NO: 153236 - DNA, 163 bp, Homo sapiens
  misc_feature: GYAE6OF02IVYN0.10.73.G07.1.454.CMB.1.raw
  modified_base (144)..(163): a, c, t, g, unknown or other
  misc_feature (144)..(163): n is a, c, g, or t
tcagcatagtagtgcacgaccggtgctcgatttagctctacgctcagggccgaaagtggatatcaagcgaactgtgctgcaccatctgtcttcatcttccgccatctgacactactatgctgagcggctggcaaggcgcatagnnnnnnnnnnnnnnnnnnnn

SEQ ID NO: 153237 - DNA, 814 bp, Homo sapiens
  misc_feature: GYAE6OF02JNL79.10.73.G07.1.454.CMB.1.raw
  modified_base (168)..(168): a, c, t, g, unknown or other
  misc_feature (168)..(168): n is a, c, g, or t
  modified_base (231)..(231): a, c, t, g, unknown or other
  misc_feature (231)..(231): n is a, c, g, or t
tcagcatagtagtgcacgaccggtgctcgatttagctctacgctcgagggggagtcagtctcagtcaggacacagcatggacatgagggtccccgctcagctccgtggggctcctgctactctggctccgaggtcgccagatgtgacataccaaatcgacccagtccncctactccctccctgtctcgctattcgttaggcgacagcgtacacctattacgtcggaccggnaacgtcaagtcgctaacttaaccaactttacttttaaaagttcggttacaaacgaacggtacggaccgaaacgggtaaccgtacccccgtaagtccccttaccggttaggttaccttacggttcggttacgtacctacgttcccgtacgttacggtactacggtaaaaccgggttccggggtacccctagttaccccggtagggtttaccgacgggtacggtaccgtaacgggttggggttaacgtttacgggaaccgttagtttacgtttacccacgttacttacccgaactacttaccaaacgttacctacgtcgtacctacggtaccgttacgtatacggttaacttccggtaaccttaaccggtttacctacgtaacgtaaccgttaaactcggttaaccgttaaccgacccggttaacctacccgttaaacgttcccggttaaccgttttcccggaacccgggtttaaccggaaaccgttaagttccggtaaattaccggttacggaaccggtaccgtaaccgggttcgttaacggccttaccgtacccgtaacctttccgttccgttaccttacccg

SEQ ID NO: 153238 - DNA, 402 bp, Homo sapiens
  misc_feature: GYAE6OF01CDDYD.23.27.C05.1.454.CMB.1.raw
  modified_base (238)..(238): a, c, t, g, unknown or other
  misc_feature (238)..(238): n is a, c, g, or t
  modified_base (399)..(402): a, c, t, g, unknown or other
  misc_feature (399)..(402): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttccccctggcgccctgctccaggagcacctctgggggcacagcggccctgggctgcctggtcaaggactacttccatactcgcgtctgagcgggctggcaaggcgcatagnnnn

SEQ ID NO: 153239 - DNA, 190 bp, Homo sapiens
  misc_feature: GYAE6OF01CH0I1.23.27.C05.1.454.CMB.1.raw
  modified_base (187)..(190): a, c, t, g, unknown or other
  misc_feature (187)..(190): n is a, c, g, or t
tcagacgcgagtatcacgaccggtgctcgatttagacgcgatcgaagggtttggggaggtgtgtcacaagatttgggctctgggcaccgtgggcacggggaggtgtgtcacaagatttgggccctgggctgcctggtcaaggactacttccatactcgcgtctgagcgggctggcaaggcgcatagnnnn

SEQ ID NO: 153240 - DNA, 588 bp, Homo sapiens
  misc_feature: GYAE6OF01CQ8SZ.23.27.C05.1.454.CMB.1.raw
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatcctgctgggctgggtccggcaaccccgagggaaggtcttgagtggattggagatatctgtcccggtagggcacttattacaacccgtccctacaaaacgacgggccgcctatcgagggacacggaccaagaaggaatctcgctgtagtttgacttctgtgaccgcgcagacacgccgtntattttgngcgaggagaaactctacttcgatcgtcgtggggccgcggctagtcctggtcctacgttcgtccttcccgtccgggcctttccccgaaccgtaacgggtccccctaacgttcccggttccctttccccccgtgggtcccgtcccctggtccctacccgg

SEQ ID NO: 153241 - DNA, 399 bp, Homo sapiens
  misc_feature: GYAE6OF01EHBW0.23.27.C05.1.454.CMB.1.raw
  modified_base (398)..(399): a, c, t, g, unknown or other
  misc_feature (398)..(399): n is a, c, g, or t
tcagacgcgagtatcacgaccggtgctcgatttagacgcgatcgaagggtcttgagtggattggagatatctgtcccggtagggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctctgggggcacagcggccctgggctgcctggtcaaggactacttccatactcgcgtctgagcgggctggcaaggcgcatagnn

SEQ ID NO: 153242 - DNA, 559 bp, Homo sapiens
  misc_feature: GYAE6OF01ACTHJ.23.27.C05.1.454.CMB.1.raw
  modified_base (447)..(447): a, c, t, g, unknown or other
  misc_feature (447)..(447): n is a, c, g, or t
  modified_base (484)..(484): a, c, t, g, unknown or other
  misc_feature (484)..(484): n is a, c, g, or t
  modified_base (519)..(519): a, c, t, g, unknown or other
  misc_feature (519)..(519): n is a, c, g, or t
  modified_base (532)..(532): a, c, t, g, unknown or other
  misc_feature (532)..(532): n is a, c, g, or t
  modified_base (547)..(547): a, c, t, g, unknown or other
  misc_feature (547)..(547): n is a, c, g, or t
  modified_base (554)..(554): a, c, t, g, unknown or other
  misc_feature (554)..(554): n is a, c, g, or t
tcagacgcgagtatcacgaccggtgctcgatttagacgcgatcgaagggtttggggagtcagaccctgtcaggacacagcatggacatgagggtccccgctcagctcctgggctcctgctgctctggctccaggaacgaggtgacgttcgagatcgaaccgcgtcctccaccctcctgtctgcagtccgtggttcggggaccagtcaccatcacgttgccgggcagtcgtgactatttcggtcttagctggtatacaaacaaaacctggttcgccctacgtctcgtcgctgtcactgacgagttacgaaaggtcggtaccatcgagtattcgagtcggcaggtggaggtcggtaccttttacacttcacacaacgtcgccgctgcggtcttaggaacgttagtttcgggactttacgtctgacagctagtatacatacgtaccgtanacgtagttcggaccgaacgggtacaaaggttcaactnaacgtacgacttgacgctcgactaccatcttcgtntcctatcccgtcnctatcagaacttcgngcttcgngacgg

SEQ ID NO: 153243 - DNA, 538 bp, Homo sapiens
  misc_feature: GYAE6OF01BHI21.23.27.C05.1.454.CMB.1.raw
  modified_base (494)..(494): a, c, t, g, unknown or other
  misc_feature (494)..(494): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttgccgggcgagtcgtgacattttcggttctttagtctggtatcaaacaaaaaccagggtttcgcccctaccgtcctcgtcgctgtcactgacgagttacaaagtgggtcccatcgagattcagtgcagtggaggtgggacctttacactctcacaatcgccggcctgcgcctgaagtatttgggacttactctgtcagcagtattacatagtcccgtacactatttggtcaggggacctaaagttcgactcatacgaactgtggctgcacatctgtcttcnttccttcccgctacgttctagtaacttactcgcgttctggacgg

SEQ ID NO: 153244 - DNA, 208 bp, Homo sapiens
  misc_feature: GYAE6OF01EC3RY.23.27.C05.1.454.CMB.1.raw
  modified_base (168)..(208): a, c, t, g, unknown or other
  misc_feature (168)..(208): n is a, c, g, or t
tcagacgcgagtatcacgaccggtgctcgatttagacgcgatcgaagggtttgggggagggtggtgtcacaagatttgggctctgggcacgagcggcccctgggcctgcctggtccaaggactacttccattactcgcgtctggagcgggctggcaaggtcgcatagnnnnnnnnnnnnnnnnnnnnnnnnnnnnnnnnnnnnnnnnn

SEQ ID NO: 153245 - DNA, 401 bp, Homo sapiens
  misc_feature: GYAE6OF01CQ3DX.23.27.C05.1.454.CMB.1.raw
  modified_base (398)..(401): a, c, t, g, unknown or other
  misc_feature (398)..(401): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttcccctggcgccctgctccaggagcacctctgggggcacagcggccctgggctgcctggtcaaggactacttccatactcgcgtctgagcgggctggcaaggcgcatagnnnn

SEQ ID NO: 153246 - DNA, 404 bp, Homo sapiens
  misc_feature: GYAE6OF01AUDNC.23.27.C05.1.454.CMB.1.raw
  modified_base (399)..(404): a, c, t, g, unknown or other
  misc_feature (399)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggtcgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctctgggggcacagcggccctgggctgcctggtcaaggactacttccatactcgcgtctgagcgggctggcaaggcgcatagnnnnnn

SEQ ID NO: 153247 - DNA, 222 bp, Homo sapiens
  misc_feature: GYAE6OF01CBVF3.23.27.C05.1.454.CMB.1.raw
  modified_base (218)..(222): a, c, t, g, unknown or other
  misc_feature (218)..(222): n is a, c, g, or t
tcagacgcgagtatcacgaccggtgctcgatttagacgcgatcgaagggtttgggggaagaggaagactgacggtcctcccaggagttcaggtgctgggcaccttgggcacgggggaggtgtgtcacaagatttgggctctgggcacagcggccctgggctgcctggtcaaggactacttccatactcgcgtctgagcgggctggcaaggcgcatagnnnnn

SEQ ID NO: 153248 - DNA, 550 bp, Homo sapiens
  misc_feature: GYAE6OF01BN1NK.23.27.C05.1.454.CMB.1.raw
  modified_base (433)..(433): a, c, t, g, unknown or other
  misc_feature (433)..(433): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccagggaaggtctgagtggattggagatatctgtcccggtaggggcacttattacaacccgtccctacaaaagacgggccgccctatcaggggacacggccaagaaggaattctcgctgagtttgactttctgtgaccgccgcagacacggccgtctattttgngcgaggagaactactacttcgatctcgtggggccgcggcatcctggtcacgtgtctcctcggcttccaccgacggtccccagtccggtccttcccccgtggccctccctgcctaccg

SEQ ID NO: 153249 - DNA, 643 bp, Homo sapiens
  misc_feature: GYAE6OF01C5HI3.23.27.C05.1.454.CMB.1.raw
  modified_base (267)..(267): a, c, t, g, unknown or other
  misc_feature (267)..(267): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaaggtgacgttcagatgacccagtctccaccctccctgtctgcatctgttggggaccgagtcaccatcacttgccgggcgagtcgtgactattttcggttctttagtctggtatcaacaaaaaccnggtttcgcccctaccgtcctcgtcgctgtcactgacgagttacaaagtgggtcccatcgagattcagtgcagtggaggtggactttacactctcacatcgcggctgcgctgagtattttggacttactctgtcagcagttattacatacgtcccgtacactagtttcggacctaaggggaaccctaaaggtttcgaacccttacgaagttaacccggtaaacttggtacgggtccttcggacctaaccctagtttcccgttcggtttccctttacctaacgttttcccctttccccccggtacccttaaccgtttccgtttaacggtaaaactttacccgttccgggttacccggttccgtttcgggaaccggggg

SEQ ID NO: 153250 - DNA, 572 bp, Homo sapiens
  misc_feature: GYAE6OF01CUOFO.23.27.C05.1.454.CMB.1.raw
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatcctgctgggctgggtccggcaaccccgagggaaggtcttgagtggattggagatatctgtccggtagggcacttatacaacccgtccctacaaaagacgggccgcctatcgaggggacacggcaagaagaatctcgctgagtttgacttctgtcgaccgcgcagacacggccgtntattttgngcgagganaaactactacttcgatctcgtcggggccgcggcacgttccgtggtccacgttcgtcctcccgtcggcctttacccgaccgaacgggcccctacgttcccggtccctttccccccgtggcccgcccctgccctacccgg

SEQ ID NO: 153251 - DNA, 404 bp, Homo sapiens
  misc_feature: GYAE6OF01BQ26Z.23.27.C05.1.454.CMB.1.raw
  modified_base (398)..(404): a, c, t, g, unknown or other
  misc_feature (398)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttcccctggcgccctgctccaggagcacctctgggggcacagcggccctgggctgcctggtcaaggactacttccatactcgcgtctgagcgggctggcaaggcgcatagnnnnnnn

SEQ ID NO: 153252 - DNA, 404 bp, Homo sapiens
  misc_feature: GYAE6OF01DF29X.23.27.C05.1.454.CMB.1.raw
  modified_base (238)..(238): a, c, t, g, unknown or other
  misc_feature (238)..(238): n is a, c, g, or t
  modified_base (397)..(404): a, c, t, g, unknown or other
  misc_feature (397)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttcccctggcgccctgctccaggagcacctctgggggcacagcggccctgggctgcctggtcaaggctacttccatactcgcgtctgagcgggctggcaaggcgcatagnnnnnnnn

SEQ ID NO: 153253 - DNA, 402 bp, Homo sapiens
  misc_feature: GYAE6OF01A6EUC.23.27.C05.1.454.CMB.1.raw
  modified_base (398)..(402): a, c, t, g, unknown or other
  misc_feature (398)..(402): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctctgggggcacagcggccctgggctgcctggtcaaggactactccatactcgcgtctgagcgggctggcaaggcgcatagnnnnn

SEQ ID NO: 153254 - DNA, 516 bp, Homo sapiens
  misc_feature: GYAE6OF01CZ109.23.27.C05.1.454.CMB.1.raw
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (510)..(510): a, c, t, g, unknown or other
  misc_feature (510)..(510): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgactattttcggttctttagtctggtatcaaacaaaaaccagggtttgcccctaccgtcctcgtcgctgtcactgacgagttacaaagtggggtcccatcgagattcagtggcagtggaggtgggacctttacactctcacatcgcgctgcgctgagtatttggacttatctgtcagctagtattacatacgtccctacactatttggacctaggggacaagttgacctcatacgactgtgctgcacntctgtctcactctcccgcntctntactactgcgtntggacg

SEQ ID NO: 153255 - DNA, 546 bp, Homo sapiens
  misc_feature: GYAE6OF01AF4YC.23.27.C05.1.454.CMB.1.raw
  modified_base (434)..(434): a, c, t, g, unknown or other
  misc_feature (434)..(434): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccagggaagggtcttgagtggattggagatatctgtcccggtaggggcacttattacaacccgtccctcaaaagcgggccgccctatcaggggacacggccaagaaggattctcgctgagtttgacttctgtgaccgccgcagacacggccgtctatttttgngcgaggagaactactacttcgatctcgtggggccgcggcacttcctggtcactgtctcctcggcttccaccacggcccagtccggtccttcccccgtggccgccctgctccg

SEQ ID NO: 153256 - DNA, 401 bp, Homo sapiens
  misc_feature: GYAE6OF01C216C.23.27.C05.1.454.CMB.1.raw
  modified_base (238)..(238): a, c, t, g, unknown or other
  misc_feature (238)..(238): n is a, c, g, or t
  modified_base (397)..(401): a, c, t, g, unknown or other
  misc_feature (397)..(401): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaaggcccatcggtcttcccctggcgccctgctccaggagcacctctgggggcacagcggccctgggctgcctggtcaaggactacttccatactcgcgtctgagcgggctggcaaggcgcatagnnnnn

SEQ ID NO: 153257 - DNA, 400 bp, Homo sapiens
  misc_feature: GYAE6OF01CXWKW.23.27.C05.1.454.CMB.1.raw
  modified_base (395)..(400): a, c, t, g, unknown or other
  misc_feature (395)..(400): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggcccatcggtcttcccctggcgccctgctccaggagcacctcgtggggcacgagccggccctgggctgcctggtcaaggctactcatactcgcgtctgagcggctggcaaggcgcatagnnnnnn

SEQ ID NO: 153258 - DNA, 405 bp, Homo sapiens
  misc_feature: GYAE6OF01B2XR9.23.27.C05.1.454.CMB.1.raw
  modified_base (238)..(238): a, c, t, g, unknown or other
  misc_feature (238)..(238): n is a, c, g, or t
  modified_base (400)..(405): a, c, t, g, unknown or other
  misc_feature (400)..(405): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttccccctggccgccctgctccaggagcacctctgggggcacagcggccctgggctgcctggtcaaggactacttccatactcgcgtctgagcgggctggcaaggcgcatagnnnnnn

SEQ ID NO: 153259 - DNA, 404 bp, Homo sapiens
  misc_feature: GYAE6OF01DISG4.23.27.C05.1.454.CMB.1.raw
  modified_base (238)..(238): a, c, t, g, unknown or other
  misc_feature (238)..(238): n is a, c, g, or t
  modified_base (398)..(404): a, c, t, g, unknown or other
  misc_feature (398)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttcccctggcgccctgctccaggagcacctctgggggcacagcggccctgggctgcctggtcaaggactacttccatactcgcgtctgagcgggctggcaaggcgcatagnnnnnnn

SEQ ID NO: 153260 - DNA, 407 bp, Homo sapiens
  misc_feature: GYAE6OF01ERVPN.23.27.C05.1.454.CMB.1.raw
  modified_base (402)..(407): a, c, t, g, unknown or other
  misc_feature (402)..(407): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctcgtgggggcacgagccggcccgtgggctgcctggtcaaggactacttccatactcgcgtctgagcggctggcaaggcgcatagnnnnnn

SEQ ID NO: 153261 - DNA, 404 bp, Homo sapiens
  misc_feature: GYAE6OF01DM4F3.23.27.C05.1.454.CMB.1.raw
  modified_base (398)..(404): a, c, t, g, unknown or other
  misc_feature (398)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggccatcggtcttcccctggccgccctgctccaggagcacctcgtgggggcacgagcggccctgggctgcctggtcaggactacttcatactcgcgtctgacgcggctggcaaggcgacatagnnnnnnn

SEQ ID NO: 153262 - DNA, 160 bp, Homo sapiens
  misc_feature: GYAE6OF01CFBBX.23.27.C05.1.454.CMB.1.raw
  modified_base (159)..(160): a, c, t, g, unknown or other
  misc_feature (159)..(160): n is a, c, g, or t
tcagacgcgagtatcacgaccggtgctcgatttagacgcgatcgaagggtttgggggaggtgtgtcacaagatttgggctctgggcacagcggccctgggctgcctggtcaaggactacttccatactcgcgtctgagcgggctggcaaggcgcatagnn

SEQ ID NO: 153263 - DNA, 540 bp, Homo sapiens
  misc_feature: GYAE6OF01B5ND4.23.27.C05.1.454.CMB.1.raw
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (391)..(391): a, c, t, g, unknown or other
  misc_feature (391)..(391): n is a, c, g, or t
  modified_base (438)..(438): a, c, t, g, unknown or other
  misc_feature (438)..(438): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgacattttcggtctttagtctggtatcaacaaaaaccngggtttcncccctacgtcctcgtcgctgtcactgacgagttacaaagtggggtcccatcgagattcagtggcagtggaggtgggacttttacgactctcacaatcgccggctgcggcctgaacgtnttttgggacttacttctgtcagctaagtattacgatacgtcccgtanactatttggccaggggacctaaagttgacctcatacgaactgtgctgcactatctcgtcttcactccttacccgcaatctagaacttacacgcgtctgacgg

SEQ ID NO: 153264 - DNA, 564 bp, Homo sapiens
  misc_feature: GYAE6OF01DZ22K.23.27.C05.1.454.CMB.1.raw
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
  modified_base (426)..(426): a, c, t, g, unknown or other
  misc_feature (426)..(426): n is a, c, g, or t
  modified_base (466)..(466): a, c, t, g, unknown or other
  misc_feature (466)..(466): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctgggtccggcaaccccgagggaagggtcttgagtggattggagatatctgtcccggtagggcacttatacacccgtccctanaaaagacggccncctatcgagggacacggcaagagatcncgctgtagttgacttctgtcgaccgtcgcagacacggcctattatttgngcgaggactaaactactacgttgatcgtcgtggggcccgngtcacttccgtggtccacgtgtcctccgtcggccttccgaaccgtacggggcccctagttccggtacccttccccgnggcccncccgtgcctacccgg

SEQ ID NO: 153265 - DNA, 610 bp, Homo sapiens
  misc_feature: GYAE6OF01EFAX4.23.27.C05.1.454.CMB.1.raw
  modified_base (264)..(264): a, c, t, g, unknown or other
  misc_feature (264)..(264): n is a, c, g, or t
  modified_base (390)..(390): a, c, t, g, unknown or other
  misc_feature (390)..(390): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggacgagggtgacgttcagatgacccagtctccaccctcctgtctgcatctgttggggaccagtcaccatcacttgccgggcgagtcgtgactattttcggttctttagtctggtatcaaacaaaaccnggtttcgcccctaccgtcctcgtcgctgtcactgacgtagttacaaggtggggtcccagtcgagattcagtggcaggtggaggtcggtacctttacactctcacagtcgccgctgcgcctagagtntttgggctttacttctgtcagctagtattacatacgtacccgtacactagtttcggacccgtaaggggaaccctaaagttcgaacccttcaacgttaacggaacttggtacggccttacggacctaaccctagttccgtcgttacctttccgaactttccccgttaccccgccctattcctacgtaaaccttaccgttccgtcggttcgtggtaccgggg

SEQ ID NO: 153266 - DNA, 542 bp, Homo sapiens
  misc_feature: GYAE6OF01A9G6V.23.27.C05.1.454.CMB.1.raw
  modified_base (268)..(268): a, c, t, g, unknown or other
  misc_feature (268)..(268): n is a, c, g, or t
  modified_base (438)..(438): a, c, t, g, unknown or other
  misc_feature (438)..(438): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgactattttcggttctttagtctggtatcaaacaaaaaccngggtttcgcccctaccgtcctcgtcgctgtcactgacgagttacaaagtcgggtccatcgagattcagtgcaggtggaggtgggaccttttacactctcacaatcgccggctgcggcctagagtatttgggacttacttctgtcagctagttattacatacgtcccgtanactatttcggccaggggaccaagttcgacctcatacgaactgtgctgcacatctgtcttcgacttccttcccgcctatctagaacttacgtcgcgtgtggacgg

SEQ ID NO: 153267 - DNA, 563 bp, Homo sapiens
  misc_feature: GYAE6OF01AZVL8.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttgccgggcgagtcgtgactattttcggttctttagtctggtatcaaacaaaacctagggtttcgcccctaccgtcctcgtcgctgtcactgacgagttacaaagtggggtcccatcgagattcagtggcaggtggaggtggaccttttacgactctacacaatcgccggctgcgcctgaagtagtttggactttactctgtcagtcagtattactatacgtcccgtacactagtttcggcctaggggtaaccaagttcacctacgaactacgaactgtgtctgacctacatcttcgtcttcacttccttacccgctacttctacgtaactcttccggcttcgtggtcggg

SEQ ID NO: 153268 - DNA, 608 bp, Homo sapiens
  misc_feature: GYAE6OF01BW3A6.23.27.C05.1.454.CMB.1.raw
  modified_base (453)..(453): a, c, t, g, unknown or other
  misc_feature (453)..(453): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggccaacccccgagggaagggtcttgagtggattggagatatctggtcccggtaggggcacttataccaacccgtccctacaaaagaccgggccgccctatcgaggggacacggccaagaaggaacttctcgctgtagtttgactttctgtcgacccgccgcacgacgaccggtccgttcttagttttgngacgaggagtaaactactacttcgatcgtcgtcggggcccgcggcactccgtggtccacgttgtcctcccgtcggtccttcccgaacccgaacgggtccccagttcccgggttcccttccccccgtcgggtccccgtccccgttgccctacccgg

SEQ ID NO: 153269 - DNA, 552 bp, Homo sapiens
  misc_feature: GYAE6OF01CUNWD.23.27.C05.1.454.CMB.1.raw
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (459)..(459): a, c, t, g, unknown or other
  misc_feature (459)..(459): n is a, c, g, or t
  modified_base (465)..(465): a, c, t, g, unknown or other
  misc_feature (465)..(465): n is a, c, g, or t
  modified_base (540)..(540): a, c, t, g, unknown or other
  misc_feature (540)..(540): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctgggctgggtccgcaaccccgaggaggtcttgagtggattggagatatctggtcccggtagggctacgtttatacaacccgtccctacgaaaacgacgggccgcctagtcgaggggacacggaccaagaaggacttctcgctgagtttgacttctgtcgaccgcgcagacacggcctctattttgngcgaganaactctactgatctcgngggccncgggctacgtcctaggtccactcgtcctcctcggcctccgacgaacggcccagtccggtccttcccccgtggccnccctgcgtcccg

SEQ ID NO: 153270 - DNA, 407 bp, Homo sapiens
  misc_feature: GYAE6OF01ANXPB.23.27.C05.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (336)..(336): a, c, t, g, unknown or other
  misc_feature (336)..(336): n is a, c, g, or t
  modified_base (398)..(407): a, c, t, g, unknown or other
  misc_feature (398)..(407): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgngcgaggagaaactactacttcgatctctggggccncggcatcctggtcactgtctcctcggcttccaccaaggcccatcggtcttccccctggcgccctgctccaggagcacctctgggggcacagcggcccngggctgcctggtcaaggactacttccatactcgcgtctgagcgggctggcaaggcgcatagnnnnnnnnnn

SEQ ID NO: 153271 - DNA, 676 bp, Homo sapiens
  misc_feature: GYAE6OF01CKGPJ.23.27.C05.1.454.CMB.1.raw
  modified_base (655)..(655): a, c, t, g, unknown or other
  misc_feature (655)..(655): n is a, c, g, or t
  modified_base (670)..(670): a, c, t, g, unknown or other
  misc_feature (670)..(670): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgtatccctgcgtggggctcgggtcccgcaaccccgagggaaggtcttgagtggattggagatatcgtgtcccggtagggactaacttacttaaccaacccgtccctacgaaaacggccgggcccgaccctaagtccggaacgggggaaccaaccggaccaaaggaaacggaactttccgacgtcgttaggtagtttcgaactttcgtcgtacgacccgccgacacggaccgtaccggtccgttcgtttagtttttcggacgtacggtaacgggtaacgtaaaacctaccttacgttaccggacttacgtcggtacggggcccgacgggtcctacgttccgtgggtacctacgttcgtcctccgtcggccttaccgaccgtacggcccagttcccggttcccttccccgcggtccccnccctagccctaccgnggtccg

SEQ ID NO: 153272 - DNA, 580 bp, Homo sapiens
  misc_feature: GYAE6OF01BJKTD.23.27.C05.1.454.CMB.1.raw
  modified_base (434)..(434): a, c, t, g, unknown or other
  misc_feature (434)..(434): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccagggaagggtcttgagtggattggagatatctgtcccggtaggggcacttatacaacccgtccctacaaaagacgggccgccctatcgacgggacacggccaagaagaattctcgctgagttgacttctgtcgaccgccgcagacacggcctctattttgngtcgaggagaaactctacttcgattcgtcgtcgggccgcggccagttcctgggtcacgttgtctcccgtcggtccttcccaccgtaacgggccccaagttcccggtaccctttcccccgcgggcccgtcccctcgccgtaccccgg

SEQ ID NO: 153273 - DNA, 566 bp, Homo sapiens
  misc_feature: GYAE6OF01A4JN8.23.27.C05.1.454.CMB.1.raw
  modified_base (442)..(442): a, c, t, g, unknown or other
  misc_feature (442)..(442): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgagggaagggtcttgagtggattggagatatctgtcccggtaggggcacttattaccaacccgtccctacaaaagcgggccgccctatcgaggggacacggccaagaaggaattctcgctgagtttgacttctgtgaccgccgcagaccacggccgtcttatttttcgngcgaggagaaactactacttcgatcgtcgtgggccgcggcatccgtggtcacgtgtcctcctcggccttcccaccgacgggccccacgttccggtccttcccccgtggcccgtccctgcctccg

SEQ ID NO: 153274 - DNA, 406 bp, Homo sapiens
  misc_feature: GYAE6OF01EAHCP.23.27.C05.1.454.CMB.1.raw
  modified_base (400)..(404): a, c, t, g, unknown or other
  misc_feature (400)..(404): n is a, c, g, or t
  modified_base (406)..(406): a, c, t, g, unknown or other
  misc_feature (406)..(406): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctcgtgggggcacgagcggccctgggctgcctggtcaaggactacttccatactcgcgtctgagcggctggcaaggcgcatagnnnnntn

SEQ ID NO: 153275 - DNA, 404 bp, Homo sapiens
  misc_feature: GYAE6OF01BH2U1.23.27.C05.1.454.CMB.1.raw
  modified_base (399)..(404): a, c, t, g, unknown or other
  misc_feature (399)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctctgggggcacagcggccctgggctgcctggtcaaggactacttccatactcgcgtctgagcgggctggcaaggcgcatagnnnnnn

SEQ ID NO: 153276 - DNA, 402 bp, Homo sapiens
  misc_feature: GYAE6OF01AUF9K.23.27.C05.1.454.CMB.1.raw
  modified_base (238)..(238): a, c, t, g, unknown or other
  misc_feature (238)..(238): n is a, c, g, or t
  modified_base (398)..(402): a, c, t, g, unknown or other
  misc_feature (398)..(402): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttccccctggcgccctgctccaggagcacctctgggggcacagcggccctgggctgcctggtcaaggactactccatactcgcgtctgagcgggctggcaaggcgcatagnnnnn

SEQ ID NO: 153277 - DNA, 401 bp, Homo sapiens
  misc_feature: GYAE6OF01BUTFB.23.27.C05.1.454.CMB.1.raw
  modified_base (238)..(238): a, c, t, g, unknown or other
  misc_feature (238)..(238): n is a, c, g, or t
  modified_base (398)..(401): a, c, t, g, unknown or other
  misc_feature (398)..(401): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctaggcttccaccaagggcccatcggtcttccccctggcgccctgctccaggagcacctctgggggcacagcggccctgggctgcctggtcaaggactacttccatactcgcgtctgagcggctggcaaggcgcatagnnnn

SEQ ID NO: 153278 - DNA, 600 bp, Homo sapiens
  misc_feature: GYAE6OF01B53HF.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctccagatgggccctgtcccaggcgcaagtgcaggagtcgggcccaggactggtgaggccttcggaaaccctgtctctttcctgcactgtctctactgtctccgtcaccgatcctgcgtggggctgggtccggcaaccccagggaacggtctgagtggattggagatatcgtggtccggtaggggcacttataccaacccgtcctacaaaacggcggccgcctatcgagggacacggacaaggaaggactcgtacgctgtagtttgacttcgtgtacgaccgtccgcacgaccacggtccgttcttagtttttgagtcgaaggacgtaaactactacttcgattcgtcgtgggcccgcgggctagtccgtcggtcacgtcgtacctccgtccggtccttcccgaccgaacgggtcccctaacgttccggtaccctttcccccgtcggcccgtcccgtgtcccgtacccgg

SEQ ID NO: 153279 - DNA, 588 bp, Homo sapiens
  misc_feature: GYAE6OF01DAG0J.23.27.C05.1.454.CMB.1.raw
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (559)..(559): a, c, t, g, unknown or other
  misc_feature (559)..(559): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccgagggaaggtcttgagtggattggagatatcgtgtcccgggtaggggctacttacttaccaacccgtccctacaaaacgaccgggccgaccctatcgaggggaccacggaccaaagaaggattcgtcgctgagtttgacttctgtgaccgcgcagaccacggcctnttattttgngagagaagtaactactacgttcgatcgtcgtcgggccgcgctactccgtggtcacgttcgtcctccctcggtccttcccaccggaacggccctagtcccgttcccttccccccgnggccctcccgtgccctccgagggtacccg

SEQ ID NO: 153280 - DNA, 404 bp, Homo sapiens
  misc_feature: GYAE6OF01C03TU.23.27.C05.1.454.CMB.1.raw
  modified_base (397)..(404): a, c, t, g, unknown or other
  misc_feature (397)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctattttgtgcgaggagaaactactacttcgatctctggggccgcggcatccctggtcactgtctcctcggcttccaccaagggcccatcggtcttcccctggcgccctgctccaggagcacctctgggggcacagccggccctgggctgcctggtcaaggactactcatactcgcgtctgagcgggctggcaaggcgcatagnnnnnnnn

SEQ ID NO: 153281 - DNA, 671 bp, Homo sapiens
  misc_feature: GYAE6OF01CB7YY.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggtagctcccagatgggccctgtcccaggcgcaagtgcaggagtcgggcccaggactggtgaggccttcggaaaccctgtctctttcctgcactgtctctactgtctccgtcaccgatccctgcgtgggcgtgggtccgcaaccccgagggaggtctgagtggagttggagtatatcgtcggtccgggtagggctacttacttaccaacccgtccctacgaaaacgaccggccgtaccctatacgacgggacgaacggaccaaggaaggtaattcgtcgcgtagtacgtttgtactttcgtcgtacgtacccgccgcgaacggaccgaccggtcccgttacgtttagttttcggtggaccggtagggtaacgtaaaccttacttacgttacgtattccgtacgtcggggaccgcggtctacgtccgtaggtcctacgtcgttacctccgttccggtaccttcccgaaccgtaacgggacccctcgtaccccggttcccgttcccccccgtagggccccgttccccgtcggtcccgtccggtaacgg

SEQ ID NO: 153282 - DNA, 573 bp, Homo sapiens
  misc_feature: GYAE6OF01CGF3E.23.27.C05.1.454.CMB.1.raw
  modified_base (442)..(442): a, c, t, g, unknown or other
  misc_feature (442)..(442): n is a, c, g, or t
  modified_base (481)..(481): a, c, t, g, unknown or other
  misc_feature (481)..(481): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccgcaaccccgagggaaggtcttgagtggattggagatatctggtccggtaggggcacttattaccaacccgtccctacgaaaacgaccgggccgcctatcgaggggacacggaccaaagaaggaattctcgctgagtttgacttctgtcgaccgcgcacgacacggtccgtcttattttgngcgaggaagtaaactactacttcgatctcgtggggccgnggcatccgtggtcacgttgtcctccgtcggtccttccgaccgaacgggccccagtcccggtccttcccccgtggcccgccctgcctacccgg

SEQ ID NO: 153283 - DNA, 411 bp, Homo sapiens
  misc_feature: GYAE6OF01DH87M.23.27.C05.1.454.CMB.1.raw
  modified_base (240)..(240): a, c, t, g, unknown or other
  misc_feature (240)..(240): n is a, c, g, or t
  modified_base (348)..(348): a, c, t, g, unknown or other
  misc_feature (348)..(348): n is a, c, g, or t
  modified_base (407)..(411): a, c, t, g, unknown or other
  misc_feature (407)..(411): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagttttgacttctgtgaccgccgcagacacggccgtctatttttgtgcgaggagaaactactacttcgatctctggggccgnggcatcctggtcactgtctcctcggcttccaccaagggcccatccggtcttccccctggccgccctgctccaggagcaccgtctgggggcacaggcggccctgggctncctggtcaaggactacttccatactcgcgtctggagtcgggctggacaaggcgcatagnnnnn

SEQ ID NO: 153284 - DNA, 578 bp, Homo sapiens
  misc_feature: GYAE6OF01CAU9M.23.27.C05.1.454.CMB.1.raw
  modified_base (336)..(336): a, c, t, g, unknown or other
  misc_feature (336)..(336): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccgcaaccccagggaaggtcttgagtggattggagatatctgtcccggtaggggcacttatacaacccgtccctanaaaacgcggccgccctatcaggggacacggccaagaggaattcncgctgagtttgacttctgtgaccgccgcagacacgccgtntattttgngcgagagaactactacttcgatctcgtggggcccgcgggctagtccctggtcctacgttcgtcctccgtccggccgttcccaacccgaacggggtccccaacgttccgggtccctttcccccccgtggccccgcccttggccctacccgg

SEQ ID NO: 153285 - DNA, 649 bp, Homo sapiens
  misc_feature: GYAE6OF01DCWA8.23.27.C05.1.454.CMB.1.raw
  modified_base (247)..(247): a, c, t, g, unknown or other
  misc_feature (247)..(247): n is a, c, g, or t
  modified_base (461)..(461): a, c, t, g, unknown or other
  misc_feature (461)..(461): n is a, c, g, or t
  modified_base (508)..(508): a, c, t, g, unknown or other
  misc_feature (508)..(508): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccatgtcccaggcgcaagtgcaggagtcgggcccaggactggtgaggccttcggaaaccctgtctctttcctgcactgtctctactgtctccgtcaccgactccngctgggctcgggtccgccaaccccgagggaggtctgagtggattggagatatcgtcggtcccgggtaggggctacttacttaccacccgtccctacgaaaacgccgggcccgcctagtcgacggggacacggaccaaagaacggtaattcgtcgctgtacgtttgtacttcgtgtcgacccgccgacgacgccgacggccgttcttagttttgngcgaaggaagtaaccttatacttcgactccgtacggtcgggggcccncggtactcgttcccgttggtacctacgttcgttcccgtcccgttccgggtccctttacccgacccggtaaacgggcccccgtaagttcccccgggttccctttaccccccggtgggtcccccgtccccgttggtacccccg

SEQ ID NO: 153286 - DNA, 546 bp, Homo sapiens
  misc_feature: GYAE6OF01EBM10.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttgaaaaccgggcgagtcgtgacattttcggttctttagtctggtatcaacaaaaaccaggtttcgcccctaccgtcctcgtcgctgtcactgacgagttacaaagtggggtcccatcgagattcagtggcagtggaggtgggacctttacactctcacaatcgccggctgcggcctgaagtattttgggactttacttctgtcagctagtattacatacgtcccgtacactatttggcctaaggggaccctaaaggtttcgaacctcaatacgaactgtggctgcacatctgtcttcacttctcccgcatctagaactactcgcgtctgacgg

SEQ ID NO: 153287 - DNA, 417 bp, Homo sapiens
  misc_feature: GYAE6OF01BKHWZ.23.27.C05.1.454.CMB.1.raw
  modified_base (312)..(312): a, c, t, g, unknown or other
  misc_feature (312)..(312): n is a, c, g, or t
  modified_base (402)..(402): a, c, t, g, unknown or other
  misc_feature (402)..(402): n is a, c, g, or t
  modified_base (404)..(417): a, c, t, g, unknown or other
  misc_feature (404)..(417): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttcccctggcgccctgctccaggancacctctgggggccacgagccggccctgggctgccgtggtcaaggactacttccatactcgcgtctgaggcggctggcaaggcgcatagngnnnnnnnnnnnnnn

SEQ ID NO: 153288 - DNA, 401 bp, Homo sapiens
  misc_feature: GYAE6OF01DG7VH.23.27.C05.1.454.CMB.1.raw
  modified_base (308)..(308): a, c, t, g, unknown or other
  misc_feature (308)..(308): n is a, c, g, or t
  modified_base (391)..(401): a, c, t, g, unknown or other
  misc_feature (391)..(401): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggcccatcgtctcccctggcgccctgctcaggancacctcgtggggcacagccggccctgggctgcctggtcaaggctactcatactcgcgtctgagcggctggcaggcgacatagnnnnnnnnnnn

SEQ ID NO: 153289 - DNA, 630 bp, Homo sapiens
  misc_feature: GYAE6OF01CGGHM.23.27.C05.1.454.CMB.1.raw
  modified_base (364)..(364): a, c, t, g, unknown or other
  misc_feature (364)..(364): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtcctccgtcaccgactcctgcgtgggcgtcgggtccggccaaccccgagggaacggtcttggagtggagttggagatatcgtcggtccggtagggctaacttataccaacccgtaccctacgaaacgccgggccncctatcgagggacacggacaagaagactcgtcgctgtagtttgacttcgtgtcgacccgtcgcacgacgaccggtcgttacttagttttgacgacggtaaggaacgtaaacttaccgttaacttccgtattccgtcggtcggggcccgcggtctacgttccgtggtcctacgttcgtccctccgtccgtacccttccgaccgtaaccgggcccctacggttccccgttcccgttcccccgtacggcccgcccctgtcccgtaccgg

SEQ ID NO: 153290 - DNA, 402 bp, Homo sapiens
  misc_feature: GYAE6OF01EZKC6.23.27.C05.1.454.CMB.1.raw
  modified_base (311)..(311): a, c, t, g, unknown or other
  misc_feature (311)..(311): n is a, c, g, or t
  modified_base (399)..(402): a, c, t, g, unknown or other
  misc_feature (399)..(402): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttcccctggcgccctgctccaggngcacctctgggggcacagcggccctgggctgcctgggtcaaggactacttccatactcgcgtctgagcgggctggcaaggcgcatagnnnn

SEQ ID NO: 153291 - DNA, 760 bp, Homo sapiens
  misc_feature: GYAE6OF01ED72E.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtcctccgtcaccgatccctgcgtgggctcgggtccggcaaccccgagggaacggtcttgagtggattggagatagtcgtcggtcccggtaggggcctacgtttacttaccgaaccccgtccctacgaaaacggaccgggcccacccgtagtacgacggggaccaccgggaccaaaggaacggtaacttccgtacgacgttaggtacgtttggactttcgtgtacggacccgtccgacgaacggaccgtaccgggtcccgttacgtttagtttttcggacggtacggtaaggtaaacgtaaaccttaccgttaaccgtttaccggtacttccgttccgggtcgggggtaccccgacgggtacctaacgttccccgttgggtaccgttaccgttacggttcccttacccgtccgggttaccccttaccccgaacccggtaaaccggggtcccccttaacggttccccgggttacccccgtttaccccccggtcgggtacccccgtcccccgttaggcccccgttaaccccggg

SEQ ID NO: 153292 - DNA, 612 bp, Homo sapiens
  misc_feature: GYAE6OF01APVOV.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaacctgtctctttcctgcactgtctctactgtctccgtcaccgatccctgcgtggggctgggtccggccaaccccgagggaacgggtcttggagtggattggagatatcgtcggtcccgggtaggggctacttattaccaaccccgtccctacaaaacggaccgggccgccctagtcgaggggacacggaccaaagaaggaacttctcgctgtagtttcgacttcgtgtcgaccgccgcacgacacggtccgttcttagttttgcgtcggtaagacgtaaactacttacttcgtactcgtcggtcgggccgtcggctacgtccgtggtctacgtcgtcctccgtcggtccttccgaccgaacgggccctacgttccggttcccttccccggtcggccctccccgtgccgtccgg

SEQ ID NO: 153293 - DNA, 737 bp, Homo sapiens
  misc_feature: GYAE6OF01CR6Y7.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctcgggtccggcaaccccgagggaagggtcttgagtggattggagatatcgtgtccggtagggcacttactacaacccgtccctacaaaagacggccgcctactcgaaggggacacggacaaagaaaggtacttcgcgtactgtagtttcgacttcgtgtcgacccgtcgcgaacgaccgacggtccgttcgttaacgttttttggacgtaccggtaaggtaaccgtaaaaccttaaccgttaacctttacggaagtttcccgttaaccggttacggggggccccggtaccggggtacctaacggttccccgttagggttccctaaaccgtttcggttacccctccccggttaccgggtacccctttaccccggaaaccccggtaaacggggtcccccctaaacgggtttcccccgggttaccccttttccccccccggaggggtcccccgtcccccgttacggtccccgttaaccccggg

SEQ ID NO: 153294 - DNA, 668 bp, Homo sapiens
  misc_feature: GYAE6OF01ECEFC.23.27.C05.1.454.CMB.1.raw
  modified_base (470)..(470): a, c, t, g, unknown or other
  misc_feature (470)..(470): n is a, c, g, or t
  modified_base (636)..(636): a, c, t, g, unknown or other
  misc_feature (636)..(636): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctgggtcccggccaacccccgagggaacggtcttgagtggattggagatatcgtcggtcccgggtaggggcctacgttacttaccaaccccgtcctacgaaaacgccgggccgccctagtcgacggggacacggacaaaggaacgaacttctacgcgtagtagtttgacttctgtacgaccgtccgcacgacgacggtccgttacttagttttcggnggacggtaagggtaaacgtaaaccttacgttaaccgttccgtaagttccgttccggtcggggcccgtcggccgtacgttccgttggtccacgttcggtccctccgtccggtcccttaccgaaccggtaacgggtcccctaggttccccggtcccgttaccccccgnggtccccgtcccgtgccttcccgaggtacccg

SEQ ID NO: 153295 - DNA, 623 bp, Homo sapiens
  misc_feature: GYAE6OF01BN34C.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtcctccgtcaccgatccctgcgtggggctcggggtccgccaaccccgagggaaggtcttgagtggattggagatagtctcggtcccggtaggggctacgttactaccaaccccgtcctacgaaaagccgggccacctatcgagggacacggcaagaagatcgtcgctgtagttcgacttgtgtcgaccgccgcagaccgaccggtccgttacgttagtttttgcgtacggtaaggaagaaacttactacttcgacgtcgtcggtacggggccgcggtactacgtccgtggtaccacgttcgttaccgtcccgtccggtaccttcccgaaccgaacgggtccccaacgttcccggttcccttcccccgcggccccgtcccgtcgcccgtacccgg

SEQ ID NO: 153296 - DNA, 550 bp, Homo sapiens
  misc_feature: GYAE6OF01BI4F3.23.27.C05.1.454.CMB.1.raw
  modified_base (266)..(266): a, c, t, g, unknown or other
  misc_feature (266)..(266): n is a, c, g, or t
  modified_base (329)..(329): a, c, t, g, unknown or other
  misc_feature (329)..(329): n is a, c, g, or t
  modified_base (384)..(384): a, c, t, g, unknown or other
  misc_feature (384)..(384): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttgccgggcgagtcgtgacattttcggttctttagtctggtatcaacaaaaccnggtttcgcccctaccgtcctcgtcgctgtcactgacgagttacaaaggtgggtcccatcgagnttcagtgcagtggaggtggacctttacactctcacatcgccgctgcgctgaagtntttggacttacttctgtcagcagtattacatacgtcccgtacactagtttcggccgaaggggtaacctaaaggttcgaccctcaattaccggaacttggtcggctgacaccatcctgtccttcgacttccttcccgcctatcctagtaactctcgcgtctggacgg

SEQ ID NO: 153297 - DNA, 411 bp, Homo sapiens
  misc_feature: GYAE6OF01C9SMD.23.27.C05.1.454.CMB.1.raw
  modified_base (237)..(237): a, c, t, g, unknown or other
  misc_feature (237)..(237): n is a, c, g, or t
  modified_base (394)..(394): a, c, t, g, unknown or other
  misc_feature (394)..(394): n is a, c, g, or t
  modified_base (400)..(411): a, c, t, g, unknown or other
  misc_feature (400)..(411): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctattttgtgcgaggagaaactactacttcgatctctggggccncggcatcctggtcactgtctcctcggctccaccaaggcccatcggtcttcccctggccgccctgctccaggagcaccctcgtgggggcacgaggccggcccgtgggctgcctggtcaaggactacttccatactcgcgtctgagcggctggcaggcncatagnnnnnnnnnnnn

SEQ ID NO: 153298 - DNA, 635 bp, Homo sapiens
  misc_feature: GYAE6OF01C9706.23.27.C05.1.454.CMB.1.raw
  modified_base (363)..(363): a, c, t, g, unknown or other
  misc_feature (363)..(363): n is a, c, g, or t
  modified_base (455)..(455): a, c, t, g, unknown or other
  misc_feature (455)..(455): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgactccctgctgggcgtcgggtccggcaaccccgagggaagggtcttggagtggattggagtatatcgtcggtccgggtaggggctacttataccaaccccgttcccacgaaagaccgggccncctatcgacgggacacggaccaagaagatctcgctgtagtttgtacttcgtgtcgacccgcgacacgaccgacggtccgttattagttttgngcggtaggaacgaaacttactacttacgacttcgtcggtggggacccgcggtccacgttccgtcggtctaccgttcgtcctcccgttccggtccgttccccgaaaccggtaaccgggtcccctacgttcccgggttccccttcccccggtcggccccgtccccgtcggtcccgtacccgg

SEQ ID NO: 153299 - DNA, 642 bp, Homo sapiens
  misc_feature: GYAE6OF01A9E5Q.23.27.C05.1.454.CMB.1.raw
  modified_base (616)..(616): a, c, t, g, unknown or other
  misc_feature (616)..(616): n is a, c, g, or t
  modified_base (624)..(624): a, c, t, g, unknown or other
  misc_feature (624)..(624): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtcctccgtcaccgatccctgcgtggggctcgggtccggaccaaccccgaggggaacgggtctggaggtggtagttggagtatagtcgtcggtcccgggtagggctacttactaccaaccccgtcctacgaaacggacggccgcctagtacgaggggacacgggaccaaaggaacggtaacttcgtcgtctagtagtttcgacttcgtgtcgaccgccgacacggacacggtccttacgttagttttggcgcggtaaggactaaactactacttcgacttcgtacgtcgggccgcgtcgtacgttccgtggtcctacgtcgttacctcccgttccggtccttacccgaccggtaaccgggtcccacgttcccggttcccttcccccgnggtccccncccgtcgcccgtacccgg

SEQ ID NO: 153300 - DNA, 621 bp, Homo sapiens
  misc_feature: GYAE6OF01BESWC.23.27.C05.1.454.CMB.1.raw
  modified_base (472)..(472): a, c, t, g, unknown or other
  misc_feature (472)..(472): n is a, c, g, or t
  modified_base (598)..(598): a, c, t, g, unknown or other
  misc_feature (598)..(598): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtcctccgtcaccgactcccctgcgtggggctcggggtccggccaacccccgaggggaaggtctgagtggattggagatatctcggtcccgggtaggggctacttacttaccaacccgtccctacaaaacggaccgggccgaccctatccgaaggggacacggaccaaaggaaggaacttcgtcgacgtgtagtttcgacttctgtcgaccgccgcgagaccacggtccgtcttagttttcgngtcgaaggacgtaaacttactacttcgattcgtcggtcggggccgcggtacacttccgtggtcacgttgtccttccgtccggtccttaccgaaccgacgggcccctagttccgtccctttccccgnggtcccgccctcgccgtacccgg

SEQ ID NO: 153301 - DNA, 585 bp, Homo sapiens
  misc_feature: GYAE6OF01AC5QU.23.27.C05.1.454.CMB.1.raw
  modified_base (393)..(393): a, c, t, g, unknown or other
  misc_feature (393)..(393): n is a, c, g, or t
  modified_base (450)..(450): a, c, t, g, unknown or other
  misc_feature (450)..(450): n is a, c, g, or t
  modified_base (560)..(560): a, c, t, g, unknown or other
  misc_feature (560)..(560): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctcgggtcccggcaacccccgaggggaaggtcttgagtggattggagatatctggtcccggtagggctacttataccaacccgtccctacaaaaggccgggccgcctagtcgaggggaccacggaccaaagaaggattcncgcgtgagtttgacttcgtgtcgacccgccgcagacacggccgtacttagttttcgngacgaggactaaactacttactcgatcgtcgtcgggccgacggctactccgtggtcactcgtcctccgtcgccttccgaaccgtacggccctagtccgtcccttccccgnggcccacccgtgcctccgaggaccg

SEQ ID NO: 153302 - DNA, 767 bp, Homo sapiens
  misc_feature: GYAE6OF01E3QX6.23.27.C05.1.454.CMB.1.raw
tcagacgcgagtatcacgaccggtgctcgatttagacgcgatcgaagggtttgggatgctctctgagagtcatggacctcctgtgcaagaacatgaagcacctgttggttttgcctcctgcgtggtgcagcctcccagagtcgggccctgtcccgaggcgacgaagtgcgaggacggtccggacccgaggacgtggtacgaccggtacccgttacccggaaccttgttccttcctttccgtcgactacttcgtcctactccgttcgtcctcccgtaccaccggtctccgtggtcgggtccggcggtcccggacccgacccggaacccggtaggggtacgttgtagtggtaggtagtagtacgtacgttcgtaccgttccggtaccggtaacgtcctaaccgttaccctaacccgaaccccgtaccgaacggaaccgccgaccgacggtacgacggacgaacgacggaacgtagtaacgtctcgcgttgtacgtttgtacgtcgtcgcgcgaccgcgtacgacgtcgtacgtttcgtagttaggtcgaacgtacgtaaacaccgttaaccgtcgtacgttccgtacggtccggtccggtacggcccgtcgttaaccgttccgtacgttccgtaccgtcccttaccggtaccccgttccgtacccgggtacccttaccccggtaaccgggtaccccggttcccgtttacccccggtccccgttccccccgtcggtaccgtccccgaacccgttacgcccggtaacccgg

SEQ ID NO: 153303 - DNA, 778 bp, Homo sapiens
  misc_feature: GYAE6OF01DW4LY.23.27.C05.1.454.CMB.1.raw
  modified_base (212)..(212): a, c, t, g, unknown or other
  misc_feature (212)..(212): n is a, c, g, or t
  modified_base (296)..(296): a, c, t, g, unknown or other
  misc_feature (296)..(296): n is a, c, g, or t
  modified_base (759)..(759): a, c, t, g, unknown or other
  misc_feature (759)..(759): n is a, c, g, or t
  modified_base (762)..(763): a, c, t, g, unknown or other
  misc_feature (762)..(763): n is a, c, g, or t
  modified_base (765)..(765): a, c, t, g, unknown or other
  misc_feature (765)..(765): n is a, c, g, or t
  modified_base (769)..(769): a, c, t, g, unknown or other
  misc_feature (769)..(769): n is a, c, g, or t
  modified_base (772)..(772): a, c, t, g, unknown or other
  misc_feature (772)..(772): n is a, c, g, or t
  modified_base (774)..(775): a, c, t, g, unknown or other
  misc_feature (774)..(775): n is a, c, g, or t
  modified_base (777)..(777): a, c, t, g, unknown or other
  misc_feature (777)..(777): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttacggaacctgtctctttcngcactgtctctactgtctccgtcaccgactcctgcgtgggctcgggtccgaccaaccccgagggacggtctgagtggattgganatatcgtcggtccggtaggggctacgtttactaccgaacccgtcctaacgaaaacggaccgggccctaccgtagtacgacgggacacggacaaggaacggaacttcacgtctagtagtttcgactttcgtgtcgaccgcgacgaagaccgtacggtccgttcgtttaagtttttcggacggtaccggtaaagggtaaacgttaaaccgttaccgtttaaccgtttacggtaaccgtttccggttaccgggttaccgggggggtaccccgtaccgggggttaacccgttaacccggttttacccccgggtttacggggtttacccccgttaaacccgggtttttccccgggggtttttaacccccccgggtttttaccccccccgggggtttttaaccccccggggggggtttttaaaccccccccgtttttttttttaaaacccccccccccccgggggggangcnncnctcngcncnncnc

SEQ ID NO: 153304 - DNA, 655 bp, Homo sapiens
  misc_feature: GYAE6OF01D3HIA.23.27.C05.1.454.CMB.1.raw
  modified_base (306)..(306): a, c, t, g, unknown or other
  misc_feature (306)..(306): n is a, c, g, or t
  modified_base (419)..(419): a, c, t, g, unknown or other
  misc_feature (419)..(419): n is a, c, g, or t
  modified_base (463)..(463): a, c, t, g, unknown or other
  misc_feature (463)..(463): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtccgggcccaggactggtgaggccttcggaaccctgtctcttcctgcactgtctctactgtctccgtcaccgatccctgcgtcggggctcgggtcccggaccaaccccggagggacggttcttaggacggtggattgganattacgtcgtcggtcccgggtagggctacgttacttaccgaacccgtcctaacgaaaacggtccgggcccacctagtacggaaggggaccaccggacaaaggaacggaattcncgtctgtacgtttgactttcgtgtacgacccgcgacaggaaccncggtaccttcgtttattttcggagtcgaaggaactaaacctactacgttcgaattctcggtcggggcctcggactacgtccgtggttccacgtcgttcctaccgttccggtaccttacccgaccggtaaaccgggtccctacggttcccggttaccctccccgcgggccctcccgtgcccctgacggtaccg

SEQ ID NO: 153305 - DNA, 930 bp, Homo sapiens
  misc_feature: GYAE6OF01DZ218.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctcttcctgcactgtctctactgtctccgtcaccgatccctgcgtggggctcgggtccggcaaccccgagggaaggtctgagtggattggagatatctggtcccggtagggcctacttacttaccaacccgttccctacgaaaaacgaccggggtcccacccgttaagtaccgaacgggggaaccaaccggggacctaaaacgggaaacgggtaaacgtttccgttaccgggaccttagggtaacggtttttacgtaaaccgttttccgttacgggtttacggaacccccgggtaccggaccgtaaacgggaacccgtaaccccggggtacccgtttaccgtttaaacgttttttttcggtacgggtaccgtaaacggggtaaaccggtaaaaacccgttttaacccgtttaacccgttttacccgggttaaacctttaacccgggttttcccgggtttacccgggggggggaccccccggtaaccgggggttacccgtaaaccggttttcccccggtttacggggtttacccctaaaccggtttccggtttcccccgttccccggtttaccccggggttacccgtttttaccccccggaaaccccggtaaacccgggggtccccccgttaaacggttcccccgggttttccccccgttttaccccccccggttccggggtacccccgttccccccggttacggtccccggtttaaccccccggg

SEQ ID NO: 153306 - DNA, 649 bp, Homo sapiens
  misc_feature: GYAE6OF01CYSJL.23.27.C05.1.454.CMB.1.raw
  modified_base (219)..(219): a, c, t, g, unknown or other
  misc_feature (219)..(219): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtcctccaccctccctgtctgcatctggttgggaccagtcaccatcactgccggngagtcgtgactattttcggttctttagtctggtatcaaactaaaaccgtggtttcgccctacgtcctcgtcgctgtcactgacgtagtacgaaagtgggtcccatcgagtattcagtggcaggtggaggtcggtaccttttacgactctacactaactccgccggtctggccgtcctaggtaaacgttagttttcgggtactttacgttcgtagtcaagtctaagtatttacaattacgtaccgtaactagttattcgggacctaaggggtaaccctaaaggttccaaccgttacaagttaccgtaacgtggtacggtcgttacgacctaaccgtaagtttcctcggttaccttcctaaccgtttcccgtaccccgtctaacgttccttaacggtaaacttcccgtacggtccgttcgtgggtaaccggg

SEQ ID NO: 153307 - DNA, 407 bp, Homo sapiens
  misc_feature: GYAE6OF01EKRPI.23.27.C05.1.454.CMB.1.raw
  modified_base (313)..(313): a, c, t, g, unknown or other
  misc_feature (313)..(313): n is a, c, g, or t
  modified_base (398)..(407): a, c, t, g, unknown or other
  misc_feature (398)..(407): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggancacctctgggggcacagcggccctgggctgcctggtcaaggctacttccatactcgcgtctgagcgggctggcaaggcgcatagnnnnnnnnnn

SEQ ID NO: 153308 - DNA, 733 bp, Homo sapiens
  misc_feature: GYAE6OF01DJOUM.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgacggccttacggaaaccctgtctctttcctgctactgtctctactgtcctccgtcaccgactccctgccgtggggcgtcgggtcccggaccaaccccgagggtaacggtcttggagtggattggagtatatcgtcggtcccgggtagggcctaactttacttaacccgaaccccgtccctaacgaaaaacggaccgggcccgacctagtaccgaacgggggaaccaaccgggaccgaaaggaaacggtaacttccgtcggcttaggtacgttttcgactttcgtaggtcgacccgccgacgaacgaccgacccggtcccgttactttacgtttttgggacgtaccggtaaaggtaaacgtaaaaccttaaccgtttacgttacggtaacttccgtaccggtcgggggcccgtccggtactaccgttcccgtggtaccacgttcgtccgttcccgtcggtacccttcccgaacccggtaacgggtccccaacgttccccgggttacccctttccccccgggcgtcccggtcccctggcccgtacccgg

SEQ ID NO: 153309 - DNA, 720 bp, Homo sapiens
  misc_feature: GYAE6OF01CTL4U.23.27.C05.1.454.CMB.1.raw
  modified_base (313)..(313): a, c, t, g, unknown or other
  misc_feature (313)..(313): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcatctcccagatgggccctgtcccaggcgcaagtgcgaggagtcgggccaggactggtgacggtccgttacggaaacccttgtcttcttcctgcactgtctctactgtctccgtcaccgctcctgcgtggggctcgggtccgaccaaccccggaggggtaacgggtcttggagtggtagttggaagtntagtcgtcggtccgggtagggctacttacttaccaacccgtccctaacgaaacggaccggcccgtaccgtacgtcggaacggggacacggacaaggaaacggtattccgacgcgttacgtaagtttcgaccgtttacgtcgtcggtacccgaccgacgtaacgaccgtaccgggtaccgttctttacgttttcggtacggtacggtaaggtaacgtaaaccgttaacgtacttacgtacgttcgttaccggtcgggtcgtcgggccgtctacgttccgttcgtaccgtcgttacgtccttccgtccggtcccttaacccggacccggtaccgggtaccctaccggttcccgttaccccgtttccccggtaccggtcccgtaccccgtcgtccgtaccgtaacccggg

SEQ ID NO: 153310 - DNA, 864 bp, Homo sapiens
  misc_feature: GYAE6OF01BZ91J.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagcctccagatcgggccctgtcccaggcgcaagtgcaggacggtccgggcccaggactggtgacggtccttacggaaccctgtctctttcctgcactgtctctactgtctccgtcacgtactcccgtgcgtgggcgtcgggtccgaccgaacccgagggaggtcttggaggtggtagttggagtattacgtcgttcgggtacccgggtagggcctaacgtttaactaacccgtaaccccgtcccgtaaacgtaaaacggccgggtacccgtacccgtaacgtaccggaacggggaaccgaaccgggaaccgaaaagggtaaacgggtaactttccgtaccggtacgttaggtacgttttacgtactttcgtcggttaccgacccgaccggtacgtaacggacccgtacgggtaccgtttacgtttacggtttttacggacggtacggtaacggtaacgttaaaaccgttaccgtttaaccgttacggttaaccttccggttccgggtaccgggggtacccggccggttaccgtaccgttccgttaccgggttcctaaccgttccggttcccttaccccgggtttaccggtcccccttttaaacccccgggaacccgggtaaccccggggttacccccgttaacccgggtttcccccgggtttacccccccgtttacccccgggttcccgggtaacccccggttcccccgttccgggtcccccgttaaaccccgggg

SEQ ID NO: 153311 - DNA, 742 bp, Homo sapiens
  misc_feature: GYAE6OF01CF57I.23.27.C05.1.454.CMB.1.raw
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggagacgtgacgtcggctgcgaaccgcgcactaccgtccngtcngcatctgtgggccagcaccatcactgccgggatgtcgtnactatttcggtcttgngttagtanacaaactaaaaccgngggtttcccncccgtacgtctcgtctactgtacacgtgacgtacgtaacgaacggtcggtaccagtacgagtacttacgaggtcggacggtaggttcgggtacggtttaccggttaacctttaccgaccgttacctaacctaacgtacccggtccgggcccggtaccgttacggccgtaacgttaggttaacgtttacgtttacggtactttacttccgacgtacgtaacgtacgttaacgttacgtacgtaacgtaacccggttaccgtaacgttacgttacggttacgggaaccggtaaccggtaacgttaacgtccgtaaccgttaacgtaaccgttacgtaccggttcggttacgaccgttaccgtaccgtaccgtacgttaccgttccgttacgttaccgttaccgttacccgttacccgttaccgttaccgttaccgttacgttaacgttaccgttaccgtaccgttcggtcggtacgg

SEQ ID NO: 153312 - DNA, 790 bp, Homo sapiens
  misc_feature: GYAE6OF01C5T5G.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtcctctttcctgcactgtcctctactgtctccgtcaccgactccctgcgtggggctgggtcccgccaacccccgaggggaacggtcttgagtggattggagatactcgtcggtcccgggtagggctacttacttaccaaccccgtccctaacgaaaacggaccgggcccgtacctactcggaacggggaccaaccgggaccaaaggaaacggtaacttcctcgtcgttaggtagtttagtaccgtttcgtggtccggtacccgcccggtacaacggtaccgaccgggttccgtttactttaacgttttttcggacggtacgggaaacgggtaaacgtaaaaccctttaccttaaccgttacgtaacgtttccgttaccgggttcgggggggcccctacggggtacctaaccgttcccgggttacggttccgtaaccgtttcccggttacccttaccccggttcccgggtacccgttttacccccggaaaccgggtaaccccgggtcccccttaacggtttcccccgggttacccccgtttcccccgtccgggccccgttacccccgttcggtccccgtaacccggg

SEQ ID NO: 153313 - DNA, 595 bp, Homo sapiens
  misc_feature: GYAE6OF01D9P6J.23.27.C05.1.454.CMB.1.raw
  modified_base (248)..(248): a, c, t, g, unknown or other
  misc_feature (248)..(248): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
  modified_base (509)..(509): a, c, t, g, unknown or other
  misc_feature (509)..(509): n is a, c, g, or t
  modified_base (574)..(574): a, c, t, g, unknown or other
  misc_feature (574)..(574): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtcctccgtcaccgatcccngctggggctgggtccggccaaccccgagggaaggtctgagtggattggagatatcgtcggtcccgggtaggggacctacgttaacttaccgaaaccccgtccctacgaaaacggccgggaccgccctaatacgaacgggggaccacggaccaaaggaaacgtaacttccgacgctaggtagtttgacttcgtgtcgaccgtccgacagacncggcgtnttatttgngacgagagaactctactcgatcgtcgtcgggccgngggcatcgtgtctacgtgtcctccgtcgtactccgacgacggcccacgttcccgtccgttccccnggacctcccgtgccgtaccgg

SEQ ID NO: 153314 - DNA, 417 bp, Homo sapiens
  misc_feature: GYAE6OF01ALLL6.23.27.C05.1.454.CMB.1.raw
  modified_base (312)..(312): a, c, t, g, unknown or other
  misc_feature (312)..(312): n is a, c, g, or t
  modified_base (401)..(417): a, c, t, g, unknown or other
  misc_feature (401)..(417): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggngcaccctctgggggcacagcggccctgggctgcctggtcaaggctacttccatactcgcgtctgagcgggctggcgaaggcgcatacgnnnnnnnnnnnnnnnnn

SEQ ID NO: 153315 - DNA, 848 bp, Homo sapiens
  misc_feature: GYAE6OF01D4LYV.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccgcaaccccgagggaggtcttgagtggattggagatatcgtggtcccgggtaggggctacttacttaccaacccgtcctacgaaaacggaccgggcccgtaccctatccggaacgggggtaccaaccgggacccgaaaaggaaacgggtaaactttccgtaccggtaccttagggttaacggtttttcggaaacccgttttccgttacggttacgggaccccgggtcccggtaccaacgggtaacccggtacccggggtaccccgtttaccgttttaacgtttttttcgggtcggtaccgggtaacgggaaacgtaaaaccgttaaccgtttaaccgtttaccggtaacgttaccgttcccgggtacggggggtaccccggtccgggaccgttaccgtttccccgttacggggttaccctaaccggtttccggttcccgttaccccggttccggtaccccgttttaccccgaaaccccgggtaaaccggggtccccctaacggtttccccgggttaccccttttccccccccggtaccggggtccccgtcccccgttacgggtccccttccccggaaggggtaccccgg

SEQ ID NO: 153316 - DNA, 660 bp, Homo sapiens
  misc_feature: GYAE6OF01DEASQ.23.27.C05.1.454.CMB.1.raw
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggacgaaggtgacgttcagatgacccagtctccaccctcctgtctgcatctgttcgggaccgagtcaccatcacttcgccggacgagtcgtgactattttcggttctttagtctggtatcaaaaacaaaccgtggttcncccctaccgtcctcgtcnctgtcactgacgtagttacgaaagtcggggtacccagtccgagtacttcgagtggcaggtggaggttcggtaacctttacgactcgtacaacgactccggccgtcgtgtccggcctaggaaacgttacgtttttcggggaccttttacgttccgtaggtacctaacggcgtaaacggtttacttaccgaactttacccggtcccgttaacacggttacgtttcgggacccgtaaggggtaaaccctaaggtttccgacttactaacgtaacgacgttgggtcgtactcgacctaccgtattccgttactctaccgtcttacccgttcccactgttcccagtaacctacgtccggtactgtcggacggg

SEQ ID NO: 153317 - DNA, 797 bp, Homo sapiens
  misc_feature: GYAE6OF01DOAWQ.23.27.C05.1.454.CMB.1.raw
tcagacgcgagtatcacgaccggtgctcgatttagacgcgatcgaagggtttggggatgctctcgtgagagtcatggacctcctgtgcaagaacatgaagcacctgtggttttgcctcctgctggtggcagctcccagatgggccctgtcccaggcgcaagtgcaggagtcgggcccaggactggtgaggccttcggaaacctgtctcttcctgcactgtctctactgtctccgtcaccgatccctgcgtggggctgggtcccggacaaccccgagggaaggtcttgagtggattggagatactcgtggtcccgggtaggggctacgtttactaaccgaaccccgttaccctaacgaaaacggtaccgggcccgtaccctaagtccggaacgggggaccgaacgggacccgtaaaaggaaagggtaaactttccgaccggtaccgttaggtacggttttagtaccgttttacgtggttaccggaacccggcccgacgaacggaaccgtaaccgggtcccgtttactttaacgtttttggtcggtacggtaacgggtaaacgtaaaaccgtttaacctttaaccgtttaacgtaccgtttaccgttccgggttaccggggggacccggtccgggtacctaccgtttcccgttaggggttaccctaacggttcccgttaccgtccccgttcgggtaccccgtttacccgaacccggtaaccgggtcccctaaccggtttcccgttaccccgtttcccccccggtcgggtccccgtccccggtgtccccgttaacccggg

SEQ ID NO: 153318 - DNA, 620 bp, Homo sapiens
  misc_feature: GYAE6OF01B6GAT.23.27.C05.1.454.CMB.1.raw
  modified_base (397)..(397): a, c, t, g, unknown or other
  misc_feature (397)..(397): n is a, c, g, or t
tcagacgcgagtatcacgaccggtgctcgatttagacgcgatcgaagggtttggggatgctctctgagagtcatggacctcctgtgcaagaacatgaagcacctgtgttttgcctcctgctggtggcagctcccagatgggccctgtcccaggcgcaagtgcaggagtcgggcccaggactggtgaggccttcggaaaccctgtctctttcctgcactgtctctactgtctccgtcaccgactccctgcgtggggctgggtcccggccaaccccgagggacggtcttggagtggattggagatagtctcggtccggtagggctactttactaccaacccgtcctacgaaaacggaccggccgaccctatcgagggacacggacaaggaacgaattcncgctagtagtttcacttcgtgtcgaccgcgacagacgaccggtcgttacttagtttttcgcgtacggaggtaaacgtaacctacgttacttacgtacttccgtcggtcggggcccgcgggtacctgttcccgtaggtctacgttcgtaccttccgtcgccgttaccgaccgacggtcccacgttcccgttcccttccccgtgcccgtccctcgtccctaccgg

SEQ ID NO: 153319 - DNA, 854 bp, Homo sapiens
  misc_feature: GYAE6OF01C64QT.23.27.C05.1.454.CMB.1.raw
  modified_base (361)..(361): a, c, t, g, unknown or other
  misc_feature (361)..(361): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgactccctgcgtggggctcgggtccgccaaccccgagggacggtcttggagtggattggatatatcgtggtccggtagggctacgttactaccgaacccgtcctaacgaaacgccggccncctagtcgacgggacacggaccgaagaaaggtaacttcgtacgcttagtagtttcgtacttcgtcggtacgacccgccgactacggaaccgtaccgggtcccgtttactttaaacgttttttggacggtacgggtaaacgggtaaacgtaaaaccgtttaaccgtttaacggtttaccggtaaacgtttcccggttaccgggttaccgggggggtacccccggtaccggggtacccgttaaccgttttcccccgggttacggggtttacccttaacccggtttccggtttacccgttaccccccggtttacccggggttacccccgttttaccccccggaaaacccccggggttaaacccggggtacccccccgttaaaccgggttttcccccccggggtttccccccgtttttaacccccccccccggggttagggggtacccccccgtttcccccccgggttacggtccccccgtttaaaccccccggggg

SEQ ID NO: 153320 - DNA, 576 bp, Homo sapiens
  misc_feature: GYAE6OF01DTZB0.23.27.C05.1.454.CMB.1.raw
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (339)..(339): a, c, t, g, unknown or other
  misc_feature (339)..(339): n is a, c, g, or t
  modified_base (422)..(422): a, c, t, g, unknown or other
  misc_feature (422)..(422): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
  modified_base (559)..(559): a, c, t, g, unknown or other
  misc_feature (559)..(559): n is a, c, g, or t
tcagacgcgagtatcacgaccggtgctcgatttagacgcgatcgaagggtttggggagtgctctctgagagtcatggacctcctgtgcaagaacatgaagcacctgtggttttgcctcctgctggtggcagctcccagatgggccctgtcccaggcgcaagtgcaggagtcgggccaggactggtgagccttcggaaaccctgtctctttcctgcactgtctctactgtctccgtcaccgatcctgcgtgggctgggtccgcaaccccagggaggtctgngnggntgagatatgtcgtcggtagggctacttatactaccgtcctacgaaacgcggccnctatcgagggacacggacaaaggaactagtctacgcgtgtagttcgtacttcgtcgtagacccgcgacagacgaccgtcgttnttagtttgcgtagagagaaacttactacgttnacgttctcggtcggacgcgtcacgtcctggtacncgttcgtcctccgtcgtccgtaccgaccgacggtcccctaagttcccggtacccttccccggtcggacccncccgtgtccgtacccgg

SEQ ID NO: 153321 - DNA, 408 bp, Homo sapiens
  misc_feature: GYAE6OF01CM43Q.23.27.C05.1.454.CMB.1.raw
  modified_base (395)..(395): a, c, t, g, unknown or other
  misc_feature (395)..(395): n is a, c, g, or t
  modified_base (401)..(408): a, c, t, g, unknown or other
  misc_feature (401)..(408): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacgcggccaagaaggaattctcgctgagtttgacttctgtgaccgccgcagacacggccgtctattttgtgcgaggagaaactactacttcgatctctggggccgcggcatcctggtcactgtctcctcggcttccaccaaggcccatcggtcttcccctggccgccctgctccaggagcacctcgtgggggcacgaggccggcccgtgggctgcctggtcaacggactacttcatactcgcgtctgagcgggctggcaggcncatagnnnnnnnn

SEQ ID NO: 153322 - DNA, 620 bp, Homo sapiens
  misc_feature: GYAE6OF01BVRLN.23.27.C05.1.454.CMB.1.raw
  modified_base (484)..(484): a, c, t, g, unknown or other
  misc_feature (484)..(484): n is a, c, g, or t
  modified_base (603)..(603): a, c, t, g, unknown or other
  misc_feature (603)..(603): n is a, c, g, or t
  modified_base (610)..(610): a, c, t, g, unknown or other
  misc_feature (610)..(610): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccatgtcccaggcgcaagtgcaggagtcgggcccaggactggtgaggccttcggaaaccctgtctctttcctgcactgtctctactgtctccgtcaccgatccctgcgtggggcgtcggggtcccggccaaacccccgagggaacgggtcgttggaggtggagttggagattatcgtcggtcccgggtaggggctacttacttacctaaccccgtccctacgaaaacggaccgggcccgcctatccgagggaccgaccggacaaaggaagaacttcgtcgtctgtagttcgtacttcgtgtcgacccgccgacacgacgaccggtccgttctttagttttgngtcgagaacgtaactacgttacttcgtatcgtcggcggggccgccggctacgtccgttggtccacgttgtcctccgtccggtcttcccgaccgacgggccctagtccgtcccttcccgnggtcccncccgtgcccg

SEQ ID NO: 153323 - DNA, 572 bp, Homo sapiens
  misc_feature: GYAE6OF01AGKWF.23.27.C05.1.454.CMB.1.raw
  modified_base (385)..(385): a, c, t, g, unknown or other
  misc_feature (385)..(385): n is a, c, g, or t
  modified_base (555)..(555): a, c, t, g, unknown or other
  misc_feature (555)..(555): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccatgtcccaggcgcaagtgcaggagtcgggcccaggactggtgaggccttcggaaaccctgtctctttcctgcactgtctctactgtctccgtcaccgatccctgctggggctgggtccggccaaccccgagggaaggtcttgagtggattggagatatctgtcccggtagggcacttataccacccgtcctacaaaggcggccgcctagtccgaggggacacggaccaagaaggaattcncgctgagtttgacttctgtcgaccgccgcagacgacggtccgtcttattttgtgcgaggacaactactacttcgactcgtcgtcggggccgcggctactccgtggtctactcgtcctccgtcggtccttcccgaccgtacgggcccctagttcccggtcccttcccccgnggccctcccgtcgcccg

SEQ ID NO: 153324 - DNA, 672 bp, Homo sapiens
  misc_feature: GYAE6OF01CD6H8.23.27.C05.1.454.CMB.1.raw
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
tcagacgcgagtatcacgaccggtgctcgatttagacgcgatcgaaggggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttacggaaaccctgtctcttcctgcactgtctctactgtctccgtcaccgactccctgcgtggggctcggggtcccggaccaacccccgaggggaacgggtcttaggagtggattggagatatcgtcggtcccgggtaggggcctaacttataccaacccgtccctacaaaacggccgggccncctatcgaggggacacggacaaagaaggtattcncgctgtagtttgacttcgtgtacgaccgccgacacgaccgacggtccgttcttagttttggacgcggtaaggaactaaactactacgttcgacttcgtcggtcggggccgtcggacctacgttccgtacggtcctacgttcgtcccttccgtccggtccctttacccgaacccggtaacgggtcccctaaggttccccgggttcccctttccccccggtcggtcccccggtccccgttggaccccttcccggaagggtaccccgg

SEQ ID NO: 153325 - DNA, 699 bp, Homo sapiens
  misc_feature: GYAE6OF01BE4Q4.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcatctcccagatgggccctgtcccaggcgcaagtgcaggagtcgggcccaggactggtgaggccttcggaaaccctgtctctttcctgcactgtctctactgtctccgtccaccgactccctgcgtggggcgtcgggtccggaccaaccccggagggtaacgggttcttggagtggtagttggagtatagtcgtcgggtacccgggtaggggtcctacgtttaacttaacccgtaaccccgtaccctacgaaaacggaccgggacccgaccccgtacgtaccggaacgggggaaccgaccggaccgaaaggaaacggtacttcgtcgtacgtggtagtttcgtacttcgtacgtcgaccgccgacacggaccgaccggtccgttacttagtttttgacggacggtaagggtaacgtaaaccttacgttacgttcgtacttcgtcggtcgggtctcggcggctacgttccgtggtcctacgttcgttcctccgtccggtccttacccggaccgtacggccctacgttcccggttccccttccccgtcggcccgtcccgtcgtcccgtccgacggg

SEQ ID NO: 153326 - DNA, 638 bp, Homo sapiens
  misc_feature: GYAE6OF01CP6XT.23.27.C05.1.454.CMB.1.raw
  modified_base (408)..(408): a, c, t, g, unknown or other
  misc_feature (408)..(408): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatcctgctgggctgggtccgcaaccccgagggaacggtcttgagtggattggagatatcgtcggtcccggtagggcctactttactaccaacccgtccctacgaaaacggccggcccgcctagacgaggggacacggccaaagaacgacttcgtcgctagtagtttnacttctggtacgaccgccgctagaccgacggtccgttattacgtttttgagtcggaacggtaagtaaaccttaccttaacgttcgaacttcgtacgtcggggcccgtacggtctacgttcccgtaggtccacgttcgtaccctcgtccggactttcccgaaccgaaccgggtccctacgttccccggttacccttccccccgtcggcccgtcccctggtccctacccggg

SEQ ID NO: 153327 - DNA, 626 bp, Homo sapiens
  misc_feature: GYAE6OF01B65U3.23.27.C05.1.454.CMB.1.raw
  modified_base (212)..(212): a, c, t, g, unknown or other
  misc_feature (212)..(212): n is a, c, g, or t
  modified_base (399)..(399): a, c, t, g, unknown or other
  misc_feature (399)..(399): n is a, c, g, or t
tcagacgcgagtatcacgaccggtgctcgatttagacgcgatcgaagggtttggggatgctctctgagagtcatggacctcctgtgcaagaacatgaagcacctgtgttttgcctcctgctggtggcagctcccagatgggccctgtcccaggcgcaagtgcaggagtcgggcccaggactggtgaggccttcggaaaccctgtctctttcngcactgtctctactgtcctccgtcaccgactccctgcgtgggcgtcgggtccgacccaaccccgaggggtacggtcttgagtggtagtggagatatcgtcgtccggtagggctacttactaccacccgtcctaacgaaacgccggccacctagtcgacgggacgacgaccaaggaacgaatctcgtntgtagttgtacttgtcgtcgaccgccgcgacgacgaccggtccgttacttagttttggcgtacggtagaaacgtaactacttacgttcgtactcgtccgtgggccacgtgtaccgtccgttggtcctacgttcgtccgtccgtccggtccttacccgaaccgaaccgggtccctaccgttcccggttccccttccccggtcggcccgtccccgtgtcccgtaccggg

SEQ ID NO: 153328 - DNA, 781 bp, Homo sapiens
  misc_feature: GYAE6OF01EDF7B.23.27.C05.1.454.CMB.1.raw
  modified_base (586)..(586): a, c, t, g, unknown or other
  misc_feature (586)..(586): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagcctcccagatgggccctgtcccaggcgcaagtgcgaggagtcgggcccaggactggtgaggccttaccggaaacccttgtctctttcctgcactgtctctactcgtcctccgtccaccgtctcccgtgcggtggggccgtcgggtcccggacccgaaaccccggaggggtaacgggttcgttaggacggtaggtagttgggaatagtacgtccggttacgggtaccccggggttaaggggtaccttaccgttttaaccgttaaccccgaaacccccgttaccctaaacggaaaaccgggcccgggacccctacccgtacgtaccggaacggggtaccaaccgggaaccgaaacggaaacggtaacgttcgtaccgtcgttacgttaagttcgttacgttcgtcggtacggaccccgtcgcgaacgaccggtaccggtccgttctttagtttcggngtacggaaggaactaacttcgttacgttcagttccgtacgggtcgggacccgtgaccgttacgtcccgttggtaccctacgtttccggtaccgttcccgtccggtaccgttacccccggaacgtacccgggtaccctacggtttccccggttcccctttccccggtcggcccccgttcctccgccgttaacccgg

SEQ ID NO: 153329 - DNA, 557 bp, Homo sapiens
  misc_feature: GYAE6OF01BXFWS.23.27.C05.1.454.CMB.1.raw
  modified_base (389)..(389): a, c, t, g, unknown or other
  misc_feature (389)..(389): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccgccaaccccgagggaagggtcttgagtggattggagatatctggtcccggtaggggcacttattaccacccgtccctacaaaagccgggccgccctatcgaggggacacggccaaagaaggaattcncgctgagtttgacttntgtgaccgcgcagacacggccgtctagttttgngcgaggagtaactactacttcgatcgtcgtcgggccgcggtcatccgtgtcacgtgtcctccgtcggtctccaccgacggcccagttccggtccttccccgtggccgccctgcctaccg

SEQ ID NO: 153330 - DNA, 693 bp, Homo sapiens
  misc_feature: GYAE6OF01EO7TY.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctgggctgggtccgcaaccccgaggaggtcttgagtggatggagatatcgtaggtcccgggtagggctacttactaccgaacccgtccctaacaaaacgaccgggcccgtaccctagtacgaggggaccgacggaccaaaggaaggaacttctacgctcgtagtttgtacttcgtgtacggacccgccgacaggaccgtaccggccgttacgttacgtttttaggacgacggttaacgggaacgtaaaacttccgttaacgtttaccgtattacccgttggttaccggggggccccgtaccgggtccaacgtttcccggtacgggttccctaagttccggtccttccccgtcggttcccttacccgaacccgtaaccggtcccgtacgttcccggtacccctttcccccggtggacccccgtccccggtcgcccgtaccccggg

SEQ ID NO: 153331 - DNA, 637 bp, Homo sapiens
  misc_feature: GYAE6OF01BEAKL.23.27.C05.1.454.CMB.1.raw
  modified_base (454)..(454): a, c, t, g, unknown or other
  misc_feature (454)..(454): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggccaaccccgagggaaggtcttgagtggattggagatatctcggtcccggtaggggctactttattaccaacccgtcctacgaaaacggcgggcccgcctatcgacggggacacggaccaagaacggaattctcgctgtagtttcgacttctgtcgaccgccgacacgaccacggtccgttcttagtttttgngacggaaggtaacgtaaaccttacttacgttcgaacttccgtcggtcggggccgccgggactacgttccgtgggttcctacgttcgtccttccgtccggtcctttacccgaaccgtacgggcccctagttcccggttacccgttcccccgtgggcccgtcccctggccctccggaggtacccg

SEQ ID NO: 153332 - DNA, 797 bp, Homo sapiens
  misc_feature: GYAE6OF01B44Z7.23.27.C05.1.454.CMB.1.raw
  modified_base (279)..(279): a, c, t, g, unknown or other
  misc_feature (279)..(279): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctggttggggaccagtccaccatcacttggccgggcgagtcgtgactagttttcggttctttagtctggtatacaaacaaaacctgggttcnccctaccgtcctcgtcgctgtcactgacgagttaacgaaaggtcggggtcccaagtcggagtattcgaggtggcgaggtgggagggttacgggtaccttttaacgactcgtaccaacaacgtccggacccggtcccgtcggcccgggtacccgttaggtaaacggtttagtttttacggggtaccttttaaccgtttcgttcggttaccgtaggtacttaacggttaactttaccgtaacgtttaaccggtaccccttaacgtaaccgttaacggtttccggggaaccgtaacgggggtaaaccctaaaggtttccgaacccttacgaaacgttaaccggaacgtttcggtacggtaccgttacggtacctaacccgtacgtttccgttacggtttaccctttaccgtaccgtttaaccccggtttcccccctaaccggttaccgtttacccgttaaacggtttaaacccttacccggtaccccgggtttacctaccgggttacgggtaaccgggggg

SEQ ID NO: 153333 - DNA, 419 bp, Homo sapiens
  misc_feature: GYAE6OF01CLWMR.23.27.C05.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
  modified_base (400)..(419): a, c, t, g, unknown or other
  misc_feature (400)..(419): n is a, c, g, or t
tcagacgcgagtatcacgaccggtgctcgatttagacgcgatcgaagggtcttgagtggattggagatatctgtcccggtagggggcacttattacaacccgtccctcaaaaagacgggccgccctatcaggggacacggccaagaaggaattctcgctgagtttgacttctgtgaccgccgcagacacggccgtctatttttgngcgaggagaaactactaacttcgatctctggggccncggcatcctggtcactgtctcctcggcttccaccaaggcccatcggtcttcccctggcgccctgctcaggncactctgggggcacagcggccctgggctgcctggtcaaggactacttccatactcgctctgaggcgggctggcaagggccgctatagnnnnnnnnnnnnnnnnnnnn

SEQ ID NO: 153334 - DNA, 716 bp, Homo sapiens
  misc_feature: GYAE6OF01CTQPY.23.27.C05.1.454.CMB.1.raw
  modified_base (241)..(241): a, c, t, g, unknown or other
  misc_feature (241)..(241): n is a, c, g, or t
tcagacgcgagtatcacgaccggtgctcgatttagacgcgatcgaagggtttgggggctctctgagagtcatggacctcctgtgcaagaacatgaagcacctgtggtttttgcctcctgctggtggcagctcccagatgggccctgtcccaggcgcaagtgcaggagtcgggcccaggactggtgaggccttacggaaaccctgtctcttcctgcactgtctctactgtcctcgtcaccgntccctgcgtgggctgggtccgcaaccccgagggaacggtcttagagtggattggagtatatcgtcggtcccgggtaggggcctaacttactaccgaacccgtccctacgaaaacggccgggccgacctacgtcgaacggggacacgggtaccgaaagtaaacggactttaccgtcgtacgtagtagttttcgaactttcgtaggttacgacccggccgtacgaggtaccgtacggtccgtttactttagtttttcggaggacggtaaggtaacgtaaacgttacgtacttacgaacttccgtcggtacgggccgtcggtacctacggtccgttagggtacctacgttcgttaccctccggttccggtaccctttacccgaaacccggtaacgggtccccctaacggttccccggttaccccgtttccccccggtaggtccccgtaccccgttgccccgttaccgacgggtacccg

SEQ ID NO: 153335 - DNA, 642 bp, Homo sapiens
  misc_feature: GYAE6OF01BGUVU.23.27.C05.1.454.CMB.1.raw
  modified_base (456)..(456): a, c, t, g, unknown or other
  misc_feature (456)..(456): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctggggtccgcaacccccgagggaaggtcttgagtggattggagatatctggtcccggtaggggcacttattacacccgtcctcaaaagcgggccgccctatcgacggggacacggaccaaggaacggaacttcgtcgctggtacgtttgaacttctgtcgaccgccgacgagaccgaccggccgttcttaacgtttttcggngtacggaagggtacgtaaaccgtaccttacgttcgacttcgtcgtcggggcccgacggctacgtccgttggtcctacgttcgtccttcccgtcggtccttaccccgaccgaacggggtcccctaggttcccggtccctttacccccgtgggtccccgtcccgtacgcccgttcccgaggtacccgg

SEQ ID NO: 153336 - DNA, 573 bp, Homo sapiens
  misc_feature: GYAE6OF01DN3VJ.23.27.C05.1.454.CMB.1.raw
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (552)..(552): a, c, t, g, unknown or other
  misc_feature (552)..(552): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtcccggcaacccccgagggaagggtcttgagtggattggagatatctggtcccggtaggggcacgtttattaccaaccccgtccctacaaaacgccgggccgccctatcgagggacacggcaagaaggatctcgctgagttgacttntgtgaccgccgcagacncggctctattttgngcgaggacaactactacttcgatcgtcgtcggggcccgcgggccacgtccgtggtccacgtgtcctccgtcggccttccaccgtaacgggccccagtcccggtcccttcccccgnggcccgccctggccctcccgg

SEQ ID NO: 153337 - DNA, 1035 bp, Homo sapiens
  misc_feature: GYAE6OF01CUZLD.23.27.C05.1.454.CMB.1.raw
  modified_base (210)..(210): a, c, t, g, unknown or other
  misc_feature (210)..(210): n is a, c, g, or t
tcagacgcgagtatcacgaccggtgctcgatttagacgcgatcgaagggtttggggatgctctctgagagtcatggacctcctgtgcaagaacatgaagcacctgtgtttgcctctgctggtggcagctcccagatcgggccctgtcccaggcgcaagtgcaggacgtcgggccaggactggtgaggccttacggaacctgtctctttcngcactgtctctctgtctccgtcaccgctccgtgcgtcggggtccgtcgggtacccggacccgaacccccggagggggtaacgggttcgttaggacggttagggtacgttaggggaacgtagttacgttccggttccgggttaccccggggttaggggtacccttaaccgttttaaccgttaaaccccgtaaccccccgttacccgtaaaccggaaaaccgggtaccccgggggaccccgtacccgttaacggaccggtaaaccgggggaacccgaacccggggaaccgtaaaacgggtaaaacggtaacgtttccggttaccggtacgttacgggtttaacggttttacggttaaccgtttcggtttacggggtaccggaacccccggtcccgggtaccgtaaaccgggtaccgggtaaacccccgggttccggtttttaaccgttttaacggtttttttccgggacgggtaaccggggtaaacgggttaaacccgtaaaacccgttttaacccggttttaacccgtttacggttaaccggtttccggttaccccggggtttaccggggggggaccccgttaccccggggtcgttaacccggttcccgggttttaacccgggttacccttaaccgggtttcccgtttaccccggttccccgggttccccggttaaccccgttttaaccccccgggaacccgggttaaaacccccggggtccccccgtttaaaccgggttccccccggtttcccccggtttccccccccgggttaccggggtcccccgtacccccggtttcccggtacccccgggttaaccccggg

SEQ ID NO: 153338 - DNA, 408 bp, Homo sapiens
  misc_feature: GYAE6OF01ELZDZ.23.27.C05.1.454.CMB.1.raw
  modified_base (398)..(408): a, c, t, g, unknown or other
  misc_feature (398)..(408): n is a, c, g, or t
tcagacgcgagtatcacgaccggtgctcgatttagacgcgatcgaagggtttgggtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctgggggccgcggcatcctggtcactgtctcctcggcttccacaagggcccatcggtcttcccctggccgcctgctccaggagcacctctgggggcacgagcggcccgtgggctgcctggtcaaggactacttccatactcgcgtctgagcggctggcaaggcgcatagnnnnnnnnnnn

SEQ ID NO: 153339 - DNA, 981 bp, Homo sapiens
  misc_feature: GYAE6OF01CBL15.23.27.C05.1.454.CMB.1.raw
  modified_base (139)..(139): a, c, t, g, unknown or other
  misc_feature (139)..(139): n is a, c, g, or t
  modified_base (254)..(254): a, c, t, g, unknown or other
  misc_feature (254)..(254): n is a, c, g, or t
tcagacgcgagtatcacgaccggtgctcgatttagacgcgatcgaagggtttggggatgctctctcgagagtcatggacctcctgtgcaagaacatgaagcacctgtggtttgcctcctgctggtggcagcctccgagngtcgggtccctgtcccgaggtcgacgtaagtcgcgagggtacggtccgggcccgagggtacgtgggtggacgggtcccgttacgggaaaccccgttggttcctttccgttttccncgtcctacgttcgtcttacgtaccttcgtccgtccgtcaccgtactccgtgcggtcgggccgtcgggtcccgaccgtaacccggtaggggtaacggtcgttaggacggttacggtagttcgggagtactacgtcggtaccgggtaccggggtagggccttaacgtttaactaacccgtaaccccgttacccgtaaacggaaaccgggtaccgggtacccgtaccgttaacggtaccggaacggggtaaaccgaaccgggaaaccgtaaacgggtaaaacggttacgttaccgtacggttacggttaacggtttaggttttaccgtaccgggtttacgtacgggttacccggaaccccggccgtaacccgtaacgggaaccccggtaacgggttccccgttttaacgttttaacggttttcggaccgggtaaaccgggtaacgggtaaaacctttaaacccgtttacccgtaacggtttacccggtaacggtttcccggttaccgggggttaacccggggcccgtaccgggttacccgttaaccggttacccgggttcgggttaccccttaaggttcccggtttcccggttaccccggttcgggttacccccttaaccggggtaacccggacccggggttacccctaccggggttttcccccgttccccgggttaccccccggttcggggtccccggtaccccccggttggtaaccccggtacccggg

SEQ ID NO: 153340 - DNA, 669 bp, Homo sapiens
  misc_feature: GYAE6OF01DDIGN.23.27.C05.1.454.CMB.1.raw
  modified_base (236)..(236): a, c, t, g, unknown or other
  misc_feature (236)..(236): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatcgacccagtcctccaccctcctgtctgcattctggttcggggaccagtcaccatcacttggccggcgagtcgtgactnttttcggtctttagtctggtatacaaacaaaacctagggttcgcccctaccgtcctcgtcgctgtcactgacgtagttacaaggtggggtcccatcgagtnttcaggtggcaaggtgggtaggtcgggtacctttanactctcgactaactcgccggcctggtccggcctagaagtagttttggggaacttttactttcgtgttcgagtcctaagtacttacagttacgtccccgtacacttacgtttcgggaccaacgggggtaacctaacggttgacccgtactaacgttaaacggaacgttggttacgggcttacgtcctaaccgtactttcgttacgttccctttacgtaccctttccgtttcccccgccttaccttacgttaacgtaacgtttaccctccgggttccgttccggtggtaacccggggg

SEQ ID NO: 153341 - DNA, 574 bp, Homo sapiens
  misc_feature: GYAE6OF01AUQD1.23.27.C05.1.454.CMB.1.raw
  modified_base (275)..(275): a, c, t, g, unknown or other
  misc_feature (275)..(275): n is a, c, g, or t
  modified_base (388)..(388): a, c, t, g, unknown or other
  misc_feature (388)..(388): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgngggaagggtcttgagtggattggagatatctgtcccggtaggggctacttattacaacccgtccctacaaaagcgggccgccctatcaggggacacggccaagaaggaattcncgctgagtttgacttctgtcgaccgcgcagcacggcgtctattttgngcgagganaactactacttcgattctcgtcggggccgcgggccattccgtggtctactggtcctccgtcggccttcccgaccgacgggccccagttccggtcccttccccccgtggcccgtcccgtcgtcccgtaccgg

SEQ ID NO: 153342 - DNA, 1055 bp, Homo sapiens
  misc_feature: GYAE6OF01A6F20.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttcgcctcctgctggtggcagcctcccagagtcgggccctcgtcccgaggcgcgaagtgcgaggacggtccgggacccgaggtacgtgggtcggacggtccgttaccggaaacccttgttccttcctttccgtcgcctacgttcgtcttccttacgtcgtccctcccgtccgacccgtacctcccgtggtccggttcggggtccggttaccggggtccccggaaccccgaaacccccgggtaagggggttaacgggttccgtttacggtacggttagggttacgttagggtaacgtacgttacgttccgttaccggggttaccccggggtacgggtaccttaaccgttttaaccgttaaacccccggtaacccccgttacccctaaaaccggaaaaccgggtccccgggtaccccgtaaccccgtttaacggtacccgggaaaccgggggtaaaccccggaacccgggtaacccgtaaaaacgggtaaacgggttaaacccgtttccggtaaccggttacggtttacgggtttaacggttttaccgttaaccgtttccggttacgggttaacccggacccccgggtacccgtaaccggggtaaccgtaacccggggttacccgggttacccgttttacggtttttaaggtttttcgggaaccggtacgggtaaaacggttaaacgtaaaccctttaccggtttaaccgttacggtaaccgtttcgggttaccccgggtacgggggtcccccggtacggtaacccgttaccggtttccccggtacggttaccctaccgggttacccgttcccgttccccggttaccgggtaccccttaaccccggaaccgggtaaccccgggttccctacccgggtttaccccgtttccccccggttacccccgggtccggtcccccgtcccgtcccgggtcccgtaaccccgggg

SEQ ID NO: 153343 - DNA, 658 bp, Homo sapiens
  misc_feature: GYAE6OF01C5LVF.23.27.C05.1.454.CMB.1.raw
  modified_base (212)..(212): a, c, t, g, unknown or other
  misc_feature (212)..(212): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
tcagacgcgagtatcacgaccggtgctcgatttagacgcgatcgaagggtttggggatgctctctgagagtcatggacctcctgtgcaagaacatgaagcacctgtgttttgcctcctgctggtggcagctcccagatcgggccctgtcccaggcgcaagtgcaggagtcgggcccaggactggtgagccttcggaaccctgtctctttccngcactgtctctactgtctccgtcaccgatccctgcgtgggcgtcgggtcccggaccgaacccccgaggggtaacgggttcttggagttcggagttggagatactcgtcggtcccgggtagggctactttactaccaacccgttcccaacgaaacggaccgggccgcccgtatcgaggggacagtcggaccaaaggaacgtaagttcgtcgacttgtagtttgacttcgtgtcgacccgccganacgacncggtccttntttagtttgngcggaagaagtaactcttactcgattccgtcgtcggggccgtcggctacgtaccgttggacctacgtcgtaccgttcccgtcccggtaccttcccccgaaccgggtaacccgggccccttacggtttccccgttccccgtttcccccccgtgggtcccccctacccggttgtcccccg

SEQ ID NO: 153344 - DNA, 439 bp, Homo sapiens
  misc_feature: GYAE6OF01EXAX1.23.27.C05.1.454.CMB.1.raw
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
  modified_base (429)..(439): a, c, t, g, unknown or other
  misc_feature (429)..(439): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctcgtggggccgcggcatcctggtcactgtcctcctcggcttccaccaagggcccatccggtccttcccctggccgccctgcctccgaggacgccaccgtcgtgggggccacgacgccggcccgtgggcctcgccgtgggtacaacggtacctacttccataccgtcgcgtcgngaggcgggctggcgaagggcncgatagnnnnnnnnnnn

SEQ ID NO: 153345 - DNA, 780 bp, Homo sapiens
  misc_feature: GYAE6OF01B7ZNE.23.27.C05.1.454.CMB.1.raw
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgtgggaccagtccacatcacttgccgggcgagtcgtnactattttcggttctttagtctggtatacaaacaaaaccagggtttcnccctaccgtcctcgtcgctgtcacgtgacgtagttaacgaaaggtcggggtacccagtcgagtacttcgaggtggtcgagggttgggaacggggttacgggttaccctttttaacgaccttcctacaaccgtaacgtcccggccccgggtcccgttcggccgggtacccttaggtaaacggttacgttttttacggggtaaccttttaacgtttcttacggttacaacgtcttaaaggtttaacttaaccgtaacttaaccggttacccccgtaacgtaacgttaacggttttcgggaaccccgtaagggggtaaccctaaacgggttccgtaacccttacgaacgttaacccgtaacgttcgggttacggtaccttacggaccctaacccgaattttccggttaccgttacccttttacgtaacctttccccggttaaccccgtccctaacgtttaccctacggttaaacttacccgttccggacccggtttgacgggtaccggg

SEQ ID NO: 153346 - DNA, 723 bp, Homo sapiens
  misc_feature: GYAE6OF01A03YH.23.27.C05.1.454.CMB.1.raw
  modified_base (383)..(383): a, c, t, g, unknown or other
  misc_feature (383)..(383): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatcgggccctgtcccaggcgcaagtgcaggagtccgggcccaggactggtgacggcccgttcggaaaccctgtccttcctttcctgcactgtctctactgtcctccgtccaccgctcccgtgcggtcgggcgtcgggtccgaccgaacccccgagggaacggtcttggagtggagttggagatatcgtcggtcccgggtagggctaacttactaccctaacccgtcctaacgaaaacggcggaccncctagacgacgggacacgaccgaaggaacgtaacttcgtcgtacgtgtagtttcgtacttcgtcggtacgacccgaccgcgaacgaccgacggtccgttctttacgttttggcgacgggtagtaaccgtaaacttactacgttacgtacgttccggttccggaccgggggtcccgacgggtccttaccgttccctcgggttacccaccgttcgtcccgttaccggttcccggtaccctaccccgtaacccggaaccgggtccccctagggtttacccccggttcccccggtttccccccgacgggtacccccggtcccctcggtcccccggttacccggg

SEQ ID NO: 153347 - DNA, 627 bp, Homo sapiens
  misc_feature: GYAE6OF01CV3N9.23.27.C05.1.454.CMB.1.raw
  modified_base (224)..(224): a, c, t, g, unknown or other
  misc_feature (224)..(224): n is a, c, g, or t
  modified_base (465)..(465): a, c, t, g, unknown or other
  misc_feature (465)..(465): n is a, c, g, or t
tcagacgcgagtatcacgaccggtgctcgatttagacgcgatcgaagggtttggggatgctctctgagagtcatggacctcctgtgcaagaacatgaagcacctgtgttttgcctcctgctggtggcagcctcccagatcgggccctgtcccaggcgcaagtgcaggagtccgggcccaggactgggtgacggtccttaccggaaaccctgtccttcctttccngcactgtctctactgtcctccgtcaccgactcctgcgtcgggcgtcgggtccgaccaaccccggagggaacggtctgagtggagttggagtatacgtcgtcggtccggtaggactacgttactaccaacccgtcctaacgaaacgccggtccacctagcgaacgggaccacggacgaaagacgtaatcgtacgctgtagttgtacttcgtcgtacgacccgcgacgacgacgacggtcttnttagtttgcgagtagaactaacgtctacgtcgtagtcgtacggcgggaccgtcgtactcgttccgtggtcctacgttcgtcccgttccgtcggtcctaccgaccgtaccggtccctacggtcccgttccctccccggtacgcccgtccgtcgcccgtaacgg

SEQ ID NO: 153348 - DNA, 703 bp, Homo sapiens
  misc_feature: GYAE6OF01ET57W.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatcccctgcgtggggctcgggtccgccaaccccgagggaaggtcttgagtggattggagatatcgtcggtcccggtaggggcctactttactaccaaccccgttccctaacgaaaacggccgggccgaccctatccggaaggggaccacgggaccaaaggaacggtaacttcgcgtactaggtagtttcgtactttcgtcgtacgacccggtaccgcaagaccgacggtcccgttactttaagtttttcggtacgtacggaacggtaacgtaaaccttacttaccgtttacgacttcggtacgtacggggtacccaacgggtcctaacttcccgtgtacctacgttcgtcccgttacccgtccggtacctttccccgaaaccgtaaccgggccccttacggttcccggttaccccgtttccccccggttccgggtcccggtccccggtcgtcccgtacccgg

SEQ ID NO: 153349 - DNA, 786 bp, Homo sapiens
  misc_feature: GYAE6OF01ETZ1T.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtcctccgtcaccgtatcccctgcgtggggctcgggtccggaccaacccccgaggggaacggtcttggaggtggattggagtatatcgttacggtcccgggtaggggtcctaacgttattaaccgaacccgtccctacgaaaacgaccgggtccgaccctatcgacggggacacgggaccaaagaacggtaacttcgacgacgtcggtagtttcgactttcgtagtcgacccggtaccgcgaacggtaccgaacgggtcccgttacgtttaagttttttcggacggtacggtaacgggtaaacgtaaaacccgttaacgttaaccgtttacccggaatttacccgttcgggttaccggggggtaccccgtccgggtacccgttaacgtttccccggtagggttaccctaaccggttcggttccccgtttccccgtaccggggttaccctttacccccgaacccgggtaaacgggtcccccctaaggttccccgggttaccccctttccccccgggtacgggtaccccgtcccccgttcggccccgttaaccccgggg

SEQ ID NO: 153350 - DNA, 628 bp, Homo sapiens
  misc_feature: GYAE6OF01EOG0V.23.27.C05.1.454.CMB.1.raw
  modified_base (156)..(156): a, c, t, g, unknown or other
  misc_feature (156)..(156): n is a, c, g, or t
  modified_base (482)..(482): a, c, t, g, unknown or other
  misc_feature (482)..(482): n is a, c, g, or t
  modified_base (614)..(614): a, c, t, g, unknown or other
  misc_feature (614)..(614): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcncaagtgcaggagtcgggcccaggactggtgaggccttcggaaaccctgtctctttcctgcactgtctctactgtctccgtcacgatccctgctggggctgggtccgccaaccccgagggaacggtctgagtggagtggagatatctggtccggtagggcacgttattaaccaacccgtccctacgaaaaacggccgggccgaccctagtaccgaggggaacaccggtaccaaggaaacggtacttactcgctaggtagtttacgaactttcgtgtcgaccggccgtacgacggtacgacccggtccgttacgttagttttttcggngtaccggaagggaaacctaaacgttacccttatttaccgaacttcgtccggtacggggcccgcggtactacgtccgtggtcctacgtcgtacctccgtcgtcttccgaccgaggcccagtccgtcctcccgngcctcctgcctacg

SEQ ID NO: 153351 - DNA, 799 bp, Homo sapiens
  misc_feature: GYAE6OF01BS9MC.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccgaggcgcaagtgcgaggagtccgggcccaggacgtggtgacggtccttacggaaaccctgtctctttcctgctactgtctctactgtcctccgtcaccgactccctgcgtcgggctcgggtccgaccaaccccgagggtacggtctgagtggtagttggagtatacgtcgtcggtacccgggtagggacctaacgtttactaaccgaaccccgtcctaacgaaacggaccgggaccgaccctacgtacggacgggaaccaaccggaacgaaacggtaaacggtaacttccggtacgtccgtaggttacgtttacgtaacgtttcggttacgtacggtaccccggaccgtacgaacggtacccgtaccgggtaccgtttacgtttacgtttttaggacggtacggaaacggttaaacggtaaaccttaaccgttaccgttacgaaccggtttacacggggttcccggggacccgtcggtaccgttaacgtttcccggtacggttacctaaccggttccgttacccttccccggttacgggtacccctttaacccggaaacggaccccggggttacccctacggtttcccccgggttaccccttccccccggtagggtcccccggtacccgtccggtcccgtaacccggg

SEQ ID NO: 153352 - DNA, 644 bp, Homo sapiens
  misc_feature: GYAE6OF01BY3LL.23.27.C05.1.454.CMB.1.raw
  modified_base (636)..(636): a, c, t, g, unknown or other
  misc_feature (636)..(636): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcatctccagatgggccctgtcccaggcgcaagtgcaggagtcgggcccaggactggtgaggccttcggaaaccctgtctctttcctgctactgtctctactgtcctccgtcaccgctccctgcgtggggcgtgggtcccgaccgaacccccgaggggtaacggtcttggagtggattggagtatatcgtcggtcccgggtagggctacttactaccgtacccgtcctaacgaaacggccggtcccgccgtagtaccggacggggacacggaccaaaggaaggtacttccgtcgtctaggtacgtttgacttcgtgtacgacccgcgcgacgaccgccggtcccgttatttcgtttttggcgtacggtacgtaacgtaaactaccgtacgttcgcttcgtcgtcgggccgcggtctacgtccgtgtctacgtcgtcgtcctccggtctcccgacgaccgggtccctacggtcccggttccccttccccggcggtcccgtccctgccctccgnggtacccg

SEQ ID NO: 153353 - DNA, 675 bp, Homo sapiens
  misc_feature: GYAE6OF01D15KM.23.27.C05.1.454.CMB.1.raw
  modified_base (285)..(285): a, c, t, g, unknown or other
  misc_feature (285)..(285): n is a, c, g, or t
tcagacgcgagtatcacgaccggtgctcgatttagacgcgatcgaagggtttggggatgctctctgagagtcatggacctcctgtgcaagaacatgaagcactgtggttttgcctcctgctggtggcagcctcccagatgggccctgtcccaggcgcaagtgcaggagtcggcccaggactggtgacggtccttacggaacctgtctctttcctgcactgtctctactgtcctccgcaccgactcctgcgtgggctcggtccgacctaacccggagggtacggtntaggagtggtgtggagtatatccgtcggtccgggtacgggactacttactaccgtaaccccgttaccaacgaaacggccggcctaccgtacgtacggacgggaccaacggaccgaaagtaacggtaagttcctacgtcgttaggtagtttaacgtctttacgtggtacgaacccggccgaacgtaccgaaccggtacggttaccgttcttttaggttttcgacgaccgggtaaacggaactaaccgtttactacgttacgtacttcggtacgtccggggccgcgtctacgtcgtacgtcagttccgtacgtccgttcggtacccttaccgaccgtacggtccttaccggtccgtaccccttcccgagcccccgcgttcgccgttacccgg

SEQ ID NO: 153354 - DNA, 703 bp, Homo sapiens
  misc_feature: GYAE6OF01BQIU3.23.27.C05.1.454.CMB.1.raw
  modified_base (679)..(679): a, c, t, g, unknown or other
  misc_feature (679)..(679): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgacggccttcggaaccctgtctctttcctgcactgtctctactgtcctccgtcaccgactcctgcgtcggggcgtcgggtccggaccgaaccccgagggtaacggtcttggaggtggagttggagtagtcgtccgttcggtaccgggtagggctacgttacttaccaaccccgtcctaacgaaaacggccgggtacccaccgtacgtcggaacgggaaccgacggaccgtaaaggaacggtaacttcgtacgtacgtgtagtttacgtacttcgtacggtcgacccggtcgacacggtaaccgtccgggttccttatttacgttttcggacgtaacgggtaacggtaaacgtaaaccttaccgttaacgttcgtaacttccggtccggtcggggtcccgcgggtactaccgttccggtcggtacctcgttcgtccgtccgtaccggtccttccgaacccggacggcccctacggttccccgtcccttcccccgnggtcccctccctcgcccgtacggg

SEQ ID NO: 153355 - DNA, 221 bp, Homo sapiens
  misc_feature: GYAE6OF01EL2G2.23.27.C05.1.454.CMB.1.raw
  modified_base (218)..(221): a, c, t, g, unknown or other
  misc_feature (218)..(221): n is a, c, g, or t
tcagacgcgagtatcacgaccggtgctcgatttagacgcgatcgaagggtttgggggaagaggaagactgacggtcctcccaggagttcaggtgctgggcaccttgggcacgggggaggtgtgtcacaagatttgggctctgggcacagcggccctgggctgcctggtcaaggactacttccatactcgcgtctgagcgggctggcaaggcgcatagnnnn

SEQ ID NO: 153356 - DNA, 737 bp, Homo sapiens
  misc_feature: GYAE6OF01C9HZ6.23.27.C05.1.454.CMB.1.raw
  modified_base (123)..(123): a, c, t, g, unknown or other
  misc_feature (123)..(123): n is a, c, g, or t
  modified_base (135)..(135): a, c, t, g, unknown or other
  misc_feature (135)..(135): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggnggcagctccagntcgggccctgtcccaggcgcaagtgcgaggagtccggcccaggactggtgacggtccttacggaacccttgtctcttcctgcactgtctctactgtctccgtcaccgtctcccgtgcgtgggcgtcgggtcccgaccgaacccggagggtaacggttcttggaaggtggtattcggagtattacgtcgtacggtccgggtaggcctacgttactaccaacccgtacctaacgaaaaggtccgggacccacgttacacggaacggaccgaaccggaacgaaaggaaggtaacttccgtacgtcgttagtaacggtttctaacgtttcgtacggtaccgaccggcccgacgaaccggtaacgtacccgggtaccgtttacgttagtttttcggacggtaacggtaacggtaaacgtaaaaccttaaccgtttaacgttaccggttaacttccgttaccgggtccggggtacccgtaccggtaccgtaacgttccgtacgttactaccgttacggtccctccgtacgtacccgttacccgaccgtaacggtccacggttcccgttcccgtaccccgtcgcccgtacctcgacctccgtcgacccg

SEQ ID NO: 153357 - DNA, 838 bp, Homo sapiens
  misc_feature: GYAE6OF01BVBQR.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaacctgtctcttcctgcactgtctctactgtcctccgtcaccgatccctgcgtgggctcggggtccgccaaccccgagggaggtcttggagtggattggagatagtctggtcccggtaggggtcctaactttacttaaccgaaccccgttccctacgtaaaaacggaccggggcccgtcccctaagtccgaacgggggaccaaccgggacccgaaaaggaaacgggtaaactttcctcggtccgttagggttaacgtttttcggaaccttttcgttcggttaccggaaccccggtcccggaccgaaccggaaccgtacccgggttacccgtttaccgtttaacgttttttcggtacggtaaccgggtaacgggtaaacggtaaaaaccctttaaccgtttaaccgtttacggtaacctttccggttcccgggttaccggggggtcccccggtacggggtccctaacgtttcccggttacggtaccgtaacccgtttccgttcccgttccccgttccgggttcccgtttacccccgtaaacccgggtaaacccggggtcccccgttaccgttcccccgggtttcccccgtttcccccccgtacggggtcccccggtccccgttccggtccccgtaccccggg

SEQ ID NO: 153358 - DNA, 936 bp, Homo sapiens
  misc_feature: GYAE6OF01DRXC8.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgttggttttgcctcctgctggtggcagcctacccgagagtcggccctcgtcccgaggcgacaagtcgacgagggacggtccgggacccagggtacgtgggtcgacggtcccgttaccggaacccgttgtcctttcctttccgtgacctacgttcgtcctctacgttcgtcctccgtaccaccgtctccgtgtcggtcgggtccgtcgggtacccgacccgaaccccggtaggggtaacggttcgttaggacggttaggacgttaggaagtacgttacgttccggttacggtacccggggtaggtcccttaaacgtttaacccgttaacccgaaccccggttaccctaaacggaaaaccgggccccggtacccgtaaccttacggtaacccggaacggggaaccgaacccggaaccgtaaaggtaacgttaaccgttcgtaccggtacgttacggttaacgttttaccgaccgtttcggtacggtacccggaccccgtaccgtacggtaaccgtaacccgggtaccggtttaccgtttacgttttttacgggtttacggaaccgggtacggttaaaacgggtaaacccttaaaccgttttaccgtttaacccgtaacggttaccgtttaccgggtaccggggttacccggggccccggaccgttaccgttaccggtttacccgttccggtaacccttacggtttcccgtaccccgtttccggtccgtaacccccggttaacccggaacggtccccggtaaccttcccgggtttaccccgttcccccccgttaccggcggtaccccccgttccgtccggttcccgaacccgggg

SEQ ID NO: 153359 - DNA, 515 bp, Homo sapiens
  misc_feature: GYAE6OF01ES5QB.23.27.C05.1.454.CMB.1.raw
  modified_base (492)..(515): a, c, t, g, unknown or other
  misc_feature (492)..(515): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtcttattttgtgcgaggagaaactactacttcgatctcgtggggccgcggcatccgtgtcactgtctccgtcggccttccgaacctaaacgggcccacgtccggtcccgttccccccgtgggcccgtccccttcgccttaccgacggacggcctacccgtacggtcggggggaccacggaacggcccgggccccgtggggtcctcgtcccgttaggtaccgaaaggtaccttaaccgttaccaacttaccgtccggtccgttcgtcggaggccgggtcgtggacgaaacggcgacgatgnnnnnnnnnnnnnnnnnnnnnnnn

SEQ ID NO: 153360 - DNA, 876 bp, Homo sapiens
  misc_feature: GYAE6OF01CE6QM.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagcctcccagagtcgggccctcgtcccgaggcgcaagtgcgagggacggtccgggcccgaggacgtgggtggacggtccgttaccggaaaccctgttccttcctttcctgcctacttcgtccttccttacgtcgtcctccgtaccaccgactccgtggcggtcgggcgtcgggtcccggacccgaaccccggagggtacggttcgtaggtaggtaggtagtggagtacttacgtccggtcgggtaccgggtacggggtactaaccgtttaaccgttaacccgtaacccccgttacccgtaaccggaaaaccggacccgggccccgtacccgtacggtaccgaacgggggaccgaaccggaaccgtaaaggaaacggtacttccgtacgtacgttacggttacgtttaccgtacgtttcggtacgtacccggacccgtaccgacgaacgtacccggtacccggttccgtttacgttttaggttttcggcgtaacggtaacggtaacgtaaaccgtttaccgttacgttacgtaccgttcggtccgggtacggggtccccgtacgggtacctccgtttcccggttacggtccgtaccgtttccgttacccgttcccgggtaccgttaccccgtaccccggtaacccggtacccgggttacccccttaccgggttcccccgggtttaccccccgtttccccccgggtaccgggttccccccgtcccggttcccgtaccccggtaacccggg

SEQ ID NO: 153361 - DNA, 754 bp, Homo sapiens
  misc_feature: GYAE6OF01C1G08.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtcctccaccctccctgtctgcatcgtggttcggggaccgtagtccaccatccacgttcgccgggcgtagtcgtgacttagttttcggtttctttagtcgtagtactacaaaactaaaaaccgtcggtttcgacccctaccgtcctcgtcgctgtcactgacgagtaacgtaaggtcgggtcccagtcgagtattcgagtggcgtaggtagggtacggggttcggtaacctttttaaccacgttccttacgaaccgtaacgtcccggtaccggtcccgtcggcccgggtccctaagggtaaacgtttacggtttttacgggacctttttacgttcgttacgtcgaacgtactaagttaactttacaacgttaaccgtccccgttaacacgttaacgtttcgggacccggtagggtaaacccgtaagtttcgaacccttacgtaacgttaaccgtaacgttggacggttctacgtacccaaccgttactgttccttaccgtttaccctactttccccgttacccgtcccttaaccgttaccgttacgtaaaccgtttaccgtcccggttaggttcccgtgggtacccgggg

SEQ ID NO: 153362 - DNA, 840 bp, Homo sapiens
  misc_feature: GYAE6OF01AP00W.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagcctcccagagtcgggccctcgtcccgaggcgcaagtgcgaggacgtccgggcccaggacgtggtggacggtcccgttaccggaaaccccttgttccttccgttttcctgacctacttcgttcctccgttacgttcgtccgttacccgtccgaacccgtacttcccgtggtccggttggggccgttccgggtcccgacccgaaccccggaggggtaacggttcgttaggtacggtaggtagttaggacgtagttacgttccggttaccgggtacccgggtagggtccttaacgtttacctaacccgtaaccccgtaccgtaaacgaaacggccgggtcccaccgtacgtacggacggaccgacggacaaaggtacgtacttccgtacgtcgtacgttacgtttacgtacgttccggtcggtaccgcccggccgtacgacgtacccgtacggtccgtttacgttacgttttcggaccgtaacggtaacgtaaacgtaaccgttacgtttaccgtacgtaccggttccgttccgggtaccgggtcccggtacggttaccgtacgtttcccgtacggttaccctcgttccgttcccgttcccggtaccgttacccgtacccggtacccggtaccgggtccccgtaccggttcccccggtttcccccgttcccgggtcccggtaccccgttccgtcccggtcccgtaacccggg

SEQ ID NO: 153363 - DNA, 884 bp, Homo sapiens
  misc_feature: GYAE6OF01EK1KT.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggccaggactggtgaggccttcggaacctgtctcttcctgcactgtctctactgtcctccgtcaccgtactccccgtgcgtggggcgttcggggtcccggaccaacccccggaggggtaacgggtcttggaggtggagttggagtatacgtcgttcgggttcccggggtaggggtacctacgtttaacgttacccgaaccccgttcccgtaacgaaaacggaccgggcccgtacccttacgtaccggaacgggggaccaaccgggaccaaacgggtaaacggtaactttccgtacggtaccgtggttaaggttttcgtaaccgtttcgtcggttaccggaccccggtcccggacgaacggtaaccggtaacccgggtcccgtttacgtttaaggttttttcggacgggtaccgggtaaagggtaaaccgttaaaccgtttacccgttaaccgtttaccggtacgttacccgttccggggtaccgggggtaccccgtaacgggtaccctaaccgtttcccggtacggggttacccttaaccggtttccggttacccccgtttcccgggtacccggttaccccgttaacccccgtaacccgggttaaacccggggtcccccgttaaacggtttccccccggggttaccccgttttccccccccgggtacgggtccccccggttacccccgttcggggtccccgttaaccccgggg

SEQ ID NO: 153364 - DNA, 695 bp, Homo sapiens
  misc_feature: GYAE6OF01DUZAR.23.27.C05.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagcctccagatcgggccctgtcccaggcgcaagtgcaggcgtccggcccaggactggtgaggtccttacggaaccctgtctcttccngcactntctctactcgtcctccgtcaccgcttccgngcgtgggcctcgggtccgaccaacccggaggacggtctgacgtgagttggatatatcgtcggtccggtaggctacttactaccaccgtcctacgaaacgcggcccaccgtancggacggacaccggacaagagtacttcgngtactgtacgttntacttcgtacgtcgaccgcgacgagaccgcgtccgttnttacgtttaggcgtacggagaacttaacctacgttacgttcgtacttcgtaaccgggttcgggaccgtcggaccgttacgttcccggtacggttacctacgttccgttcccgttcccggttacccgttccccgttaacccgaaacccgggttaacccgggaccccgtttacggttccccggttaccccggtttccccccggacgggttaccccggttcccggtacccgttacccgtaccggtaacggaccccgg

SEQ ID NO: 153365 - DNA, 539 bp, Homo sapiens
  misc_feature: GYAE6OF01E0JZW.23.27.C05.1.454.CMB.1.raw
  modified_base (268)..(268): a, c, t, g, unknown or other
  misc_feature (268)..(268): n is a, c, g, or t
  modified_base (437)..(437): a, c, t, g, unknown or other
  misc_feature (437)..(437): n is a, c, g, or t
  modified_base (486)..(486): a, c, t, g, unknown or other
  misc_feature (486)..(486): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgactattttcggttctttagtctggtatcaaacaaaaaccnggtttcgccctaccgtcctcgtcgctgtcactgacgtagttaacaaaggtcggggtcccatcgagattcagtggcaggtggaggtggtacctttacgactctcacaatcgccgcctgcggctgaagtgtttgggacttacttctgtcagctagtattacatagtcccanactattcggcagggacaaagttcgactcatacgactgtggctgcacctntcttcgtcttcacgtcttcccgctactcgtataactactcgtctgtggacggg

SEQ ID NO: 153366 - DNA, 599 bp, Homo sapiens
  misc_feature: GYAE6OF01BXEZQ.23.27.C05.1.454.CMB.1.raw
  modified_base (214)..(214): a, c, t, g, unknown or other
  misc_feature (214)..(214): n is a, c, g, or t
  modified_base (501)..(501): a, c, t, g, unknown or other
  misc_feature (501)..(501): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcagggagtcgggccaggactggtgaggtccttacggaaacctgtctcttccngctactgtctctactgtcctccgtcaccgctccgtgcgtgggcgtcgggtccgaccaacccgagggtacggtctgagtggattggatatacgtcgtcggtccgggtagggctacgttactaaccacccgtcctacgaaacggccggccgcctagcgagggacacggacaaggaagtactcgtcgcgtagtacgtttgacttcgtgtcgacccgcgacgagaccgacggtccttcgtttagtttgcgaggtagaacgtaacttcttactgacttcgtcggtcggccgngtactacgttcgtgtactcgtcgtcctccgtcgtcctaccgaaccgacggccctacgttcccggtcccttcccggcggtccctcccgtgccgtaccgg

SEQ ID NO: 153367 - DNA, 775 bp, Homo sapiens
  misc_feature: GYAE6OF01ETVO5.23.27.C05.1.454.CMB.1.raw
  modified_base (764)..(764): a, c, t, g, unknown or other
  misc_feature (764)..(764): n is a, c, g, or t
tcagacgcgagtatcacgaccggtgctcgatttagacgcgatcgaagggtttggggatgctctctgagagtcatggacctcctgtgcaagaacatgaagcacctgttggtttttcgcctcctgcgtgggtggcagcctacccgagagtcggccctcgtccgaggcgacaagtgcgagggacggtccgggccgaggacgtgggtggtacggtccgttaccggtaaacccgttcgttccttcctttccgtgtacctacgttcgttccttccttaccgttccgttccgttcccgtaccgacccgtaccttcccgtcggtccgggttcgggtccggttccggggtccccggacccggaaccccggtaggggtacggttcgtacggtaggtacggtagtaggagtacgtcgttccggtacgggtccgggtaggtaccttaacgttacctaacccgtaccccgtaccgaacgaaacggccggccgtaccgtacgaccggacggaccgacgaacgaaaggaacgtacgtcgtacgtacgtaggttacgttcgtacgttcgtacgtcccggacccgcgacgacggtaccggtcccggtttacgtttacgtttgtttcggacgggtacgtaacggtaaactaccgttacgttacgttaccgtagtccggttaccgggccgggtccgacgtccgtacgttcgtcgtactcgtccggttcctccggtcgtccgtaccgacgtccggtccttccggtccgtcccgtccgcgtaccnccgtgtccgag

SEQ ID NO: 153368 - DNA, 655 bp, Homo sapiens
  misc_feature: GYAE6OF01B1ZYY.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtcttctttcctgcactgtctctattgtctccgtcaccgtactcctgcgtggggctcggggtccggaccaaccccgaggggaacggtcttggagtggagttggagtatatcgtcggtccgggtaggggctacgttactaccgaaccccgtccctaacgaaaacggccggaccgccctagtcggacggggaccaccgggaccgaaaggaaggtaacttccgtcgcttaggtagtttcgtactttcgtcggttcgacccgccgacgaacgaccgtaccggtccgttcgtttagtttttggacggtacggtaaggaacgtaaacttacttaccgttcgtacttcgtcggtcggggccgcggtctacgttccgtaggtcctacgttcgtcctccgtccggtcctaccgacgtacggccctcgtccgtcccttcccgcgccctccgtgccgtaccgg

SEQ ID NO: 153369 - DNA, 929 bp, Homo sapiens
  misc_feature: GYAE6OF01AMPW0.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatcgacccagtcctcccaccctccctgtctgctatcgtggttcggggaccgacgtccaccgactctacgttcggccggggcgtacggttcgtagtacgttacgtttttcggtttacttttaggtacgttggttaactaaccgaaaaaccgtaaaaaaccgtacggggttttacccgtaccccccgttacccgttccgttaccggttccgtccgttacggtaccaccgttacggtaaaccgtaggtttaaccgggaaaacgggttccggggtacccctaagttacggaaggttacgtttaccgaggtcgggtacgtaagggtacggggtacgggttccgggttaaccctttttaccgaaccgttcctaaccgtaacgtaaccgttccggaccccggcccgttcggcccggtaccgttaagggttaaacgtttacggttttacgggtaaccttttaccgttcgttacgtacgtaacggtaccttaaggttaacctttaacgtacgtaacccggtttccccgaacgtttaacgttacgggtttaccggaacccggtaagggtaaaccccgttaaggttcccgaacccttaacgtaaccggttaacccggtaaacggtttcgggtaaccggaccgtttcgaacccgttaaccccgtacgttccgtttacccgttacccgtttacccgtacttttccccccggtaccctacccgttacgtttaccgttaaccgtaaacgttcccggttacgtccggtttaaccgtcgggtacccgggg

SEQ ID NO: 153370 - DNA, 783 bp, Homo sapiens
  misc_feature: GYAE6OF01B9XO4.23.27.C05.1.454.CMB.1.raw
  modified_base (709)..(709): a, c, t, g, unknown or other
  misc_feature (709)..(709): n is a, c, g, or t
tcagacgcgagtatcacgaccggtgctcgatttagacgcgatcgaagggtttgggggctctctgagagtcatggacctcctgtgcaagaacatgaagcacctggtggttttgcctcctgctggtggcagctcccgagagtcgggccctgtcccaggcgcaagtgcaggacgtcggcccaggactggtgacggtccttacggaaccctgtctctttcctgcactgtctctactgtctccgtcaccgtctcctgtcgtcggggcgtcggggtcccgacccgaacccggagggtaacggtcttaggaggtcggtagttgggaagtacttacgtccgtcggtaccccgggtagggtctaactttaacgtaccgtaaaccccgtcctaacgaaaaccggcccgggtacccgaccttaacggccggtaaccggggaacaaccggggaaccaaaaggggtaaacggtaactttccgaccggtacgtacggttacgttttacggaaccgtttcgtacggttacgacccgtccggacaacggtaccggtaccgtccgtttactttacggttttacggcggaggtaacggtaaacgttaaacttaacgttaccgttcggaactcggtttaccggacgggttccgagtcctacgtccgtaggtcctagttccgtacctccggtacccgttcgttacccgaaaccggtacccgggtacccncgggtttcccccggtacccgtttccccccgtcgggtccccgtacccttcggtaacccctagggcggtaacccgg

SEQ ID NO: 153371 - DNA, 992 bp, Homo sapiens
  misc_feature: GYAE6OF01DFIMX.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggcctcccgaaggaacgaagggtgtacgttcagatcgacccagtcctcccaccctccctgtctgcatcgtggttcggggaccgagtcaccatcacgttcggccgggcgtagttcggtgtacttacgttttcggtttctttacggttctaggtactaccaaaacgtaaaaaacccggtcgggtttaccgcccccgttaaccgttcccgttccggtccgtcttcgtacctaacgtcggtaaccgtaacggttaaccgtaaagggttccggggtaccctaagtccggaagtacttccggaggtcggacgtagggtggggtaacggggtttacgggtaaccctttttaaccgtaccgtttaccgtacctaaacccgtaaccggttccccgggtacccgggtcccgttaccggggtcccgggtacccgtttaaggggtaaaacggttttaacggtttttttacggggttaacccttttttacccgtttacgtttacgggtaccgtaacgggttaaccgttaaacggtttaaactttaaccgtaaacgttttaaccccggttaaccccccggtttaaaccttaacccgtttaacggggttttcccggggaaccccgggttaacggggggttaaaacccttaaaacggggttttcccgaacccgtttaacgtaacgtttaaacccgggtaacgtttcgggtacgtacccgttaccggtaccctaacccgttacgtttacccgttccggttttacccttacccgttaaacccgtttcccccgtttaccccccggtacctttaaacgttcccggttaaacgttaacctttaacccggttacccgggtacccgtttcgggtacggtacccggggg

SEQ ID NO: 153372 - DNA, 838 bp, Homo sapiens
  misc_feature: GYAE6OF01A26NZ.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggacgtggtgaggccttcggaaccctgtctctttcctgcactcgtctctactgtcctccgtcaccgtactcccctggtccgtcggggtcgtcggggtcccgtaccgaacccccggaggggaacgggttcttggaggtggtagttcggagtacgtagttcgttcgggtacccgggtaggggtctaaccgtttaacgttaacccgtaacccccgtacccttaacggaaaaacggtcccggggaccctaccccgttacgtacggaacgggggaacctaacccgggacctaaaagggaaacggtaaacgtttccgtacggtacgttacggtaacgtttcggtaccgtttcgtacggttaccgaccccggcccggtacgaacggtacccgtacgggtcccgtttagtttacgtttttcggacggtaccgggtaaggtaaacgttaaaccgttaaccgttacgtttaccgtacgtccggttaaccgcgggggtcccgtaccggtacgtaaccgttccgttcgggtacctccggttaccgttcccgttaccccgtccggttacccttaccccggtacccggaacccgggcccccttaacggttcccccgggttacccccgttttcccccggcgggtaccccgtccccggtcgtcccggtaacccccgg

SEQ ID NO: 153373 - DNA, 740 bp, Homo sapiens
  misc_feature: GYAE6OF01CLY9Y.23.27.C05.1.454.CMB.1.raw
  modified_base (468)..(468): a, c, t, g, unknown or other
  misc_feature (468)..(468): n is a, c, g, or t
  modified_base (730)..(730): a, c, t, g, unknown or other
  misc_feature (730)..(730): n is a, c, g, or t
tcagacgcgagtatcacgaccggtgctcgatttagacgcgatcgaaggggtttgggggagtcagaccctgtcaggacacagcatggacatggacgggtccccgctcagctccgtggggctcctgctgctcgtggcctacccgaaggaacggaagggtgtacgttcagatcgacccagtccctccctaccccttccttgtctgctacgttcggttgggtaccggggaccgtacgtaccaacctactccgtacggttcgggcccgggtacgtacggttcggtacgtacgtttacgttttccggtttactttagttcgtaggtaactaaccgaaaaccgtaaaaccggttcggtttaccctccccgttaccgttccgtcgtcctcgttcgtccacgtcgaacgttaagtaaccgtaacggtccggtccagtcgatcgtgaggtgtgtaggtgggtaggtccgttacttacncttacacacgtcgccggccgtcgtcgcgtacgtaggttagttacgtttcggtaactttcgtgtacgtactacgtacttagtaacttacgtacgttaccgtcctatacgttcgttacgggacgtaacggtaactagttacgacctacgtaacttacggacgttggacgtctacgtcctaacgtcttcttaccgttcttaccgtcccttcccgttaacccagttaccttaccggttaagttaccccgtacgtccggtcgttggnggggtcccgg

SEQ ID NO: 153374 - DNA, 708 bp, Homo sapiens
  misc_feature: GYAE6OF01ECVRN.23.27.C05.1.454.CMB.1.raw
  modified_base (279)..(279): a, c, t, g, unknown or other
  misc_feature (279)..(279): n is a, c, g, or t
  modified_base (369)..(369): a, c, t, g, unknown or other
  misc_feature (369)..(369): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttggccgggcgagtcgtgactatttttcggttctttagtctggtatacaaacaaaaacctgggtttcncccctaccgtcctcgtcgctgtcactgacgtagtacaaaggtcggggtacccatcgagtattcgagtgcagtggaggtcggtactttacnctctacactaacgtcgcccggtctggcccggtaccgtagtaaggttacgtttttcggggtaaccttttacgtttccgttaggtctaacggtctaaacgtttaactttaacgtaacttaaccggttacccccgttaataaccgttagttttaccggggacccggtaaacgggggtaacctaaaacggtttcgaacccttaacgtaaacgttaaccgtaacgttggttacggacttcggacctaaccctattccgttcttccgtttacctacttccccttaccccgtcctaactttccgtaacgtaacttaccgttaccggtccgttcgtgggtaaccggg

SEQ ID NO: 153375 - DNA, 707 bp, Homo sapiens
  misc_feature: GYAE6OF01AGOOD.23.27.C05.1.454.CMB.1.raw
  modified_base (289)..(289): a, c, t, g, unknown or other
  misc_feature (289)..(289): n is a, c, g, or t
  modified_base (307)..(307): a, c, t, g, unknown or other
  misc_feature (307)..(307): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgagggtgacgttcagatgacccagtcctccaccctccctgtctgcatcgtggttggggaccgagtccaccatcctacgttggccggggcgagtccgtgacttattttcggttctttagtctggtactacaaacaaaaccgtgggttccncccctaccgtcctcgtcnctgcactgacgtagttacgaaggtcgggcccagtcgagtattcagtggctaggtagggacgggttcggtacctttacactctcacacgtccggaccggccgtggccggtctaggtaacgtttagttttcgggtacctttacgttccgtggtcctagtaccgtagttaacttactaacgttaccgttacccgtaactacgttaacgtttccggaccggtaacggggtaaccttaacggttaccgaacccttacaacggttaccgaacgttggtacggtctacggccaacccgtagtccgtttacgtctttacccgtaccttcccgttaccccgccttaacgttaccgttaaccgttaaacgtttcccgttacccggtcggtttccggtagggtacccgggg

SEQ ID NO: 153376 - DNA, 762 bp, Homo sapiens
  misc_feature: GYAE6OF01AJA9S.23.27.C05.1.454.CMB.1.raw
  modified_base (214)..(214): a, c, t, g, unknown or other
  misc_feature (214)..(214): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtccgggcccaggactggtgaggccttcggaaccctgtctcttccngcatgtctctactgtctccgtcaccgactccctgcgtggggtccgtcgggtcccggccgaaccccgaggggaacgggttcttggacggtagggtattgggagtatacgttcgtcggtcccgggtagggactacgtttactaacccgaaccccgtcctaacgaaaacggccgggccctcccgtacgtacggacggggacctaccgggaaccgaaaggtaaacggtaacttcgtacgtaccgttaggttacggtttagtacctttcgttacggtcggacccggacccgacgacgtaccgtaccgggtcccgtttacgttttagtttttcggcgggtacgggtaaggtaaaccgtaaacgtttaccttaacggttcgtaacgttcggttccggtccgggggcccgtcgggtacctacggttcccgttcggtacctacggttcgtcccttcccggtccggtacccgttcccgaaccgtacccgggtccccttacggttcccggttccccttcccccggtcggtaccccggtccccgtcggtcctacccgggg

SEQ ID NO: 153377 - DNA, 779 bp, Homo sapiens
  misc_feature: GYAE6OF01B6SEM.23.27.C05.1.454.CMB.1.raw
  modified_base (224)..(224): a, c, t, g, unknown or other
  misc_feature (224)..(224): n is a, c, g, or t
tcagacgcgagtatcacgaccggtgctcgatttagacgcgatcgaagggtttggggatgctctctgagagtcatggacctcctgtgcaagaacatgaagcactgtggtttgcctcctgctggtggcagctcccagatcgggccctgtccgaggcgcgaagtgcgagggacggtcgggcccgaggacgtgggtgacggtccgttacgaaccgtgtcttctttccngcacttgtctctactcgtcctccgtcaccgactccgtggcggtcgggtcgtcgggtcccggaccgaacccggagggtacggttcgtaggtacggtcggtagttggaagtacgttacgtcgttacgggtaccgggtacggtactacgttaactaccgaccccgttaccgtaacgaaacggaccggacccgtaccgtacgtacggaacgggtaccgaaccggaacgaagtaacggtactacgtcgtacgttagtacgtttacgtaccgttactgggtaccgacccgtacgacgtaccgaccggtcccggttacctttagttacgttttcgggacgaccggaagggttaacctaaccgttacgtttaacgttcgtactacggttccgggaacgggtcccgtagtaccgtacttccgtacggtactaccggtttccgttaccgtccggttacccgtacgtttaacccgggaacccggaccggttccccggtacgtttacccccgggtttcccccgtccccggttacggcccccgttcgtccggtaacccggttcccggg

SEQ ID NO: 153378 - DNA, 683 bp, Homo sapiens
  misc_feature: GYAE6OF01AW2RW.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttacggaaaccctgtcctctttcctgctactgtctctactgtcctccgtccaccgtactccgtgcgtggggcctcggggtcccggccaaccccgaggggtaacggtcttggagtggagttggagatagtcgtggtcccgggtaggcctacttacttaccgaacccgtccctaacaaacggccggccgaccctagtcgacggggacacggaccgaaaggaacggtactcgtcgacgttgtaggtttcgacgtttcgtggtcgaacccggtccgactaacggaccgtacggtcccgttacttaacgtttttcggacgtacggtaagggtaacgtaaaaccttacgttaccttacgacgttcgtcggtcggggtccgccgggtactacgttccgtagtccgtacttcgtcctcccgtccggtccgttacccgaaccgaacggtcccgaccgttccggttccccttcccggtcggccctcccgtcgtcctaccgg

SEQ ID NO: 153379 - DNA, 850 bp, Homo sapiens
  misc_feature: GYAE6OF01AXZ64.23.27.C05.1.454.CMB.1.raw
  modified_base (684)..(684): a, c, t, g, unknown or other
  misc_feature (684)..(684): n is a, c, g, or t
tcagacgcgagtatcacgaccggtgctcgatttagacgcgatcgaagggtttggggagtgctctctgagagtcatggacctcctgtgcaagaacatgaagcacctgttggttttgcctcctgctggtggcagctcccagatgggccctgtcccaggcgcaagtgcagggacgtcgggcccaggacgtggtcgacggtccttacgggaaacccctgtcctctttcctgctactgtctctactcgtcctccgtcaccgtactcccgtgcgtcgggcgtcgggtccggtaccaaccccggaggggaacgggttccttggacggtgggtacgttcgggatacgttagtccgttcgggtaccccggggtaggggaccttaacgtttaacgttaccccgtaaaccccgtcccgtaaacggtaaaaccggaccggggacccgtaccccgttagtacccggaacgggggaacctaccggggaaccgtaaaaggtaaccggtacgttaaccgtccgcgtaggttacggtttacggtacctttcggttcggtaccgggaacccggtcccgtacgaacggtacccgtacccgggtcccgtttacgtttaaggtttttcggtacgaaccgggtaaggtaaccgtaaaacgttccgttaacgttcggtacttcccggttcggccgggggttacccgnggttaccaccggtttccttgggtacctacccggttcgttaccgtccccgttaccggttcccgttaaccccgaacccggttacccgggggaacccctaccggtttccggttacccccccttttacccggccgggtaccccgtacccgtcggttcccctaaacccggg

SEQ ID NO: 153380 - DNA, 829 bp, Homo sapiens
  misc_feature: GYAE6OF01DUCM7.23.27.C05.1.454.CMB.1.raw
tcagacgcgagtatcacgaccggtgctcgatttagacgcgatcgaagggtttggggatgctctctgagagtcatggacctcctgtgacaagaacatgaagcacctgtggttttcgcctcctgcctggtggccagcctacccagatcgggcccttggtcccaggcgcgaacgtgcaggacgtcgggccaggactggtcgacggccttacggaacctgtctcgttcctgcacttgtctctactgtcctccgtcaccgactcccgtgcgtgggcgtgggtcccgaccaaccccgagggtaacggtcttaggaggtggagttggagacttacgtcgtcggtccgggtagggacctacgtttaactaccgtaaccccgttacctaacgaaaacggaccgggcccacccttagacggaacgggaccacggaccgaaaggaggtaacttcgtacgcgttagacgtttagtacgttacgtggtacgacccgtccgaacgtacgaaccggtacggtccgttacgtttagtttttcggacggtacggtaacggtaacgtaaaccgttacttaaccgttccgtaagttccggttaccggtccgggggtacccgtaccgggttaccgtaacccggtttcccggttacgggttacccttaaccggtttccccggtttaccccgtccccgggtttacccggtacccccgttttaacccccggaaaacccggggttaacccgggtccccccgttaaacgggttttcccccggttaccccccgtttaccccccggtaaccgggggtccccctacccccggttcggccccggttaaacccccgggg

SEQ ID NO: 153381 - DNA, 697 bp, Homo sapiens
  misc_feature: GYAE6OF01DB1AZ.23.27.C05.1.454.CMB.1.raw
  modified_base (256)..(256): a, c, t, g, unknown or other
  misc_feature (256)..(256): n is a, c, g, or t
  modified_base (352)..(352): a, c, t, g, unknown or other
  misc_feature (352)..(352): n is a, c, g, or t
  modified_base (677)..(677): a, c, t, g, unknown or other
  misc_feature (677)..(677): n is a, c, g, or t
tcagacgcgagtatcacgaccggtgctcgatttagacgcgatcgaagggtttgggggagtcagaccctgtcaggacacagcatggacatggacgggtccccgctcagctccgtggggctcctgctgctcgtggctcccgaaggaacgaagggtgacgtcagatcgacccagtcctcccaccctcctgtctgctatcgtggtcgggaccagtcacatcgtacgtcggccggcgtagtcgtgtacttagtttcggttntttagtcgtgtactacaaacgaaacgtcggttcgccctacgtctcgtcgtctgtctacgtgacgtaaggtacgaacggtccgggtccagtcgagtnttcgaggtgacgtaggtgggtaggttaccggtacctttcacttcaactacgacgtccgtccggccgtggccggtctaggtaaggttacggtttcggtaccttttacgtgtacgttaccgtaggtcttaagttattaccaagttcccggtaacctagtacgttaggttaccgggaactaacgggggtaaccctaacgggttacaccctttaagaaccgtttaccggacgtaggttccggactccgaccgtactcttcgttacgttcccttagttcccttcccttacccgccgttaatccgttaactaccggtactttaccccgggnttcccggtaggtacccgggg

SEQ ID NO: 153382 - DNA, 811 bp, Homo sapiens
  misc_feature: GYAE6OF01A3UV3.23.27.C05.1.454.CMB.1.raw
  modified_base (130)..(130): a, c, t, g, unknown or other
  misc_feature (130)..(130): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcanctcccagatgggccctgtcccaggcgcaagtgcaggagtcgggcccaggactggtgaggccttcggaaaccctgtctctttcctgcactgtctctactgtctccgtcaccgatcctgcgtgggctgggtccgccaaccccgagggaaggtctgagtggattggagatagtcgtcggtcccgggtaggggctactttataaccaaccccggtccctacgaaaaggaccgggcccgacctagtcgacgggggaaccaccggaccgaaaggaacggtaacttcgtacgaccgtaggtacggtttcgtaacctttcgttacgttacgggacccgtccccggacgtaacggaacccgtacccggggtaccggtttctttaagtttttttcggacgggtaccggtaaacgggtaacgtaaaaccgttaccgtttaaccgtttacggtaactttaccggttaccggttaccggggggccccggtaccggggtaccgttaacccgtttccgggttccggttacccgtaccggtttccggttacccccgtttcccggttaccccggttaccccgtttaaacccccggaacccgggtacccgggtaccccgttaccgggttacccccggtttcccccgtttacccccgggtcgggttacccccgtcccccggttcgtccccgtaacccggg

SEQ ID NO: 153383 - DNA, 444 bp, Homo sapiens
  misc_feature: GYAE6OF01EMTYE.23.27.C05.1.454.CMB.1.raw
  modified_base (296)..(296): a, c, t, g, unknown or other
  misc_feature (296)..(296): n is a, c, g, or t
  modified_base (425)..(444): a, c, t, g, unknown or other
  misc_feature (425)..(444): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtcttatttttgtgcgaggagaaactactacttcgatctctggggccgcggcatcctggtcactgtctcctcggcttccaccgaaggccactcggtccttccccnggccgccctgcctccaggacgccacctcggtgggggcacgacggccggcccgtgggctcgcctcggtacaacggactacgttccatacgtcgtcgtcgtgacgcgggcgtaggcgaaggcgacagtagnnnnnnnnnnnnnnnnnnnn

SEQ ID NO: 153384 - DNA, 805 bp, Homo sapiens
  misc_feature: GYAE6OF01CHSO1.23.27.C05.1.454.CMB.1.raw
  modified_base (221)..(221): a, c, t, g, unknown or other
  misc_feature (221)..(221): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagcctcccagatcgggccctgtccaggcgcaagtgcgaggacgtcgggcccaggacgtggtggaggccgttacggaaacccttgtctctttccgngccactgtctctactcgttctccgtcaccgctcccgtgcggtcggggtcgtcggggtaccggaccgaaccccggaggggtaacgggtcgtttaggacggttaggtacgtaggtagtactacgttaccggtcgggtacccgggtaggggtccttaaccgttaacgtaacccgtaaccccgtacccgtaacgtaaaacgggccgggtacccgtaccgtaacgtcggtaaccggggaaccgtaaccggaacgtaaaacgggtaacggtaaactttcgtaccggagttacggttaggtttactacgtttcgtcgtaccgggacccgtaccggactaacggtaccgtaccggttaccgttacttttacgtttgggacggtacggaacgtaaacgtaaccttaccgtacggttacgtacgtacggttacgcggggtcccgcgggtacctacgttcggtacgttacctacgttccgtccttcccggtggttccccttaacccggaaaccgggtccggtaccctaccgggtttccccggacccgtttcccccggcggtcccgttccccaggttcccaacggtcggaccccgg

SEQ ID NO: 153385 - DNA, 876 bp, Homo sapiens
  misc_feature: GYAE6OF01CT29A.23.27.C05.1.454.CMB.1.raw
  modified_base (269)..(269): a, c, t, g, unknown or other
  misc_feature (269)..(269): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagcctcccagatcgggccctgtcccaggcgcaagtgcgaggacgtccgggcccaggacgtggtggacggtcccgttaccggaaacccgttgtcttcctttcctgcactgtcctctactcgtcctccgtccaccgacttcccgnggtcggtcggggcgtccggggtcccgaccgaacccccggagggtaacggtcgttaggacgtggagttggagtatacgtcggtccggtaccgggtcgggacctaacgtttaccgttaacccgtaaccccgtacccgttaaacgaaaaccgggtaccccgggaccccgtacccgttaacggccggaacggggaaccgaacccgggaaccgaaaacggaaacggttaactttccggtaccggtacgttggttaacggttttacggttaacctttaccggttgggtacccggaacccggtccgtaccgtaaaccggaccgttaccccgggtaccgttttaacttttacgttttttggaggtaaccgggtaacggtaaacgttaaacccgtttacgttaccgttaaccgttacgtcccgttaccggggtacggggtccccgtcggtaaccgttccgttcccggttcggtacttccgttaccgttccccgttacccggtccgttaccccgtacccggtaacccgaccgggttccccttaacgttcccccggttacccccgtttcccccggcggacccccgtccgtacccggtcctccccgggaaagtccccgg

SEQ ID NO: 153386 - DNA, 751 bp, Homo sapiens
  misc_feature: GYAE6OF01DUP6M.23.27.C05.1.454.CMB.1.raw
  modified_base (356)..(356): a, c, t, g, unknown or other
  misc_feature (356)..(356): n is a, c, g, or t
tcagacgcgagtatcacgaccggtgctcgatttagacgcgatcgaagggtttggggatgctctctgagagtcatggacctcctgtgacaagaacatgaagcacctgttggttttcgcctcctgcgtggtggcagcctaccagagtcgggccctcgacccgaggcgacaagtcgcgaaggcggtccgggcccgaggacgtggtcgacggtacccgttaccggaaaccccttgttccgttccttttccgcgtccgtacttcgttcctacgttactcgttcctcccggtaccaccgtactcccgtggcgtcggggacgtacggggtcccggaccgaaccccggtaggggtaaccggttnttaggaggtaggtagtaggaactatacgtcgtacggtacccggaggacctaacttacgtacccaaccccgtaccaacggaaacgccgggacccaccgtagaccggaagggaccaccggaacgaaaggaagtacttcgtaccgtatacgtagttcgactttcgacgtcgaccgtccgagacgaacgcggtacgttacgttagtttgcgtacgaagtaacgtaaactactacgtacgagtccgtcgggtccgggcccgacggactaacggtccgtacggtacctacttccgttcccgtacccgtccggttaccgtaaccccgaacggtaacccgggccgttaccgtacccggtttaccccctcccgggcgaccccggtccctaccgtcgtaacccgg

SEQ ID NO: 153387 - DNA, 838 bp, Homo sapiens
  misc_feature: GYAE6OF01AMIAX.23.27.C05.1.454.CMB.1.raw
  modified_base (156)..(156): a, c, t, g, unknown or other
  misc_feature (156)..(156): n is a, c, g, or t
  modified_base (655)..(655): a, c, t, g, unknown or other
  misc_feature (655)..(655): n is a, c, g, or t
tcagacgcgagtatcacgaccggtgctcgatttagacgcgatcgaagggtttggggagtgctctctgagagtcatggacctcctgtgcaagaacatgaagcacctgtggttttgcctcctgctggtggcagcctcccagatcggccctcgtacccncggcgacaagtgcaggacgttccgggcccaggacgtggtggacgccttccgggaaaccctgtccttcgtttcctgcacttcgtcttacctctcgttcctacccgtaccgtaacccgtcttccccgtggaccggtcggggtccgttaccggggtcccggtaaccccgaaacccccggtagggggtaaaccgggtttccgttaaggttacggtacgggtactacgggtaacgtagtttaccgttaccgttccggggttacccgggtaacggggtaccttacgtttaacctttaaccccgtaacccggtacccctaagtaaaccggtaccgggaccctccccgtaagtccggaaggggacccaacggacccaaaggaacggttactccgttcgaccgttaggtactttcggaacctttcggtgtaccgccgtacccgagtacgaacccgtaaccggtccgttacgtttacgtttggtacggtcggaaggtacgaaccttacncgtttacgagttcctccgggtaccgggcgtaccggaccgttactcccggttacgtcgtaccttcggtccttaccccgtcgtacccggtaccgtaccgtaccccgggtacccttaccggttcccggttacccccgtttccggtacccgggttaccccgccccgttttcccggccgttacccggg

SEQ ID NO: 153388 - DNA, 661 bp, Homo sapiens
  misc_feature: GYAE6OF01BMM3L.23.27.C05.1.454.CMB.1.raw
  modified_base (212)..(212): a, c, t, g, unknown or other
  misc_feature (212)..(212): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagcctccagatgggccctgtcccaggcgcaagtgcaggagtcgggcccaggactggtgaggccttacggaacctgtctcttccngcactgtctctactcgtcctccgtcaccgactccctgcgtttggggcgtcgggtccggaccaaccccgaggggtaacggtcttaggaggtggtagttggagtatagtcgtcggtccgggtagggctacgttataccacccgtcctaacgaaacggccggaccgacctacgtcggacgggacgacggacgaaggaagtactcgtcgcgtagtagttacgtcttcgtggtccggacccggccgacgacggaccgtccggtccgtttacgtttagttttggacggtacggaaggtaacgtaaacttaccgttacttcgtacttcgtcgggtcggggccgcggtactcgttccgtcggtacctcgttcgtccgttcccgtcggtcctacccgacggtaaccggtccctagttcccgttcccttcccggcggtccctcccgttcgccgtaccgg

SEQ ID NO: 153389 - DNA, 645 bp, Homo sapiens
  misc_feature: GYAE6OF01CEWS4.23.27.C05.1.454.CMB.1.raw
  modified_base (125)..(125): a, c, t, g, unknown or other
  misc_feature (125)..(125): n is a, c, g, or t
  modified_base (436)..(436): a, c, t, g, unknown or other
  misc_feature (436)..(436): n is a, c, g, or t
  modified_base (473)..(473): a, c, t, g, unknown or other
  misc_feature (473)..(473): n is a, c, g, or t
tcagacgcgagtatcacgaccggtgctcgatttagacgcgatcgaagggtttgggggagtcagaccctgtcaggacacagcatggacatgagggtccccgctcagctccgtggggctctccccgntgctctggctcccaggaacgagggtgacgttcagatcgacccagtcctcccaccctcctgtctgctatcgtggttcggggacctagtccaccatccgacgttcgccgggacgtagtcgtgtacttagttttcggttactttggtctagtataccaaactaaaaccgtggtttccgaccccttaccgtcgtccgtcgcttcgcacgtgacgtagttaacgaacggttcgggtacccagtacggagttactcgagtggacgtaggtgggagggttacgtacctttacacgttctacacgtacgtcgcccgtcncggtcgcgtagtagttcgtttggtacttctgtcgacngtactatagtactacgttcctacccgtatcgttagttcggaccgtaacggacctaagttcgacctgaacgtacgaacgttgtacggtcacgtacctacgagttccgttctaccttactccgtacccttacccgtctaactcgtacgtacttacccgtatccgtcgtggtcgg

SEQ ID NO: 153390 - DNA, 878 bp, Homo sapiens
  misc_feature: GYAE6OF01DYQ6D.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgttggttttgcctcctgctggtggcagcctccagatcgggccctgtcccaggcgcaagtgcgaggagtcgggcccaggactggtgacggtccttacggaaaccctgtccttctttcctgcacttcgtctctactgtcctccgtacaccgtactcccgtggccggtcggggccgtcggggtcccggaccgaaacccccggaggggtaacggtcgttaggaggtggtagttgggagtattacgtcgttcgggttacccggggtagggacttactttaacgttaacccaaccccgttaccctaacgaaaacgggcccgggtaccctacccgtaagtaccggaacggggaaccaccgggaaccaaaggaacggtaacttcgtcgtcgtaggtagtttacgtaccgtttcgtggtaccggtacccgcccggaacgtacggacccgtacccgggtaccgtttacgttttaagtttttcggacggtacggtaacgggtaaacgtaaacccgttaacgtttaaccgttaccgtacgttaccggttccgggtacccgggggacccgggttacccgggtcgttaacccgtttccgggttaccgggttaccccttaaccggtttccgggtttaccccgttccccgggttacccggggttaccccctttaaccccggaaacccgggtaaccccggggtccccttaacccggggtttcccccggtttacccccgtttccccccggttcgggcccccggttaccccgtcgtccccggtaaaccccggg

SEQ ID NO: 153391 - DNA, 759 bp, Homo sapiens
  misc_feature: GYAE6OF01DFH0J.23.27.C05.1.454.CMB.1.raw
  modified_base (163)..(163): a, c, t, g, unknown or other
  misc_feature (163)..(163): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (402)..(402): a, c, t, g, unknown or other
  misc_feature (402)..(402): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggcctccgaaggacgaaggtgacgttcagatgaccngtcctccacctcctgtctgcatcgtggtcgggactagtcacatcacgtgaccgggcgtagtcgtagacgttattttcggttctttagtctagtataccaaaactaaaaccgtggttacnccccgtacgtcctcggtcntcgtacatcgacgtaagttaacgaacggtcgggaccctatacggaatcgtttacgaggtacggacgtaaggtcgggtaagggttaccggtttaccttaacncctttacgaactaacgtacgtccggccggtcgcggaccggtctaagggtaacgttcggtttttacgggaaccttttcgttctacggtcgagtagtaacgttacttacgtaacgttacccggtaccgttaacgtacgttaacggtttaccgggacggtaacgggttaaccgttaaacgtttccgaccgttaactaacggttaaacggtacgttaggtcccgtattccgaaccgtacttaacgtttcgaccggttttacttaaccctacggtttacccccttaacccgtaccgttacttaccgttaaacgttccgtttaaacccttcggggttaccttaccgggtacggggtaaccggg

SEQ ID NO: 153392 - DNA, 808 bp, Homo sapiens
  misc_feature: GYAE6OF01C2LXI.23.27.C05.1.454.CMB.1.raw
  modified_base (218)..(218): a, c, t, g, unknown or other
  misc_feature (218)..(218): n is a, c, g, or t
tcagacgcgagtatcacgaccggtgctcgatttagacgcgatcgaagggtttggggatgctctctgagagtcatggacctcctgtgcaagaacatgaagcacctgtgttttgcctcctgctggtggcagctcccagatgggccctgtcccaggcgcaagtgcaggagtccgggcccaggacgtggtgacggccgttacggaaaccctgtctctttccngcactgtctctactcgtcctccgtcaccgtactccctggcgtcggggcgtcgggtcccggaccgaaaccccggaggggtaacgggttcgttggacggttaggtagttggacgtattacgtcgtcggtacccggggtagggctacgtttactaaccgaaccccgtacctaacgaaacggccgggcccacctagcgtaacggggactaaccgggaccaaaggaagtaactccgtacgtcgtacgtagtttacgtaccgttcgtggtacgtacccgccgtagacgtaccggaccggttccgtttactttaggtttttacgcggtaacggtaacggtaaacgtaaactttaccgttacgttaccgtacgttaccggttaccggtccgggggaccgtacccggtaccgttacggttaccccgttacggggtcccttaaccgttcccgggtttacccgtccccgtttaccgggcccgttttaacccccggaaccgggtaaacccgggccccgtttaaggttccccccggtttaccccgttaccccccgggtcggaccccccgttccccggttacgggcccccgttaaaccccgggg

SEQ ID NO: 153393 - DNA, 839 bp, Homo sapiens
  misc_feature: GYAE6OF01C5CVV.23.27.C05.1.454.CMB.1.raw
tcagacgcgagtatcacgaccggtgctcgatttagacgcgatcgaagggtttggggctctctgagagtcatggacctcctgtgcaagaacatgaagcaccttggttggttttgcctcctgcgtggtggcagcctaccagagtcgggccctgtcccaggcgcaagtgcgagggacggtccgggacccgaggacgtggtgacggtccgttaccggaaacccttgttccttctttcctgctcgtcgtctctactcgtcctccgtcaccgtctccgtgcgtgggcgtcgggccgaccgaacccggagggtacggtcgtggaggtggtagttaggatattacgtcggtacggtaccgggtaggtaccttacgttaacctaaccgaaccccgttaccgtaaacgaaaccgggacccggtcccgtacccgttacggaccgggaaccggggaaccgaaccggaaccgaaaggtaacggtaacttccgtacgtcgttaggttacgtttacgtacgttcgtcggtaccggaccgccgtaagaaccgtacccgtaccggttaccgtttacgttttacggttttcggacggtaacggtaacgggtaaaccgttaaaccgtacccgtttacgttaaccggtacgttccggtaccgggtcccggggtaccgacggtaccgttaccgttcccggtacggttaccgttccgttccggttcccgttacccggtcccggttacccgtttaaccccggaacccggtcccgggtaccccttacgggttcccccggttcccccgttacccccggtccggtaccccgttcccgtccgtacccgtaccggccgggtaacccg

SEQ ID NO: 153394 - DNA, 805 bp, Homo sapiens
  misc_feature: GYAE6OF01D9N4I.23.27.C05.1.454.CMB.1.raw
  modified_base (513)..(513): a, c, t, g, unknown or other
  misc_feature (513)..(513): n is a, c, g, or t
tcagacgcgagtatcacgaccggtgctcgatttagacgcgatcgaagggtttggggatgctctctgagagtcatggacctcctgtgacaaagaacatagaacgcctaccttggttcggtttttcgccctcctgtcgtggtggcagcctaccgagacgtcggccttcgacccgaggccgacaaggtcgacggaggtacggtccgggcccgaaggtcggtgggtacggaccggttacccgttaaccggaaaccctttgttcctttcccgttttaccgcgtcctaacgttccgtactttacctaccgttcggtccccttaccgtaccgacctaccgtccgtaggtccgggtcgggtccggtcgggaccccgacccggaaccgggtagggtacggttcgtaggcggtaggtagtacgagtagtcgtcgtccgggtaccggtgtacacttacgtaaccaccgtacaacggacgaccgtccacgtagcggtaacggacacggaacgagtaacgtactcnccgtaggtgtttaacgtctgttccggaagaccgtcgacccgacgaaccggtaacgtcccgtacgtttacgtttcggttacggacgtaacggtacgtaaacgtaacctttacgtacgttacgtacgtcggtccgggtacggaccgtcgtcgtaccgttcgttccgtacggttaccgttccggtcttaccccggttacgtacccgttacccggacccggtacggttccccgaacccgttcccggttcccccggtacccgtcccggtacccttcccggtccgtacccggtacccg

SEQ ID NO: 153395 - DNA, 702 bp, Homo sapiens
  misc_feature: GYAE6OF01BJ3TT.23.27.C05.1.454.CMB.1.raw
  modified_base (691)..(691): a, c, t, g, unknown or other
  misc_feature (691)..(691): n is a, c, g, or t
tcagacgcgagtatcacgaccggtgctcgatttagacgcgatcgaagggtttggggatgctctctgagagtcatggacctcctgtgcaagaacatgaagcacctgttggtttttgcctcctgctggtggcagcctcccagagtcgggccctgtcccaggcgcaagtgcaggacgtccgggcccaggacgtggtgacggtccttaccggaaacccttgtccttcctttcctcgctacttcgtcttctacgttcgtccttccgtccaccgtctccccgtgtcggtgggtccgtccgggtacccgaacccgaaccccggaaggggtacggttcgttacggtaggtggtagttggagtatacgtcgtcggtccgggtaggtcctaactttaacttaacccgaccccgtaccaaacgaaacggccggccgacctacggtacggaacgggaaccgaccggacgaaaggtaacgtacttcgtacgtagttgttagtttcgtacgtttcgtcgtaccgacccgccgacgaacggcccgtaccgggttctttactttcgtttcggcggtacggtaaggaactaaacttccgttaacttcggcttccggtggccgggccgcgtcctcgttccgtcgactcggtctcccgtccgtccgtaccacccgacgacggtccctcgtcccgtccctccggacgtccncctgtccgacg

SEQ ID NO: 153396 - DNA, 435 bp, Homo sapiens
  misc_feature: GYAE6OF01B3O8Y.23.27.C05.1.454.CMB.1.raw
  modified_base (202)..(202): a, c, t, g, unknown or other
  misc_feature (202)..(202): n is a, c, g, or t
  modified_base (420)..(435): a, c, t, g, unknown or other
  misc_feature (420)..(435): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctattttgngcgaggagaaactactacttcgatctctggggccgcggcatccctggtcacgtgtcctcctcggcttccaaccgaagggcccatcggtccttccccgtggccgccctgcctccgaggtacgcaaccctcgtgggggcacgagccggtccctgggctgcctggtcaaggtactaccgttcatactcgcgtctgacgtcgggctggacaggtcgcatagnnnnnnnnnnnnnnnn

SEQ ID NO: 153397 - DNA, 756 bp, Homo sapiens
  misc_feature: GYAE6OF01BG6HJ.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatcgacccagtcctccaccctccctgtctgcatctgttggggaccgagtcaccatcacttgccgggcgagtcgtgactattttcggttctttagtctggtatcaaacaaaacctagggttcgcccctaccgtcctcgtcgctgtcactgacgagttacgaaggtcggggtcccagtcgagtacttcgagtggcaggtgggaggtcgggtacccttttacgactctcaacgtaacgtccggcccggtcctcggtaccgtcccgttaaggtaaacggttacggttttttacggggtaaccttttaccgttttccttcgggttacctaacggtacgttaacggtttaatttaaaccgtaacgtttaccggttacccccgttaaactaaccgtttaaggtttttaccgggaccccggggtaaaggggtaacccccgttaaaacggttttaccggaacccctttacgtaaaccggttaaaccgttaaccggttagggttcgggtaccttacgggtacccaaccgttcttaccgttcgttaccttacgtaccttcccgttacccgcctacgtactacgtacttaccgcgtccgttgtcggtacggg

SEQ ID NO: 153398 - DNA, 694 bp, Homo sapiens
  misc_feature: GYAE6OF01BKC54.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttacggaaacctgtctcttcctgcactgtctctactgtctccgtcaccgtctccctgcgtgggctcgggtccgaccaacccgagggacggtcttggaggtggtattggagtatatcgtggtcccgggtagggcctacgtttactaccacccgtcctaacgaaacggccgggcctccctatcggacgggaccacggacaaaggaacggtaactcgtacgtcgtaggtacgtttcgtacttcgtaggtccggacccgccgacaacggaccgtaccgggtccgtttacgtttacgttttcgggcgtaccggtaagggtaaaccgtaaaccttaccgttacgttacgtaacgttccggttccgggtcggggtcccgcggtacctacggttccgttcggtactaccgttcgttcccttcccgtcgttccctacccgaaccggaccgggtccctacggttccccggttcccttcccccggcggtcccgtaccctgccctcggacggtaccg

SEQ ID NO: 153399 - DNA, 693 bp, Homo sapiens
  misc_feature: GYAE6OF01BBXRY.23.27.C05.1.454.CMB.1.raw
  modified_base (218)..(218): a, c, t, g, unknown or other
  misc_feature (218)..(218): n is a, c, g, or t
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagacgcgagtatcacgaccggtgctcgatttagacgcgatcgaagggtttgggggctctctgagagtcatggacctcctgtgcaagaacatgaagcacctggtggttttgcctcctgctggtggcatctcccagatcgggccctgtcccgaggcgcaagtgcaggagtccgggcccaggactggtgaggtccgttacggaaacctgtctctttccngcactgtctctactcgtctccgtcaccgactcctgcgtcggggcgtcgggtcccgacccgaaacccggtaggggtacggttcttaggaggtggtagttgganatcgtcgtggtcccgggtagggctacgttactaccgacccgtacctacgaaacggcggcccaccgtagacggacgggacncggactaaagacgtatcncgtntgtattcgtacgtgcgtacgcccgcgtacgacgaccgacggtcgttctttagtttcggaggtacgaggtaacgtaaccgtactacgttacgcttcgtcgggtacgggtcccgagggtccctacggttacccgttcggtaccgttacgttccgttaccgttccgtttcccggaccccgttacccgaacccggtcggtaccccgtaccgggtttccccgttcccgtttccccgcgggtaccccgtcccgttacgcccgttccgagggtcccgg

SEQ ID NO: 153400 - DNA, 679 bp, Homo sapiens
  misc_feature: GYAE6OF01AGXC4.23.27.C05.1.454.CMB.1.raw
tcagacgcgagtatcacgaccggtgctcgatttagacgcgatcgaagggtttgggggagtcagacccctgtcaggacacagcatggacatgagggtccccgctcagctcctggggctcctgctgctctggctcccaggaacgaagggtgacgttcagatgacccagtctccaccctccctgtctgcatctgttgggaccgagtccacatcacgttgccgggcgagtcgtgactagttttcggttctttagtctggtatacaaacaaaaccgtaggtttcgcccctaccgtcctcgtcgctgtcactgacgagttaacaagtgggtcccagtccgagattcgagtggctaggtggtagggtacgggtacttttaccacgtctaccgtacaacgtccggcccggtcctcggtccggaccttaggaacgttagttttccgggtactttaccgtttcgtgttcgacgtcgtaacgttaagttaacgtaacgttaccgtacccgttaactaccgttagtttaccgggaccgtacggggaaacccttaaaggttacgtaacccttcgaaacttacgaacgttagtcggtcttaccggcctaccgtactacgttcgttacttccgtacttcccgttaccccgcttaccgtcttagtaaccttacgtaccgtccgtcgtcgtacggg

SEQ ID NO: 153401 - DNA, 841 bp, Homo sapiens
  misc_feature: GYAE6OF01CG5ZO.23.27.C05.1.454.CMB.1.raw
  modified_base (216)..(216): a, c, t, g, unknown or other
  misc_feature (216)..(216): n is a, c, g, or t
  modified_base (263)..(263): a, c, t, g, unknown or other
  misc_feature (263)..(263): n is a, c, g, or t
tcagacgcgagtatcacgaccggtgctcgatttagacgcgatcgaagggtttggggatgctctctgagagtcatggacctcctgtgcaagaacatgaagcacctgtggtttgcctctgctggtggcagcctccagatgggccctgtcccaggcgacaagtgcgaggacgtccgggcccaggactggtgacggtccttacggaacctgtctcttccngctactgtctactacgtcgtccgtccgtaccaccgtacgttccccgnggtcggttcggggtccgttccggggtaccccggacccgtaaaccccccggaaggggtaacgggttccgttagggaaggttaccgggtagtttagggaacgtacgttaccggttcggttaccggggttaccccggggtaggggaccttaaccggtttaacttaaccccgaccccgttaccccgtaaggaaaaaccggccgggtaccccgtaccgttaacgccggaacgggtaaccgaccgggtaacgaaaggtaaccggtaacttccgtacggtcgttaggtacgtttccgaccgtttccgtaggtccgtaccggtccgtacgaacgtaaccggtaacccggtccggtttaactttgttttaccggtacgggtaccggtaacgggtaacgttaaaaccgttaccgtttaaccgttaccgtacgtttccggtccgggtacgggaccggtaccggtacttacgttccggttacgtacgtacgtccgttaccgtccgtacgtaccgttacccgacgggtaccgtcccgttaaccgtcccggttacccttccccggtcgccccgtacgtcgtcccgtaaccgg

SEQ ID NO: 153402 - DNA, 410 bp, Homo sapiens
  misc_feature: GYAE6OF01A36RZ.23.27.C05.1.454.CMB.1.raw
  modified_base (307)..(307): a, c, t, g, unknown or other
  misc_feature (307)..(307): n is a, c, g, or t
  modified_base (395)..(410): a, c, t, g, unknown or other
  misc_feature (395)..(410): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctgggccgcggcatcctggtcactgtctcctcggcttccaccaaggcccatcgtcttcccctggcgccctgctccagngcacctcgtcggggcacgagccggccctgggctgcctgtcaaggactactccatactcgcgtctgagcgggctggcaaggcacatagnnnnnnnnnnnnnnnn

SEQ ID NO: 153403 - DNA, 921 bp, Homo sapiens
  misc_feature: GYAE6OF01AU3UJ.23.27.C05.1.454.CMB.1.raw
  modified_base (907)..(907): a, c, t, g, unknown or other
  misc_feature (907)..(907): n is a, c, g, or t
tcagacgcgagtatcacgaccggtgctcgatttagacgcgatcgaagggtttggggatgctctctgagagtcatggacctcctgtgcaagaaacatgaagcacctgtggttttgcctcctgctggtggcagctcccagtagtcggccctcgtcccgaggcgacaagtgcgaggacggtccgggcccaggctgggtggacggtccgttaccggaaaccgtggtccttcctttaccgtgcctacgttcgtaccttccttaccgtcgttccgtacccgtaccgaaccgtccgttccccgtggtccggtccggggtcggtccggggttccccggacccggtaaaccccccggtagggggtaaccggttacggtttacggtagggttagggtaacgttggaacggtaacttacgttaccggttcccgggttacccggggttaggggaccctttaaccgtttaacgttacccccgtaaacccccgtttaacccgtaacggtaaaaacccggtccgggaaccccgttacccgtaacggttaccgggaaccggggaacccgaacccgggaaacccggtaaaaaggtaaacggttaaacgtttccgtaccgggtaccgttaaggttacgtttaccggttcctttaccggttcgtaccggacccgcccggacgtaaccggaccggttaacccgggttccctttaaggttttacgttttacggacgggtacggtaaacggttaaaccgtaaccgttaaccctttaccggtttacgtaaccggttcccggtttgggtaccccgggtcgggtcctaccgtacgttacgttcggtacctcgttaccggtccgttcccgtaccgttcccgtaccgtacccggacggtaccccgtcgtcccgttcccgtcccgtacggtcccnccgtcgccctccgg

SEQ ID NO: 153404 - DNA, 762 bp, Homo sapiens
  misc_feature: GYAE6OF01EUX3P.23.27.C05.1.454.CMB.1.raw
  modified_base (222)..(222): a, c, t, g, unknown or other
  misc_feature (222)..(222): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagcctcccagatcgggccctgtcccgaggcgcaagtgcgaggagtccgggcccaggactggtgacggtccgttacggaaccctgtctctttccngcactgtctctactcgtcctccgtcaccgtactcccgtggcgtcggggccgtcgggtcccggacccgaaccccggaggggtaacggtcgtaggacggttggtagttggagtagtacgtcgtcggtccggtaggtacctacgttactaccgtaaccccgtacctaacgaaacggaccggtcccgaccgtacgtacggacgggacgacgacgaaggaacgtaactcgtcgcgtagttacgttcgtacttcgtggtaccgaccccgtcgacgacgacccggtacgttccgtttacgtttagttttcggacgttacggaacggttaaacgttaaaccttacgttaccgttacgtacgttccgtaccggggtccggggtcccgtacgggtccttaaccggttccgtacggttccgtacgtttccggttccccgttcccggtacccgttacccttccccggaaacggtacccgggtccccttacggttccccggttacccccgtttccccggcgggtccccctccccgtaggtccccgtaaccggg

SEQ ID NO: 153405 - DNA, 915 bp, Homo sapiens
  misc_feature: GYAE6OF01ETMBP.23.27.C05.1.454.CMB.1.raw
  modified_base (223)..(223): a, c, t, g, unknown or other
  misc_feature (223)..(223): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatcgggccctcgtcccaggcgcaagtgcaggacggtccgggcccaggacgtggtgacggtccttacggaaaccctgtctctttccngctactgtctctactcgtcctccgtcaccgtactccccgtggtccggtcggggtccgtccggggtccccggacccgaaacccccgggtaggggtaacgggttcgttaggtacggttgggtagttagggaagtaagtacgttccggttcgggttacccggggtaggggtaccttaaccgtttaacgttaaccccgtaaaccccgttaccccgttaaacggaaaaccgggtcccgggtaccccgtacccgtaacgtaccgggaacgggggaaccgaacccgggtaacccgaaaagggtaaacggtaacgttccgtaccggttacgttacggttaacggtttacgtacccgtttcggttcggtaccggaccccggtccggaacgaaccgggtaaccggtacccgggtttccctttagttttaacggtttttcgacgggtaacggtaacgggtaaacgttaaccgtttaaccgtttacgttacggtaccgtttccggtacggggttacccgggggaccgtccggtaccttacggttcccggttacggttacccgtacgttccggtttcccctccggttcccggttaccccgttacccggaaacccgggtcccggtaccccgttaaccgggttcccccggtttcccccgttacccccgggtggtacccccgtccccgttgaccccgttaacccgggg

SEQ ID NO: 153406 - DNA, 861 bp, Homo sapiens
  misc_feature: GYAE6OF01A38QE.23.27.C05.1.454.CMB.1.raw
  modified_base (117)..(117): a, c, t, g, unknown or other
  misc_feature (117)..(117): n is a, c, g, or t
  modified_base (603)..(603): a, c, t, g, unknown or other
  misc_feature (603)..(603): n is a, c, g, or t
tcagacgcgagtatcacgaccggtgctcgatttagacgcgatcgaagggtttggggatgctctctgagagtcatggacctcctgtgacaagaacatgaagcacctgttggtttttcncctcctgctggtggcagcctccagtagtcggccctcgtcccgaggcgacgaagtggtaggacggtccgggcccaaggtcgttgggtcggacggtcccttacggtaaaccccttgttcctttcctttcccgtgtctacgttcgtaccttcgtacttcgttcctacccgtcctacccgtacttccccgtggtcggtcgggtcgttccggggtcccgaacccgaaccccggaagggttacggttccgttaggacggtggttaacggttaggaagtacgttacgttccggtaccgggttacccgggtagggtaccttaaccgtttaacgttaaccccgtaaccccgttaaccgtaacgaaaccgggtcccggaccctaccgtacggtaccggaacggacctaacggaacgtaaagacgttacgtacgtcggcttaggttacgtttcgtacttcgtacggtccgtaccggcacgtacgaccggtcccgttnttacggtttgtttcgaagtcgggtaaagttaacgtaaccttacgtactccgtcggttcctaggggtcccgacgtccggtacttaccggttcggttcctccgttacgttcccggtcccgttcccggtacccgtacccgtttaccggaaaccccggttccggtacccccgtttcgggttaccccccgttcccccccggtacccggttaccgggtccccccggttcccttaaccccggtccccggttccgggaaaccccgg

SEQ ID NO: 153407 - DNA, 757 bp, Homo sapiens
  misc_feature: GYAE6OF01DHRYI.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttacggaaaccctgtctctttcctgcactgtctctactcgtctccgtcaccgactccgtgcgtcgggcgtcgggtccggaccaaccccggagggtaacggtcgttaggacgtggtacgttggagtatactcgtcggtaccgggtagggacctacgtttaacgtaaccgaacccgtaccctaacgaaacggccggacccgtaccgtacgtcggaacgggaaccgaaccggacgaaaggaaacgtacgtacgtcgtacttaggtacgtttacgtacttcgtcgtacgacccgccgacgacgaccgtaccggtccgttatttaacgttttcggacgacggtaagggtaactaaaccgttaccgttacgttcgtaacttccgtacggtccgggggtacctcgggtacctaggttcccgttagggtaccctaccgtttcgtccccgttccgttcccggtacccgtttacccgaaacccgggtaaccgggtcccccgttaacggttcccccgggtttaccccttccccccgggtacggtcccccggtccccgttcgtccccggtaacccggg

SEQ ID NO: 153408 - DNA, 821 bp, Homo sapiens
  misc_feature: GYAE6OF01DI3XD.23.27.C05.1.454.CMB.1.raw
  modified_base (625)..(625): a, c, t, g, unknown or other
  misc_feature (625)..(625): n is a, c, g, or t
  modified_base (733)..(733): a, c, t, g, unknown or other
  misc_feature (733)..(733): n is a, c, g, or t
  modified_base (806)..(806): a, c, t, g, unknown or other
  misc_feature (806)..(806): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggcccttgcccaggcgcaagtgcgagggaggtccgggcccaggacttggtggaggtcccgttaccggaaacccttggtccttcctttccgtgtcctacgtcgtcctttaccgtaccttcggttacccttcccgtccgtacccgtacttccccgtggccggttcgggggccgttaccggggtccccgaacccgaaacccccgggtaaggggtaaccgggttcgtttacgggacggttggggtaagttgggaagtacgttacgttcggttccgggttacccggggtagggtaccttaacgtttaccgttaacccgtaaccccgtccgtaaccgaaaacggcccgggacccgtacccttaggaccggaacgggacctaccgggaaccaaacggtaaaggttaaccttccgtacggtccgttagtacggttttacgtaaccgttcttcggtaccggcccgacccgataaccggaccgtcggttacccgttntttttaagttcggtacggaccggtaagggtaacctaaacttaccgtagttaccgtacttacggtccgggtcgggcccgtacgtcctacgttccggtgtacctcgttcnccgttcccggtcgacccttccgacgtaacccggtcccttacggtccccgttccctcccgggcgtcctacccgngtcctcggaaccccg

SEQ ID NO: 153409 - DNA, 280 bp, Homo sapiens
  misc_feature: GYAE6OF01DOMKW.23.27.C05.1.454.CMB.1.raw
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (199)..(199): a, c, t, g, unknown or other
  misc_feature (199)..(199): n is a, c, g, or t
  modified_base (270)..(280): a, c, t, g, unknown or other
  misc_feature (270)..(280): n is a, c, g, or t
tcagacgcgagtatcacgaccggtgctcgatttagacgcgatcgaagggtttggggggaagaggaagactgacggtcctcccaggagttcaggtgctgggcaccttgggcacgggggaggtgtgtcacaagatttgggctctgggcaccggtggggcagtgggggaggtgtgtcanaagtntttgggctcgtgggcacngcggccctgggctgcctgtcgaagctacttccatactcgcgtctgaggcggctggacaaggcgacagtagnnnnnnnnnnn

SEQ ID NO: 153410 - DNA, 710 bp, Homo sapiens
  misc_feature: GYAE6OF01BVXRT.23.27.C05.1.454.CMB.1.raw
  modified_base (288)..(288): a, c, t, g, unknown or other
  misc_feature (288)..(288): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtcctcccaccctccctgtctgcatctggttcgggaccagtcaccatccacttcggccgggcgtagtcgtgactagttttcggttctttagtcgtaggtactacaaactaaaaccgtggttccnccccgtaccgtcctcgtcgctcgtacactgaacgtagttaacgaaggtcgggtaccagtcgagtatcgagtggcgaggtggacggtacggtaccttttacgaccttctacacgtaactccgaccggcctggccgtaccgtaggtaagttacggtttagggtacctttcgttcgtcgtaccgagtacgtaacgttagttaacacgttaccgttaccccgtaactacttaggttaccggaccggtaacgggtaactaaacggttccgaacccgttacgtaacgttaacccgtaacgttcggacggttaccacgtacccgtaccttacgttcccttcgttacccgttaccgtacgtttcccccgttacccgccgttactccgttaaagtaccttacgtacccggttcgttcgtacgggtaccggg

SEQ ID NO: 153411 - DNA, 1011 bp, Homo sapiens
  misc_feature: GYAE6OF01DIAEM.23.27.C05.1.454.CMB.1.raw
  modified_base (171)..(171): a, c, t, g, unknown or other
  misc_feature (171)..(171): n is a, c, g, or t
tcagacgcgagtatcacgaccggtgctcgatttagacgcgatcgaaggggtttgggggagtcagaccctgtcaggacacagcatggacatgagggtccccgctcagcctccgtggggctcctgctgctctggcctccgaaggaacgaaggtgacgttcgagacgtcgaccngtcctaccctacccgtcctgtctcgctgttcgtgggtacgggaccgtgtacaccattcgtacgttcggccgggtcgacgttcgtacttacgtttacgtttttcgggtttctttacggttcgttaggtaactaaccgaaaaaccgtaaaaaccggtttcgggtttcctaccccccggttacgttcccgtcgtcgtccgttgtaccctaagtcggaaacgttaaacggtttaacggaaacgggttccggggtaaccctaggtacgtaacggttacttaccgggtaggtacggtacggtaggggttacggggttaaacgggtttaccgggtttaaccttttaaccgaccctttaacgtaaacccgttaacgtaaacccggtccccgggggttaaccccggttccggtttacggggacccgggtttaaccggttttaaaccgggttaaaagggggtttttacgggttttttaccccgggtttaacccttttttacgggttttcccggtttaacggtacccggtaaacgggtttacggttttaaaacggtttaacccgtttaaactttaacccgggttttaaccggtaaccccccgggtttaaactttaccggggttaaccggggttttaaacccgggggaaccggtaaacggggtttaaaacccgttaacgggttacccttaaccgggtacctaaaccggtttaaaccggtacggttccgaacggttctaacccggtacccttaatcgtttaccgtactttacccgtctttacccgttacccgttacccgtccttaataccttaaccggtagtttacccgcggtacgttggtaaccgggtcggg

SEQ ID NO: 153412 - DNA, 838 bp, Homo sapiens
  misc_feature: GYAE6OF01BFDYB.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgttggttttcgcctcctgcgtggtggcagctccagagtcggccctgtcccgaggcgcaagtgcgagggtagtccgggcccaggacgtgggtggacggtcccttaccggaaaccctgttccttccgtttcctgcctacttcgtcctctacttcgtcctccggtaccaccgtactcccgtgcggtcgggccgtcgggtcccgacccgaaccccggaggggtaacggttccgttaggtaggtaggttacgttagggagtacgttacgttcggttaccgggtcccggggttacgggacctttaaccgtttaaccgttaaaccccgtaaccccggtttacccgtaaaccggtaaaaccgggtcccgggtacccgtacccgttaacggtacccgggaacgggggaacccggaaccggggaaccaaaacgggtaaacggttacgtttccgtacggtacgttaggttacggtttacgtacgtttccggtacggtaccgtaccggcccgacgacgtaccgtacccggttccttcgttttagtttcggacgaacggtaacggtaaacgtaacttacgttacgttaccgtacttcggttccgggtcgggtcccgtcgggtacctaccgttcgtacgtaccgtccgttacgtcccgttccgtcccgttacctaacccggtaccgacgggtcccctcgggttccccggttcccttccccggacggtaccctcccgtagcccgtacgg

SEQ ID NO: 153413 - DNA, 480 bp, Homo sapiens
  misc_feature: GYAE6OF01CT29D.23.27.C05.1.454.CMB.1.raw
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (448)..(480): a, c, t, g, unknown or other
  misc_feature (448)..(480): n is a, c, g, or t
tcagacgcgagtatcacgaccggtgctcgatttagacgcgatcgaagggtcttgagtggattggatatatctgtcccggtaggggcacttattacaacccgtccctcaaaagacgggccgccctatcaggggacacggccaagaaggaattctcgctgagtttgacttctgtgaccgccgcagacacggccgtctattttgtgcgaggagaaactactacttcgatctcgtggggccgcggcatcctggtcactgtctcctcggcttccaccgaagggccctagtcggttcccttccccgtggccgccctgcctccgaggcgcctaccgtcggcgggggaccaccgacggcccggtcccgtgggcctcgccgtggtacgaacggtaccttaccttccactactccggtcgttcgnggaccggcgggtcgnggacgaggcgactagtgnnnnnnnnnnnnnnnnnnnnnnnnnnnnnnnnn

SEQ ID NO: 153414 - DNA, 918 bp, Homo sapiens
  misc_feature: GYAE6OF01CIQ8X.23.27.C05.1.454.CMB.1.raw
  modified_base (210)..(210): a, c, t, g, unknown or other
  misc_feature (210)..(210): n is a, c, g, or t
tcagacgcgagtatcacgaccggtgctcgatttagacgcgatcgaagggtttggggatgctctctgagagtcatggacctcctgtgcaagaacatgaagcactgtgtttgcctcctgctggtggcagctcccagatgggccctgtcccaggcgtcaagtgcaggagtcgggcccaggactggtgaggccttcggaaccctgtctcttccngcactgtctctactgtctccgtcaccgtactcccgtgcgtcggggtcgttcggggtcccggaccgaacccccggtaggggtaacgggttccgttaggaggttagggtagtttagggggagttaagtaacgttccggttccgggttaccccgggggttaagggggtaccttaaaccgttttaaccgtttaaaccccgtaaaccccccggtttaccccgtttaaaccggaaaaaaccgggtaccccggggtaccccgtaacccccgtttaaggtacccggtaaacggggggaaacccgtaacccggggtaaacccgaaaagggttaaaacgggttaaaccgtttaccgttaccgggtaccttaggggttaacggttttaccggtaccgtttacgggttaccgggtacggtaaccccgggacccggtaccggttaacggaacccggtacccgggttacccgtttaacgtttaaggtttttcggtaccgggacggttaaacgggtaaaccgtaaaccttacgttaaccgttacgtaacgttccgtacgggtacggggtcccgacgggtcctaacgttcccgtacggttacctacgttccgttccgttacccgttccggtaccgttacccgaacccggtaacgggtcccctaacggttccccgtttccccgttaccccgtcgggtacccctacccgttcggccctaacccggg

SEQ ID NO: 153415 - DNA, 948 bp, Homo sapiens
  misc_feature: GYAE6OF01CZ86D.23.27.C05.1.454.CMB.1.raw
  modified_base (127)..(127): a, c, t, g, unknown or other
  misc_feature (127)..(127): n is a, c, g, or t
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
tcagacgcgagtatcacgaccggtgctcgatttagacgcgatcgaagggtttggggagtgctctctgagagtcatggacctcctgtgcaagaacatgaagcacctgtggtttgcctctgctggtgcngctccagagtggcctcgtcccgaggcgactaagtgcgaggaggtccgggcccgagggtacgtgggtggacggtccgtttacggaaacccttgtccttcgtttcctgtcacgttgtctctactcgtcctccgtacnccgactccgtgcgtgggtccgtcggtccgaccgaaccccggagggtacggtcgtgnggttgagttcggagtagttactcgtcggtaccgggtagggtactacgtttacgtaacccgtaacccgttacccgtaacgaaacggtccggacccgtaccgtacgtaaccggaacggggtaacccgaacccgggtaaccgtaaaacgggtaaacggtaacgttacccggttaccggtacggttaacggttacggtttttacgttacccggtttacggtttaccgggtacccgggtaacccggtaaccccggttaccgaaaccgggttaacccggtaccccggggtttaccggttttaacgtttttaacgggtttttaccgggtaacggtaaccggggttaaacgggttaaaccgtttaaaacctttaccgttttaaccgtttacggttaaccggttccggtttccggggttaccgggggaccccgtccggggttaaacttccggttacccggtttacgggttccgtacggttttacccggtcccgtttaccccgttacccgggtaccccgttttacccccggaaccccgggtaacggtttcccccccgtacggtttaccccccggttccccgttttccccccggggtaacgttcccccgggtcccttacccggtccccggtaaaccccggg

SEQ ID NO: 153416 - DNA, 743 bp, Homo sapiens
  misc_feature: GYAE6OF01AXKHI.23.27.C05.1.454.CMB.1.raw
  modified_base (717)..(717): a, c, t, g, unknown or other
  misc_feature (717)..(717): n is a, c, g, or t
  modified_base (726)..(726): a, c, t, g, unknown or other
  misc_feature (726)..(726): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctccagatcgggccctgtcccaggcgcaagtgcaggagtcgggcccaggactgggtgaggtccttacggaaaccctgtcttcttctgctactcgtctctacgtcgtcctccgtcaccgtctccgtgcggtcgggtcgtcgggtccgaccgtaccccgaggggtaacggttcgttggacgtggtagttaggtacgtattacgtcgtcggtaccgggtacggggtctaaccgttacgttaccgaaccccgtcctaacgaaaacggacccgggcccgtacccgtacgtacggacgggaaccgaccgggaccgaaaggaagtacttccggacgtacgtaggttacgtttaggactttcgtcgtaccggccgacccgacgaacggtaccgtaccggtacccgtttagtttacgttttacggcggtaacggtaaggtaaaccgttaaaccttaccgtaacgttcgtaacttcggtccggttacgggcccggtacggtccttaacgttcccgtggtaccctcgttcgtccgtaccgtccggtaccttaccgaaccggtacccggtcctaccgggttccttccccggttacccgngggtccccnccggtcgtaccgccggg

SEQ ID NO: 153417 - DNA, 857 bp, Homo sapiens
  misc_feature: GYAE6OF01CKCBS.23.27.C05.1.454.CMB.1.raw
  modified_base (111)..(111): a, c, t, g, unknown or other
  misc_feature (111)..(111): n is a, c, g, or t
  modified_base (135)..(135): a, c, t, g, unknown or other
  misc_feature (135)..(135): n is a, c, g, or t
  modified_base (229)..(229): a, c, t, g, unknown or other
  misc_feature (229)..(229): n is a, c, g, or t
tcagacgcgagtatcacgaccggtgctcgatttagacgcgatcgaagggtttggggatgctctctgagagtcatggacctcctgtgcaagaacatgaagcacctgtgtttncctctgctggtggcagcctccagntcgggccctcgtcccaggcgacaagtgcgagggacggtccgggacccgaggacgtgggtgacggtccttaccggaaaccctgtcctcctttccngctactgtctctactcgtcctccgtacaccgactccgtgcgtcgggtcgtcgggcccgaccgaacccggaggggtaacggtcgtaggaggtggtagtacggagtatacgttccgtcggtacccgggtaggtacctaacgttactaacccgtaccccgtaccgtaaacgaaacggccggtcccgtacctagtaccggaacgggaccgaacggaccgaaaaggtaacgtaacttcgcgtacgttacggttagtttaccgttacgttcggtacgtaccggaccccggtaccgtcgaaccgggaccgtaacccggttccgtttaacgttttaaggtttccggacgtaacggtaaacggtaaaccgttaaaaccgttacgtttaaccgtacggttaccgttacccggttccgggtaccgggggtccctacccggttaacccgttaccggttccccggttaacggttaccccttacgggtttcccttacccgggttacccggttacccggtacccgtaaccccggtaaacccgggtacccgggttaaaccccttcccggggtttaccccgtttcccccccggttacccggcccgggtacccccgtccccgttaggaacccccggttaaccgggg

SEQ ID NO: 153418 - DNA, 841 bp, Homo sapiens
  misc_feature: GYAE6OF01APB4I.23.27.C05.1.454.CMB.1.raw
  modified_base (149)..(149): a, c, t, g, unknown or other
  misc_feature (149)..(149): n is a, c, g, or t
  modified_base (828)..(828): a, c, t, g, unknown or other
  misc_feature (828)..(828): n is a, c, g, or t
tcagacgcgagtatcacgaccggtgctcgatttagacgcgatcgaagggtttgggggagtcagaccctgtcaggacacagcatggacatgagggtccccgctcagctccgtggggctcctgctgctctggctccgaggaacgaagggtnacgttcagatcgacccagtcctcccaccctcctgtctcgactagttcgtggttacggggacctagtaccaacctatacctaacgttcgggacccgggtcggtaacggttcggtacgtaactttacgttttcgggtttactttaacggtcgtaggttactaaaccaaaaaccgtaaaaaccggtcgggtttaccgtacccccttaccggttcccgtcgtaccgtctcgtctaacgtacggtaaccgtaacgttaacggtaaacgggtccgggttacccaagtcgaagttacgttacgtagtacggagtagggtacggtacgggttaccggttaaccttttaccgaacttcctaaccgtaacgtaacggtccggcccggtaccgtaggtacccggcgttaaacgggttaacgtttaggtttacggtacctttactcgttacgaccgtaagccttaagttaaaccttacgacgtttaaccgtcccgtaaacgtaccgttaaggtttcccggaaaccgggtaccggtaaacgttacgttacgaaccgtctaaaccgtacggtaacgtgttaacgcgtaccgaaacgtcctaattccgttacgttacctttacctaccccgttccctaacccggtcccttaacttaaccggttacgtaactttacccggaccggtcttaacggngggttaacccggg

SEQ ID NO: 153419 - DNA, 817 bp, Homo sapiens
  misc_feature: GYAE6OF01A48VS.23.27.C05.1.454.CMB.1.raw
  modified_base (703)..(703): a, c, t, g, unknown or other
  misc_feature (703)..(703): n is a, c, g, or t
  modified_base (785)..(785): a, c, t, g, unknown or other
  misc_feature (785)..(785): n is a, c, g, or t
tcagacgcgagtatcacgaccggtgctcgatttagacgcgatcgaagggtttggggatgctctctgagagtcatggacctcctgtgcaagaacatgaagcactgtggttttgcctcctgctggtggcagtctccagagtgggccctgtcccaggcgacagtgcaggagtcgggcccaggacgtggtgacggtccttacggaaacccttggtccttcctttccgtgcgtacttcgtcttacctacgtgtccgtaccgtcaccggtactccccgtaggcggtacggggccgtcggggtacccggacccaaccccggtaaggggaacggtttcgtaggaggtggtagttagggaatacgttacgtccggttacgggtacccggggtaggggtaccttaaccgtttacgtaaccccgtaaccccgttacccgtaaacgaaaaaccgggtccgggaccctaccgttaacggaccggtaacggggaaccgaccgggaaccgtaaaacgggaaacggttacttccgtacgtccgtagggtttactttcggtaactttccggttaggtaccgacccggtccgaagtaacggaccggtacccgttcgtttacgtttaaggttttcggacgggttacgaaacgggttaactaaaccttcggttaacgtctacttacggcgggttaccgggccgagggttccacggttccggtnaccgtccgtgtaccgttcccgacggttcccaccgggtacccggaacggtccctaacgggtttccccgtcccctttacccggnggttaccccctccgttacggcccggttaccgg

SEQ ID NO: 153420 - DNA, 810 bp, Homo sapiens
  misc_feature: GYAE6OF01BFR59.23.27.C05.1.454.CMB.1.raw
tcagacgcgagtatcacgaccggtgctcgatttagacgcgatcgaagggtttggggatgctctctgagagtcatggacctcctgtgcaaagaacatgaagcacctgttggtttttcgccctcctgcgtgggtggcagcctcccaggagtcgggcccttcgtcccgaggcgacaaggtgcgaggagtccgggcccgaggacgtggtggacggtcccttaccggtaaacccgtgttccttccttttccgtgctacttcgttctctactcgtccgttccgtccaccgtactccctgcggtcgggcgtcgggccgacccgaacccgagggtagtcgtggaggtggagtacggagtacgttacgtcgttccgggttaccgggtacggggtacttaacgtttacgttaacccctaacccccgttacccgtaaacggaaaccgggtacccgggtacccgtacccgttacgtaaccgggaacggggaacccgaaccgggtaacccgaaaacgggtaaacgttacgttcgtacgtcgttacggttaggtttaccgtacgttcgttacggtaccggacccgtaccgcgtaaccgtaccggtaccggtaccgtttactttcggtttacggtcggtaacggtaaggtaaccgtaaaccgttaccttaccgtttcggtacttcggtccgggtacggggcccgtaacgggtccttcgttccgtaccggactaccgtcgtccttaccggtccgtacccgtccgacccgtaccggtcctccgtttccggtccccgttcccggttcggccctccggcgtccgtaccg

SEQ ID NO: 153421 - DNA, 692 bp, Homo sapiens
  misc_feature: GYAE6OF01DICRA.23.27.C05.1.454.CMB.1.raw
  modified_base (164)..(164): a, c, t, g, unknown or other
  misc_feature (164)..(164): n is a, c, g, or t
  modified_base (206)..(206): a, c, t, g, unknown or other
  misc_feature (206)..(206): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
  modified_base (607)..(607): a, c, t, g, unknown or other
  misc_feature (607)..(607): n is a, c, g, or t
  modified_base (678)..(678): a, c, t, g, unknown or other
  misc_feature (678)..(678): n is a, c, g, or t
  modified_base (683)..(683): a, c, t, g, unknown or other
  misc_feature (683)..(683): n is a, c, g, or t
tcagacgcgagtatcacgaccggtgctcgatttagacgcgatcgaaggggtttgggggagtcagaccctgtcaggacacagcatggacatggacgggtccccgctcagcctccgtggggcctcctgctgctctggcctccgaaggaacgaagggtgtaccgttnagactcgacccgagtcctacccaccccttccgtgtctcgacncgttcgttaggtcggggaacctcgtaccacattccgacgttcgggccgggtacaggtcgtagtacgtttcgtttttcggttcgtttagcgttagtaataaccgaaaactaaacggtggttacccgccctacgcttcgtcgtctagtccacgtagaacgttacgtaacggaaggtccggtacctagtcgaattacgtcgaggtcgacggaggtgggtacggtcgttaaccttcactcgaacacgacgccgtcgactcggcctaggtagtaagttcggtttacgtacttacgttcgtancgttaacgntaacgttaactagtacgtacccgttacgtaccaagttaggtaccgacggtaacggtaactaagttccaccttagaacctcggtaactgggttacncgtacctaccacgttagttccgtgttaccctcgtccttaccacccgttacgtacttaacgacctttaccgngttcnggtcgcggg

SEQ ID NO: 153422 - DNA, 741 bp, Homo sapiens
  misc_feature: GYAE6OF01E27XD.23.27.C05.1.454.CMB.1.raw
  modified_base (97)..(97): a, c, t, g, unknown or other
  misc_feature (97)..(97): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
tcagacgcgagtatcacgaccggtgctcgatttagacgcgatcgaagggtttgggggctctctgagagtcatggacctcctgtgcaagaacatgaancacctgtggttttgcctcctgctggtggcagcctccagatgggccctgcccgaggcgacaacgtgcgaggagtccggggcccaggactggtaggacggtcccttacggaaacccttcgtcttcctttcctgctactcgtctctacgtcgtcctaccgtccacgtacctcccgtggcgtcgggcgttcggaccggaccaacccggagggtacggttcgtagnggtgacgtgganatcgtcgtacggtcggacggtactacttaccgtaccaccgtccgaacgaacggccggcccgacctagtacggacggacgtaggacgtaacgaaaggtaacgtaacttcgtcgtgttacgtagttctacgttctcgaccgcgccgacgacgtacccgtacgttgtttacgttttaagttcggacgtaacgggaaagttaaacccttaaacttacccgtttaacgcgtttacgtccgtccgggggttaccgggacccggtccgtaccttcgttaccgtcggttacctaccgtcgtttcccgtaccgttccggaaccccgaaccgttacccgggaaccgttccccgttacggttcccccgttccccgtttcccggaccgttcccccgtacgtcccgttccgccgggtaaacccg

SEQ ID NO: 153423 - DNA, 831 bp, Homo sapiens
  misc_feature: GYAE6OF01CQ1BS.23.27.C05.1.454.CMB.1.raw
tcagacgcgagtatcacgaccggtgctcgatttagacgcgatcgaagggtttgggggagtcagaccctgtcaggacacagcatggacatgaggtccccgctcagctccgtggggctcctgctgctctggctcccaggaacgaaggtgacgttcagatgacccagtcctccaccctcctgtctgcatctgttacgggacagtacaccatcacgttgccgggacgagtcggtagtaccttagttttccggtttctttagttaccgtggtaacgttaacaaaacgaaaaaccgtacggtttaccgtaccccgttaccgttaccgtccggttacgcttacgtcctaacgtcgaaccgtagttaacgaaacggtacggggtcccaagtacgagtagtacgagtacggacgacgtggacgggttacgggtaaccttttacgtacttaccgttacacgtaacgtcgtaccggtccgtaggtcccgaccgttagtaaacggttagtttttacgggtaaccttttaacgttccgtttaagtccgtaacggtactaaaggttaacttttaacgtaacgttaaccggtaccccgtttaacgaagttaaccgtttttacggggacccgtaaacggggtaacccttaaaagtttcccggaaacgtttaccgaaacgttaaacccgggtaacttcggtaacgggttacctaaccggtacccgttaaacccagtttacccggttacggtttaccccttaacgttaaaccgttcctttacccccgtaccgtaacttcgtaaacgtaaacccgttaacgttccggacttaccggtggtaaaccggggg

SEQ ID NO: 153424 - DNA, 826 bp, Homo sapiens
  misc_feature: GYAE6OF01C64U1.23.27.C05.1.454.CMB.1.raw
  modified_base (336)..(336): a, c, t, g, unknown or other
  misc_feature (336)..(336): n is a, c, g, or t
tcagacgcgagtatcacgaccggtgctcgatttagacgcgatcgaagggtttgggggagtcagaccctgtcaggacacagcatggacatgacgggtccccgctcagctccgtggggcctcctgctgctctggcctaccgagggaacgaagggtcgtacgttcagatcgacccagtcctcccaccctccctgtctgtcatcgttggttggggaccgtacgtaccaaccatcctacgttcggaccgggacgtaggtccgtagtaacttacgttttccggttcttttacgtacgtaggtaactaaccgtaaaactaaaaccggttcggggttttacccnccccgttacccggttccgtaccgtcggtcttacgactaacgtaggaaacgttagttaaaaccggaagggtccgggtaccctaagtcgaaagtcgtttagaggtcggtcgagggtaggtaacgggttacggttaccttttaaccacttctaacaaacgtcgtaccgcccgggtacctcggaccgggtactaagggtaaagttcggttttaccgggtaactttaacttcggtactacggacgtaacgtaagttacgttaacaagttaccgtaccgttaacacgttacggttcggaaccggaacgggtaaacttaaacggttcccgacttaaccgaacgttaccgtaaacgtgggtaccggactacgaccgtaaacttaccgttattcccgttacttaaccgtccgttaccccggtttaacccacgtttaactaacggttaaccggtaaacttacccggcccgtttacggttccggaacgggtaacccggggg

SEQ ID NO: 153425 - DNA, 790 bp, Homo sapiens
  misc_feature: GYAE6OF01DQ6P5.23.27.C05.1.454.CMB.1.raw
  modified_base (325)..(325): a, c, t, g, unknown or other
  misc_feature (325)..(325): n is a, c, g, or t
  modified_base (449)..(449): a, c, t, g, unknown or other
  misc_feature (449)..(449): n is a, c, g, or t
  modified_base (677)..(677): a, c, t, g, unknown or other
  misc_feature (677)..(677): n is a, c, g, or t
tcagacgcgagtatcacgaccggtgctcgatttagacgcgatcgaagggtttgggggagtcagaccctgtcaggacacagcatggacatgagggtcccccgctcagctcctggggcctccctgctgctctggcctcccgagggaacgaagggtgacgttcagatcgacccagtcctcccacccctccctgtcctgctattcgttgggttcggggaccctagtaccaccatccaccgttcggccgggacgtaggtccgtagtacgttacgttttcggtttctttacgtcgtaggtactaccaaaaactaaaaccgtcgggttaccncccccgtaccgtcctcgtcgtctcgtaccacgtcgacgttaagttaacgaaacgggttccgggtacccagtacgaagtcttacggaggtggcgtagggtggtacgggttcgttaaccctttacnctacgaccaacgacgttccggaccgtccgtggacccggtcgtaggtaacgtttaaggttttccggtaacctttcgttccgttgtcgtaagtacctaaagttaccttaacgtaacgttaccgttaccccgtaataaccgttacggtttccgggaacccggtaaggggttaaacctaacggtcctacctaacgtacgtaaacggtacgttcggacggtcctacggtaccncccgttaacgttcttacccggttcttacccgtaaccgtttcccccgttacccgtactaccgttacgtaaacgttacccgttacctccgggtaccgttaggtccgggtacgggg

SEQ ID NO: 153426 - DNA, 438 bp, Homo sapiens
  misc_feature: GYAE6OF01ADOQF.23.27.C05.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (421)..(438): a, c, t, g, unknown or other
  misc_feature (421)..(438): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgcgcagacacggccgtctatttttgngcgaggagaaactactacttcgatctcgtggggccncggcactcctggtcactgtctcctcggcttccaccgaaggcccatcggtccttccccctggccgccctgcctccgaggacgccaccctcggtgggggcaccgacggcgggcccgtgggcctgccttgggtcaaggctaacttccatactcgacgtctgaggcgggctggcaaggcgcagtagnnnnnnnnnnnnnnnnnn

SEQ ID NO: 153427 - DNA, 822 bp, Homo sapiens
  misc_feature: GYAE6OF01AXA5W.23.27.C05.1.454.CMB.1.raw
  modified_base (146)..(146): a, c, t, g, unknown or other
  misc_feature (146)..(146): n is a, c, g, or t
  modified_base (163)..(163): a, c, t, g, unknown or other
  misc_feature (163)..(163): n is a, c, g, or t
  modified_base (588)..(588): a, c, t, g, unknown or other
  misc_feature (588)..(588): n is a, c, g, or t
  modified_base (594)..(594): a, c, t, g, unknown or other
  misc_feature (594)..(594): n is a, c, g, or t
  modified_base (811)..(811): a, c, t, g, unknown or other
  misc_feature (811)..(811): n is a, c, g, or t
tcagacgcgagtatcacgaccggtgctcgatttagacgcgatcgaagggtttggggatgctctctgagagtcatggacctcctgtgcaaagaacatgaacgccaccgttgttggttttcgcctccgtgcgtggtgcagcctccagngtcgggtccctgcccgnggcgacgtaagtcggacgtaggaccggtcccgggacccgaaggtacgtgggcggtaccggtccgttaacccggaaccccttgttccgttcccttaccgcgtaccttaacgttcggttcccttaccgttaacgtttccggttccccgtacccgtaacccgtaccgtaccggttaccccgtcgggtccgggttcggggtccgggttacccggacccggaaccccggaaaccccggggtaagggttaccgggttcgtagtaacggttaggtacggttaggaacgttactacggttccggttaccgggtaacggggtaccggtacttaaccgtttaaccgtaccccgtaaacccgtaccgtaaacggaaccggtcccggaccgtaacccgtaggacggaacggaccgtaacggaacgtaaaggtacgtntaccgngtacctaggttactagtctttcgcgacctccggagtaccgacgacgtacgtcttaacgttgttcggagtaacggaacgtaaacgtactacgtacctagtcgtacgggtccgggtacggaccgtcggtacttaccgtcgtaccgtcgtactcgttccgaacggttcgcctacgacccgcggtaacccttcgttccccgtccgacccgtcgccccgtcncgttcccaagg

SEQ ID NO: 153428 - DNA, 862 bp, Homo sapiens
  misc_feature: GYAE6OF01A6NXG.23.27.C05.1.454.CMB.1.raw
  modified_base (211)..(211): a, c, t, g, unknown or other
  misc_feature (211)..(211): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtgcagctccagatgggccctgtccaggcgcaagtgcaggagtccgggcccaggactggtgacggccttacggaaacctgtctcttcngcactgtctctactcgtccgtccgtcaccgtactcccgtggtcgtcggggtacgttccggggtacccggtacccaaacccccgggtaggggtaacggttccgttaggtaacggtggtagttagggaacgtaagtaccgttcggttccgggttacccgggtaacggggtacctaacttttaaccgttaacccgtaacccccggttaccccttaaacggaaaaccgggtacccgggtcccgtaacccgttaacgtaccgggtaacggggaaccgaaccggtaaccggtaaaacgggaaacggttacgtttacccgtacggtaccggtttacgttaaggtttaccgtaccgtttcgttacgggtacccggtaccccggaccgtaccggaaccggtaacccgtacccggggttcctttacgttttaacggtttttcggacgggtacggtaaacgggtaaacgttaaacccgttacttaaccgttacggttaccgttcggttccgggtacggggtcccgtacggtaacctacggtttccgtacgttacctacgttccgttcccgtccgtacccgttaccgtaccgaacccgaccgggtaccttccgttccggttaccccgttcccggtacgcccgttacccgtcgacccgtacggg

SEQ ID NO: 153429 - DNA, 608 bp, Homo sapiens
  misc_feature: GYAE6OF01AN8TY.23.27.C05.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
  modified_base (429)..(429): a, c, t, g, unknown or other
  misc_feature (429)..(429): n is a, c, g, or t
  modified_base (510)..(510): a, c, t, g, unknown or other
  misc_feature (510)..(510): n is a, c, g, or t
  modified_base (548)..(548): a, c, t, g, unknown or other
  misc_feature (548)..(548): n is a, c, g, or t
tcagacgcgagtatcacgaccggtgctcgatttagacgcgatcgagggtttggggatgctctctgagagtcatggacctcctgtgcaagaacatgaagcacctgtggttttgcctcctgctggtcggcagctcccagatgggcctgtcccaggcgcaagtgcaggagtcggccagactggtgagccttcgaacctgtctctttcngcnctgtctntactgtctccgtcacgatcccngcgtagggctgggtccgccaaccccaggggaacggttcttgacgtgattggagattatctacggtccggttaggggctacttaacttaccgacccgttccgtacaaaacggccgggcccgtaccctatcggacgggtaccacgggaacctaaaggaacgggtattacctcgcttacgaagtttcgctttacngtcgacccgcgcacgacgacgccgttcttagttttgcgtcgaacggacgtaactcgttactcgatccgtcgtcgggcgcgnactcgtagtctacgtcgtactcccgtcgcgttaccccncggaggtcccctacgtcgggtacccctttcccggacgtccctcccgtgtcccgtacccgg

SEQ ID NO: 153430 - DNA, 977 bp, Homo sapiens
  misc_feature: GYAE6OF01EZCFJ.23.27.C05.1.454.CMB.1.raw
  modified_base (164)..(164): a, c, t, g, unknown or other
  misc_feature (164)..(164): n is a, c, g, or t
tcagacgcgagtatcacgaccggtgctcgatttagacgcgatcgaagggtttgggggagtgctctctgagagtcatggacctcctgtgcaagaacatgaagcacctgttggtttttcgccctcctgctggtggcagcctcccagatcgggccctgtcccaggcncaagtcgcgagggacggtccgggcccagggacgtcgggtggacggtccgttaccggaaaacccttcgttccttacctttcctcgctacttcgtctaccttacgtcgtcctccgtccgaccgtacttcccgtggcggtcggggtccgttcggggtaccccgacccgaaccccggtacggggtaacggttcgttacggtaacggttgggtaagttaggtaagtaacgttacgttccggttccgggtaccccgggggttagggtaccttaacgtttaaccgtaacccgtaacccccggttacccgttaaaccggaaaaccgggtccccgggtaccccgtacccgtaacggtacccggtaacggggaaccgaccgggaaccgtaaacggtaaacggttaccgttccgtaccgtcgtttaggttaacgttaccggttacctttccggttcgggtaacccgcccccggtacggaccggtaaccggaacccgggttaccccggttaccggttttaattttcgggtttttaacgggacggttaacgggtaaacggttaaaccctaaaccgtttccgtttaaccgttacgtacgtacccggttaccggggcccgggggtacccgtgggtaccccttaccggtttccgtaccgggtacctaccgtttccggttcccccgtttacccgggtcccggttaccccgttaaccccgaaccggggacccccggttccccgtacccgggtttccccccggtttaccccccgtccccccggggttagacccccccttaccccggggttcctccccggtaaacccccgggg

SEQ ID NO: 153431 - DNA, 870 bp, Homo sapiens
  misc_feature: GYAE6OF01CE2ZI.23.27.C05.1.454.CMB.1.raw
  modified_base (216)..(216): a, c, t, g, unknown or other
  misc_feature (216)..(216): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagcctccagatgggccctgtcccaggcgcaagtgcaggagtccggacccaggactggtgaggtccttcggaaaccctgtctcttcctgcnctgtctctactgtctccgtcaccgatccctgcggtcggggcgtcggggtcccggaccaaaccccggagggtaacgggttcttaggacggttggaggtttacgggagtagtacgttcgttcgggtacccgggttaggggacctaactttaaccgtaaccgtaaccccggttacccgtaacgtaaaaccgggacccgggtcccgtaccccgttaagtaccggaacggggtaaccgaccggaaaccgaaagggtaacggtaactttccgtaccggtacgttaggttacgttttacgacttttaccgtgggtaccgaacccgggtcccgtaacgtacggtaacccgaccggtttacccggttacgttttaacgttttcgggtacgtacgggtaacgggtaaaccgttaaaaccgttacgtttaacccgttaccgtaacgtttccggttaccgggttacccgggggccgtcccggggtacccttaacgggttcccggttacggttaacccgtcggttaccggttccgttccccgtacccgggttcccgttaacccgaaccccgggttaacccggtaccgttcccgggttaccccggttcccccgtttaccccgggcggtccccgtttacccgaccggtacctcccgggacggtaccccg

SEQ ID NO: 153432 - DNA, 537 bp, Homo sapiens
  misc_feature: GYAE6OF01BYBNB.23.27.C05.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (491)..(493): a, c, t, g, unknown or other
  misc_feature (491)..(493): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (501)..(537): a, c, t, g, unknown or other
  misc_feature (501)..(537): n is a, c, g, or t
tcagacgcgagtatcacgaccggtgctcgatttagacgcgatcgaagggtcttgagtggattgggagatatctgtcccggtaggggcacttattacaacccgtccctcaaaagacgggccgccctatcaggggacacggccaagaaggaattctcgctgagtttgacttctgtgaccgccgcagacaccggccgttcttattttttgngcgaggagaaactactacttcgatcctcgtggggccncggcattcctggtccactgtcctccgcggcttccacgaagggcccagtccggtccttcccccgnggcccgcccctgcctccgaggacaccacccgtcggtgggggacctacgacggccggtcccgtgggccgtcgtccgttggtaccgaaacgggacccttaccttccaacttccgtccggccgttcgacggacgggcggggtccgtaggaccgaacgggccgacagttacgnagctagngtcncnnncgncantnnnnnnnnnnnnnnnnnnnnnnnnnnnnnnnnnnnnn

SEQ ID NO: 153433 - DNA, 862 bp, Homo sapiens
  misc_feature: GYAE6OF01D62KM.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtccgaggcgcaagtgcaggagtccggcccaggactggtgacggtccttacggaaacccttgttccttctttccgtgcctacttcgttcctccttacttcgtcctccgtccaccgacttcccgtggtcgtggggccgttcgggtcccggacccgtaaccccgtaaggggtaaggttccttaggtaggtcggtagttagggaattacgttagtccggttcgggtaccggggtacgggtccttaacgtttaactacccgtaaccccgtacgtaacgaaacgggccggcccgtaaccgtagtaccggaacggggaccaaccggaacgaaacggaaagttcttcgtacggtctacggttacgttcgtaacgttcgtcggtaccgtacccggtcgaccgtaaccggacccggtaccgggtttacgtttacgttttaaggttttacggagggtaacccggtaagggtaaacctttaaccgttaaccgttttacgtttacccggtaacgtttccggttccgggtaaccgggggtcccgaaccggggttccttaaccggggttccgtttaaccggttccttaaccggtttccggttcccgtccggttacccggttaccccgtaccccgtaaaccgggtaacccggttacccgttacccggtttccccggttaccccgttccccggaccgtcccggtacccctgtacccgtacggaccggttacccg

SEQ ID NO: 153434 - DNA, 683 bp, Homo sapiens
  misc_feature: GYAE6OF01CWZ1O.23.27.C05.1.454.CMB.1.raw
  modified_base (97)..(97): a, c, t, g, unknown or other
  misc_feature (97)..(97): n is a, c, g, or t
  modified_base (207)..(207): a, c, t, g, unknown or other
  misc_feature (207)..(207): n is a, c, g, or t
  modified_base (523)..(523): a, c, t, g, unknown or other
  misc_feature (523)..(523): n is a, c, g, or t
  modified_base (541)..(541): a, c, t, g, unknown or other
  misc_feature (541)..(541): n is a, c, g, or t
  modified_base (581)..(581): a, c, t, g, unknown or other
  misc_feature (581)..(581): n is a, c, g, or t
  modified_base (624)..(624): a, c, t, g, unknown or other
  misc_feature (624)..(624): n is a, c, g, or t
tcagacgcgagtatcacgaccggtgctcgatttagacgcgatcgaagggtttggggagtcagaccctgtcaggcacagcatggacatgaggtcccgntcagctccgtgggctcctgctgctctggctccaagggacgaaggtcgacgttcagactgacccagtctccctacctcccgtgtctgcctattccgtaggttcggggaccngtaccaccatcgtacgttcggccgggtactagtcggtactacgttacgttttcggttactttgtccgtaaggtataccaaaacgtaaaacctcgggttcaccccgtacgttcctcgtctcgtgtcaacgtgtactagtttacgaaacgtcgggtaaccctgtaccgtagtacttacggagtcggagtcgtaggtacgtcggttactttcgacgttactacgaaccgtacgtccggacggttcaacggtccgtactggtaaacggttcgttttaccgggattttcccgttagttcgtactacggtactagtacttanaacgttaccgtcccgtanacgttacgtcgtaccgaacgggtacctaagtacgtcctanacgtacgtaacttcggactcgactctaccgtctctaccggttntacctgtacccttccggccttaacgcgtacctaaatcctacggttcgttgaaggtcccg

SEQ ID NO: 153435 - DNA, 855 bp, Homo sapiens
  misc_feature: GYAE6OF01EEYYZ.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaacctgtctctttctgcactgtctctactgtcctccgtcaccgactccctgcgtggggcgtcgggtccggaccaaccccggaggggaacgggtcgttaggaggtggtagttggagtatagtcgtcgggtacccgggtaggggtactaacgttacttaacccgtaaccccgtccctaacgaaaacggaccgggccctacccgtacgtacggacggggaccgaacggaccgaaaaggtaacggtaactttaccgtacgtcgttaggttaacggtttacgtaccgtttacgtcggtaccggacccggccgtaccgaacggtaaccgtaccgggttcccgtttacgttttagttttttacgggaggtaaccgggtaaacgggtaaacgttaaaacccgtttaccgttaaccgttttaccgtaacgtttcccggtaccggggttccgggggaccccggtacgggtaccttaaccggttcccgttcgggttacccttaacggttcccgttcccgttaccccgttccgggttaccccgttaaccccggaacccgggtaaacccggggtcccccttaaccgggtttccccccgggtttaccccctttacccccccgggtcgggtaccccccgttccccggttacccggtcccgttaacccccgggg

SEQ ID NO: 153436 - DNA, 623 bp, Homo sapiens
  misc_feature: GYAE6OF01C4C5P.23.27.C05.1.454.CMB.1.raw
  modified_base (155)..(155): a, c, t, g, unknown or other
  misc_feature (155)..(155): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
  modified_base (568)..(568): a, c, t, g, unknown or other
  misc_feature (568)..(568): n is a, c, g, or t
  modified_base (574)..(579): a, c, t, g, unknown or other
  misc_feature (574)..(579): n is a, c, g, or t
  modified_base (582)..(582): a, c, t, g, unknown or other
  misc_feature (582)..(582): n is a, c, g, or t
  modified_base (584)..(623): a, c, t, g, unknown or other
  misc_feature (584)..(623): n is a, c, g, or t
tcagacgcgagtatcacgaccggtgctcgatttagacgcgatcgaagggtcttgagtggattggagatatctgtcccggtagggcacttattaccacccgtccctacaaaagccggcccgccctatcgaggggaccacggaccaaggaagattcncgctgagtttgacttctgtcgacccgccgnacgaccgacggccgttctttatttttgngacggaaggaactaaaccttacgttacttcgatccgtcggtacggggcccgacggctactccgtaggtcctaccgttcgtccttccgtccggtccttacccgaaccggaacgggcccctacgttccccggttccccttccccccgtcggggacccctccccgtccgttacccgaccgaagggtcccgtaccctacccggtccggggtaccgggggtaccaccgtacgggcccccggtcccgtacgggggccttcggtaccccgttgggttaaaccaagggtacccctttaaccttccggaacctaccggttcgtccgttcgtggacgggccgggttggacgtcgaacggccgtanagtacnnnnnntgntnnnnnnnnnnnnnnnnnnnnnnnnnnnnnnnnnnnnnnnn

SEQ ID NO: 153437 - DNA, 558 bp, Homo sapiens
  misc_feature: GYAE6OF01BJLKQ.23.27.C05.1.454.CMB.1.raw
  modified_base (205)..(205): a, c, t, g, unknown or other
  misc_feature (205)..(205): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (505)..(506): a, c, t, g, unknown or other
  misc_feature (505)..(506): n is a, c, g, or t
  modified_base (509)..(513): a, c, t, g, unknown or other
  misc_feature (509)..(513): n is a, c, g, or t
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
  modified_base (520)..(520): a, c, t, g, unknown or other
  misc_feature (520)..(520): n is a, c, g, or t
  modified_base (523)..(525): a, c, t, g, unknown or other
  misc_feature (523)..(525): n is a, c, g, or t
  modified_base (528)..(529): a, c, t, g, unknown or other
  misc_feature (528)..(529): n is a, c, g, or t
  modified_base (533)..(537): a, c, t, g, unknown or other
  misc_feature (533)..(537): n is a, c, g, or t
  modified_base (539)..(542): a, c, t, g, unknown or other
  misc_feature (539)..(542): n is a, c, g, or t
  modified_base (544)..(551): a, c, t, g, unknown or other
  misc_feature (544)..(551): n is a, c, g, or t
  modified_base (553)..(558): a, c, t, g, unknown or other
  misc_feature (553)..(558): n is a, c, g, or t
tcagacgcgagtatcacgaccggtgctcgatttagacgcgatcgaagggtcttgagtggattggagatatctgtcccggtaggggcacttattacaacccgtccctcaaaaagacgggccgccctatcaggggacacggccaagaaggaattctcgctgagtttgacttctgtgaccgccgcagacacggccgtcttatttttgngcgaggagaaactactacttcgatctcgtcggggccgcggcattccgtggtcacttcgtcctccgtcggccttccaaccgaacgggccctacgtccggttcccttccccgtggccgcccgtgtcctccgaggacgccaccgtcggtcggggccacgacggtccggccgtgggcctcgtcccgtggtaccgaacggtaccttaccgttaccacgttaccgtccgtaccgttcgtaggacgggcccgggtacgtacgggtaccgaaacggccggtacaacgttacggntagcntgacncgtnncannnnncncnncncgnnncgnnctcnnnnngnnnngnnnnnnnncnnnnnn

SEQ ID NO: 153438 - DNA, 878 bp, Homo sapiens
  misc_feature: GYAE6OF01A070G.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatcgggccctgtcccaggcgcaagtgcgaggacggtcgggcccaggacgtggtgaggtccttacggaaaccctgtccttctttcctgcactgtctctacgtcgtcctccgtccaccgactccctggcggtcggggcgtcggggtcccgacccgaaccccggaggggtaacggttcgttaggacgtggtagttggaagtattctcggtcgggttaccccggggtagggtaccttaaccgtttaacgttaaccccgtaacccccggttacccgtaaaccggaaaaaccgggaccccggggtaccccggtaccccgttaacggtaccgggaacgggggtaacccgaaccgggaacccgtaaaaggtaaacggttaactttccgtacgtacggttcggttaacgtttacgtaccgtttcgtacgtaccggaacccgtccggtaacgaacgtaccggtacccggtcccgtttagttttcgttttacggcggtaacggtaacggaaacgttaaacccgtttacttacgttaccgtcgttccggttccgggtacggggcccgtaccgggtacctcggtttacccggtcggttacctccgttacgttcccgttacccgtccgggtaacccttaaccccggtaaaccgggtcccggtcccttaaccggtttccccgggttacccccttcccccgggttaccggacccccggttccccggccgtaccccggtaacgggtcccgggtaacccgg

SEQ ID NO: 153439 - DNA, 1091 bp, Homo sapiens
  misc_feature: GYAE6OF01BDEGC.23.27.C05.1.454.CMB.1.raw
tcagacgcgagtatcacgaccggtgctcgatttagacgcgatcgaagggtttggggatgctctctgagagtcatggaccctcctgtgcaagaacatggaagcaccgtggttggtttttcgcccttcctgcgtgggtggcagcctcccgagagtcgggtccctcgtcccgagggcgacaaggtgacgaagggacggtccgggcccgaggtacgtgggtggacggtacccgttaccggtaaacccgttcgttccttcctttcctcgcctacgttcgttccttaccttaccttcgttcccgttacccggtaccacccgtaccttcccgtggtccggtccgggggtccgttccggggtccccggaccccaacccccgggaggggttagggtccgttagggtacgtagggtagtgggaagtacgttacgttcggttacgggttaccccgggggttaaggggtaccttaaccgtttaaccgtttaaccccccgtaaaccccccggtttaccccgtaaaaccgggaaaaaccggggtacccccggggtaccccggttaacccccgttaaccggtaacccggggtaaaccggggggaaacccggtaaaccccgggggtaaaccccgtaaaaaggggtaaaacccggttaaacgtttccccggttaccggttaccggttaaccggttttacgggtttaccgttaaacgttttcccggttacggtacccgggtaccccggtacccggtaccggaaccccgtacccgggttaaccccggttacccggttttaacgttttaccgggttttaggttaccggtacggggttaaacgggtaaacgttaacccgtttaaaccggtttaccgttaccggttaccgtttaccgggttccgggttacccgggggtacccccggtccgggtacccttaccgggtttccgtaccccggttaccttcccgggttacccgtttcccgtcccggttacccgggttaccccgttaaccccggtacccggtaccccgggtacccgttacccggttacccggtttccccccgttacccgggttcccggtacccgtccccgtcgtcccggtaaccccgg

SEQ ID NO: 153440 - DNA, 923 bp, Homo sapiens
  misc_feature: GYAE6OF01EPRVV.23.27.C05.1.454.CMB.1.raw
  modified_base (221)..(221): a, c, t, g, unknown or other
  misc_feature (221)..(221): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccgagagtcgggccctgtcccgaaggcgacaagtgcgagggacgtccgggcccaggactggtgacgtcctacggaacctgtctcttcngctactgtctctactcgtcctccgtcaccgactcccgtgtcgtcgggtcgtccgggtccggacccaacccccggtaggggacggttcttagggacggtcggtagttcgggaatacgttacgtaccgttcgggttacccgggggtacggggtaccttaaccggtttaacctttaaccccgtaaacccccgttacccgtaaaccggaaaaccgggtaccccgggccccgtacccgtaacggttaccggaaccgggggtaaccgaacccggggaacccgtaaagggtaaacgggtaacctttcccggttaacgtaccggttacggttaacggttttaccgtacccgttttacggtaccgggttaacccgggacccccggttacccggaaccgtaacccggggaaccccgttacccgggttacccgttttaccgttttacgggttttttaccggacgggtacgggtaaaccggtaaaaccttaaaacccggttaccttttaacggttacccggtacctttacggggtccggttcccggggggtacccgaccggtacccgtttaccgtccgggtttcccggaccgtttccgtcccgttaccgttcccggttaccctcccggtttaccccggaaccggtaccgggtccctaccgggttcccccgttacccgttccccgcggtcccctcccgtcggtccccgtaacggg

SEQ ID NO: 153441 - DNA, 811 bp, Homo sapiens
  misc_feature: GYAE6OF01B8A3N.23.27.C05.1.454.CMB.1.raw
  modified_base (85)..(85): a, c, t, g, unknown or other
  misc_feature (85)..(85): n is a, c, g, or t
  modified_base (219)..(219): a, c, t, g, unknown or other
  misc_feature (219)..(219): n is a, c, g, or t
  modified_base (302)..(302): a, c, t, g, unknown or other
  misc_feature (302)..(302): n is a, c, g, or t
  modified_base (656)..(656): a, c, t, g, unknown or other
  misc_feature (656)..(656): n is a, c, g, or t
tcagacgcgagtatcacgaccggtgctcgatttagacgcgatcgaagggtttgggggctctctgagagtcatggacctcctgtgnaagaacatgaagcacctgtggtttgcctcctgctggtggcagcctcccagatcgggccctgtccccaggcgtcaagtgacagggacgtcgggcccaggactggtgacggtccttacggaacctgttctacttcngcacgtgtccttctactcgtcctccgtcaccgtactccctgcggtgggtcctcggtccggaccgaacccgtagggtaacggtnttaggacggttggacgttcgggaattactacgttcgtacccgggtaccggggtacgggtacctaacggtttacctaacccgacccgttcccgtaagaaaaccgggtccggtacccgccgtaacgtcggtaaacgggggaccttaaccggggaaacccgtaaagggtaaaccggttacgttacccgttaccggtaccgttaggttccggtttaacgtaccgttttccgtacgggtaccgtaccccggccgtacgtaaccgggacccggtccgttaccggttctttacgttttacggcggttaacggaacgggtaaacgttaaccgtaaccgtagtttcgtacgttcgttaccggnggggtacccgtcggaccgtcgttaaccggttcgcccgttacgtccggtacctttcccggtaccgtccgttaaccccgaacgaaccggttcccctacggtttcccccgttcggtacccccgttcggcccttccgtaccgtcggtaccgcgtcccgg

SEQ ID NO: 153442 - DNA, 739 bp, Homo sapiens
  misc_feature: GYAE6OF01BTZUK.23.27.C05.1.454.CMB.1.raw
  modified_base (101)..(101): a, c, t, g, unknown or other
  misc_feature (101)..(101): n is a, c, g, or t
  modified_base (413)..(413): a, c, t, g, unknown or other
  misc_feature (413)..(413): n is a, c, g, or t
  modified_base (675)..(675): a, c, t, g, unknown or other
  misc_feature (675)..(675): n is a, c, g, or t
tcagacgcgagtatcacgaccggtgctcgatttagacgcgatcgaagggtttgggggagtcagaccctgtcaggacacagcatggacatgagggtccccgntcagctcctggggctcctgctgctctggctcccaaggaacgaagggtgacgttcagatgacccagtcctccaccctccctagtctgcatctggttcggggaccagtcaaccatcacttcgccgggtcgaggtcgtgactatttttcgggttatttacgtcgttggtactacaaaacgtaaaaacctcggggtttcacccctaccgttcctaccgtcgtctacgtcactgaacgagttaaccgaaaggtcggggtacccagtcgaacgtattacgaggtggactaggttggaggtcggtacctttacatctanacaagtcgccgtctaggccgcgtagtaacgtagttttacggtactttacgttcgtgtaccgtagtacgtaacgtttaattaacgtagttaaccggtacccttaaccgtacgtaagtttaccgggacggtaaccggggtaaaccttaaacggttccgtaacccgtacaacgttaaccggtaaaccgttgttacggtacacggtaccctaacgtaccgttccttaacgttcccttaccgttaaccttaccccggttttcccccnctaacgttccctaaagttaaccttaccgttaacccggtccttaaccggtgggtaaacccggggg

SEQ ID NO: 153443 - DNA, 872 bp, Homo sapiens
  misc_feature: GYAE6OF01D6VXN.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgttggttttgcctctgctggtggcagctccagagtcgggccctgtcccgaggcgcaagtgcgaggagtccgggcccaaggcgtggtggacggtcccttacggaaaccctgttccttcctttcctgctacttcgtcttcgttacttcgttccgtccgtccgaacccgtcttcccctggtcggtcggggtccgttccggggtaccccggacccgaaacccccggtaagggggtaacggtttcgttacggtaggttgggtagttgggtaagtagttcggtccggttccgggttaccccgggggtacggggtaccttaaccgttttaacgttaaccccgtaacccccggttacccgtaaacgaaaacgggtcccgggtaccccgtaccttacggaccggaaccgggggaaccgaccggaaccgaaaggtaaacggttacttaccgtcgtaccgttagttacgtttacgttactttccgtacggtccgtacccgaccggtacgtaacgtacccggtaccgggttccgttacgttttagttttacggtacggtacgggtaaagtaaaccgtaaaccttaccgtttaagtccgttacgtccggttccggtacggggcccgtacggtacctcgttccgtacggttacctacggttccgtcctttacccggtcgttaccccgtacccggtaaccggtaacccggtcccttaaccggttccccggtttacccccgttccccggtacgggccccttccccggtcgtcccgtaacccggg

SEQ ID NO: 153444 - DNA, 648 bp, Homo sapiens
  misc_feature: GYAE6OF01AXZ6T.23.27.C05.1.454.CMB.1.raw
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
  modified_base (634)..(634): a, c, t, g, unknown or other
  misc_feature (634)..(634): n is a, c, g, or t
  modified_base (643)..(643): a, c, t, g, unknown or other
  misc_feature (643)..(643): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatcgggccctgtcccaggcgcaagtgcaggacgtccgggccaggactggtgaggccttacggaaaccctgtccttctttccgtgctacgtcgtctctactcgtcctccgtcaccgatccccgtgcgtgggctcgggtccgccaaccccgagggtaggtctagnggtggtgttggagatatcgtcggtccggtagggctacttactaccacccgttaccacgaaaacgcgggccncccgttagcggacgggcacggccaaaggacgattccncgcgtgtactttcgacttcgtgcgacccgccgacacgtaccgacggtccgtgtttagtttcggtcggtacgaaggtaccgtaaacttacgtacgttcgacgtcgtcggtacgggccggtccgtactacgttccggtagtccgtacgtcgttcctccgtaaccgttccgtacccgaccgaaccggtccctacgttcccgttaccccgtcccgtacggtccccgtccncggttaccnccggg

SEQ ID NO: 153445 - DNA, 238 bp, Homo sapiens
  misc_feature: GYAE6OF02GJGIM.23.27.C05.1.454.CMB.1.raw
  modified_base (219)..(238): a, c, t, g, unknown or other
  misc_feature (219)..(238): n is a, c, g, or t
tcagacgcgagtatcacgaccggtgctcgatttagacgcgatcgaagggtttgggggaagaggaagactgacggtcctcccaggagttcaggtgctgggcaccttgggcacgggggaggtgtgtcacaagatttgggctctgggcacagcggccctgggactgcctggtcaaggactacttccatactcgcgtctgagcgggctggcaaggcgcatagnnnnnnnnnnnnnnnnnnnn

SEQ ID NO: 153446 - DNA, 527 bp, Homo sapiens
  misc_feature: GYAE6OF02I87US.23.27.C05.1.454.CMB.1.raw
  modified_base (353)..(353): a, c, t, g, unknown or other
  misc_feature (353)..(353): n is a, c, g, or t
  modified_base (458)..(458): a, c, t, g, unknown or other
  misc_feature (458)..(458): n is a, c, g, or t
tcagacgcgagtatcacgaccggtgctcgatttagacgcgatcgaagggtttggggagtcagaccctgtcaggacacagcatggacatgagggtccccgctcagctcctggggctcctgctgctctggctcccaggacgaggtgacgttcgagagtgaaccgagtctccaccctccctgtctgcatctgttggggaccagtcaccatcacttgccgggcagtcgtgacattttcggtctttagtctggtatcaacaaaaccagggtttgcccctaccgtcctcgtcgctgtcacagacgagttacaaagtggggtccaatcgagattcagtggcagtggaggtggacctttanactctcacaatcgcggctgcggcctgaagattttgggacttacttctgtcagtcagtattacatagtcccgtacacatttggccaggggaaccaaagttgacctnatacgaactgtgctgcacatctgtcttcattcttacccgccattctacgaattcctacgcgtctgacgg

SEQ ID NO: 153447 - DNA, 404 bp, Homo sapiens
  misc_feature: GYAE6OF02G3UKD.23.27.C05.1.454.CMB.1.raw
  modified_base (238)..(238): a, c, t, g, unknown or other
  misc_feature (238)..(238): n is a, c, g, or t
  modified_base (399)..(404): a, c, t, g, unknown or other
  misc_feature (399)..(404): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttccccctggcgccctgctccaggagcacctctgggggcacagcggccctgggctgcctggtcaaggactacttccatactcgcgtctgagcgggctggcaaggcgcatagnnnnnn

SEQ ID NO: 153448 - DNA, 159 bp, Homo sapiens
  misc_feature: GYAE6OF02GZL6B.23.27.C05.1.454.CMB.1.raw
  modified_base (158)..(159): a, c, t, g, unknown or other
  misc_feature (158)..(159): n is a, c, g, or t
tcagacgcgagtatcacgaccggtgctcgatttagacgcgatcgaagggtttggggaggtgtgtcacaagatttgggctctgggcacagcggccctgggctgcctggtcaaggactacttccatactcgcgtctgagcgggctggcaaggcgcatagnn

SEQ ID NO: 153449 - DNA, 534 bp, Homo sapiens
  misc_feature: GYAE6OF02GBEUS.23.27.C05.1.454.CMB.1.raw
  modified_base (468)..(468): a, c, t, g, unknown or other
  misc_feature (468)..(468): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgacattttcggttctttagtctggtatcaacaaaaaccagggtttgcccctaccgtcctcgtcgctgtcactgacgagttacaaagtggggtcccatcgagattcagtggcagtggaggtgggaccttttacactctcacaatcgccggctgcggcctgaagtattttgggactttcttctgtcagctagtattacatacgtcccgtacactatttggcctaggggaccaaagttgacctnatacgaactgtgctgcacatctgtctcattccttcccgctatctgaacttacctcgcgtctgacgg

SEQ ID NO: 153450 - DNA, 537 bp, Homo sapiens
  misc_feature: GYAE6OF02IO982.23.27.C05.1.454.CMB.1.raw
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (438)..(438): a, c, t, g, unknown or other
  misc_feature (438)..(438): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgactattttcggttctttagtctggtatcaaacaaaaaccagggtttgcccctaccgtcctcgtcgctgtcactgacgagttacaaagtggggtcccatcgagattcagtggcagtggaggtgggaccttttanactctcacaatcgccggctgcggcctgaagtnttttgggactttacttctgtcagcagtattacatacgtcccgtanactatttggaccaggggaccaaagttcgacctcatacgaactgtgctgcaccatctgtcttcattccttcccgctatctgaactcctcgcgtctgacgg

SEQ ID NO: 153451 - DNA, 600 bp, Homo sapiens
  misc_feature: GYAE6OF02IAXG2.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctgggctgggtccgcaacccccagggaggtcttgagtggattggagatatctgtcccggtaggggcacttattacaacccgtccctacaaaacggacgggccgccctagtcgaggggacacggccaagaaggaatctcgctgagtttgactttctgtcgaccgccgcgagacacggccgtctagttttgtgcgaggagaaactactacttcgatctcgtggggccgcgggcacgttccgtgggtccacgttgtccttccgtccggtcctttcccgaacccgtaacggggacccctacgttcccgggttccctttccccccggtggcccgtccccgttcggtcctaccccgg

SEQ ID NO: 153452 - DNA, 637 bp, Homo sapiens
  misc_feature: GYAE6OF02J184O.23.27.C05.1.454.CMB.1.raw
  modified_base (148)..(148): a, c, t, g, unknown or other
  misc_feature (148)..(148): n is a, c, g, or t
  modified_base (270)..(270): a, c, t, g, unknown or other
  misc_feature (270)..(270): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtnacgttcagatgacccagtctccacctcctgtctgcatctgttggggaccgagtcaccatcacttgccgggcagtcgtgacattttcggtctttagtctggtatcaacaaaaaccagggtttnccctacgtcctcgtcgctgtcactgacgagttacaaggtgggtcccatcgagattcgaggtggcaggtggaggtggtaccttttacgactctcaacatcgccggctgcgctgaagtagtttgggactttacgtctgtcagctagtattaacagtacgtacccgtacactatttcggaccgtaaggggtaaccctaaaggttcgaaccgttacaacttaacgtaaacgttggtacgggtacttacggtaccaaaccgtaacgttccgttacggttaccgtttaccgtaacgtttcccgttacccggtaccctaacgtttccgtacgttaaccgttaccgttccggtaccgtttccgtaggtacccggg

SEQ ID NO: 153453 - DNA, 540 bp, Homo sapiens
  misc_feature: GYAE6OF02H5P1A.23.27.C05.1.454.CMB.1.raw
  modified_base (350)..(350): a, c, t, g, unknown or other
  misc_feature (350)..(350): n is a, c, g, or t
  modified_base (525)..(525): a, c, t, g, unknown or other
  misc_feature (525)..(525): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgagggaaggtctgagtggattggagatatctgtcccggtaggggcacttattacaaccgtccctacaaagcgggccncctatcaggggacacggccaagaaggaattctcgctgagtttgactttctgtgaccgccgcagacacggccgtctatttttgtgcgaggagaaactactacttcgatctcgtcgggccgcggcagtcctggtcactgtctctcgcttccacacgggcccatccggtcttccccgngcccgcctcgctccg

SEQ ID NO: 153454 - DNA, 542 bp, Homo sapiens
  misc_feature: GYAE6OF02HUAYD.23.27.C05.1.454.CMB.1.raw
  modified_base (349)..(349): a, c, t, g, unknown or other
  misc_feature (349)..(349): n is a, c, g, or t
  modified_base (428)..(428): a, c, t, g, unknown or other
  misc_feature (428)..(428): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgagggaaggtcttgagtggattggagatatctgtcccggtaggggcacttattacacccgtcctacaaagacggccncctatcagggacacggccaagaagaatctcgctgagtttgactttctgtgaccgccgcagacacggccgtctattttgngcgaggagaaactactacttcgattctcgtggggccgcggcatccgtggtcactgtctctcggcttccaccacggcccagtccggtccttccccgtggcccgtccctgcctccg

SEQ ID NO: 153455 - DNA, 583 bp, Homo sapiens
  misc_feature: GYAE6OF02IJNZG.23.27.C05.1.454.CMB.1.raw
  modified_base (363)..(363): a, c, t, g, unknown or other
  misc_feature (363)..(363): n is a, c, g, or t
  modified_base (390)..(390): a, c, t, g, unknown or other
  misc_feature (390)..(390): n is a, c, g, or t
  modified_base (433)..(433): a, c, t, g, unknown or other
  misc_feature (433)..(433): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcgagatgacccagtctccaccctcctgtctgcatctgttggggaccgagtcaccatcacttgccgggcgagtcgtgactattttcggttctttagtctggtatcaacaaaaaccagggtttgcccctacgtcctcgtcgctgtcactgacgtagttacaaagtcggggtcccatcgagattcagtggcagtggaggtgggtaccttttanactctcacatcgcggctgcgctgagtnttttgggacttacttctgtcagcagtattacatagtcccgtanactagtttggaccaggggtaaccaaaggttcgaccttcaagttaaccgaacttggtcgactcggacaccctattacctgttactttccaattccctttccccgccttacgtccttacggaacttaccgtcggaccgttcgtagtaccggg

SEQ ID NO: 153456 - DNA, 544 bp, Homo sapiens
  misc_feature: GYAE6OF02F7BHJ.23.27.C05.1.454.CMB.1.raw
  modified_base (431)..(431): a, c, t, g, unknown or other
  misc_feature (431)..(431): n is a, c, g, or t
  modified_base (531)..(531): a, c, t, g, unknown or other
  misc_feature (531)..(531): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccagggaaggtcttgagtggattggagatatctgtcccggtagggcacttattacaacccgtccctcaaaagacggccgcctatcaggggacacggccaagaaggaattctcgctgagtttgactttctgtgaccgccgcagacacggccgtcttattttgngcgagagaaactactacttcgatctctgggccgcggcagtcctggtcactgtcctctcggcttccaccaacgggcccagtccggtccttccccgtggccncccgtgcctcccg

SEQ ID NO: 153457 - DNA, 456 bp, Homo sapiens
  misc_feature: GYAE6OF02ILD4Y.23.27.C05.1.454.CMB.1.raw
  modified_base (238)..(238): a, c, t, g, unknown or other
  misc_feature (238)..(238): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
  modified_base (438)..(456): a, c, t, g, unknown or other
  misc_feature (438)..(456): n is a, c, g, or t
tcagacgcgagtatcacgaccggtgctcgatttagacgcgatcgaagggtcttgaatggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncgggcatcctggtcaactgtctcctcggcttccaccaagggccccagtcggtcctccccgtggccnccctgcctaccgaggancctacctccgtggggaccaacnggccggtcccgtgggcctcgccgtcggtagaacggaccttacttccaatacctcggcctctgaggccgggcgtaggccgaaaggccacgtatagnnnnnnnnnnnnnnnnnnn

SEQ ID NO: 153458 - DNA, 566 bp, Homo sapiens
  misc_feature: GYAE6OF02I26TY.23.27.C05.1.454.CMB.1.raw
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctgggctgggtccggcaaccccgagggaaggtctgagtggattggagatatctgtccggtagggcacttactacaacccgtcctacaaaacgacggccgcctatcgaggggacacggaccaagaaggaattcgtacgctgtagtttgactttctgtcgaccgcgcagacacggcgtntattttgngcgagagaactactacttcgatctcgtggggcccgcggctactccgttgtcctactcgtcctccgtcgcttcccaaccgacgggcccacgttccggtccctttccccggtggcccgcccgttcgcctacccgg

SEQ ID NO: 153459 - DNA, 533 bp, Homo sapiens
  misc_feature: GYAE6OF02JCJ9L.23.27.C05.1.454.CMB.1.raw
  modified_base (432)..(432): a, c, t, g, unknown or other
  misc_feature (432)..(432): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgacattttcggttctttagtctggtatcaaacaaaaaccagggtttcgcccctaccgtcctcgtcgctgtcactgacgagttacaaagtggggtcccatcgagattcagtggcagtggaggtgggaccttttacactctcacaatcgccggctgcgctgaagattttgggcttacttctgtcagcagtattacatagtcccgtanactatttggccaggggaccctaaagttcgacctcatacgaactgtggctgcacatctgtcttcattccttcccgctatctagactactcgcgttctgacgg

SEQ ID NO: 153460 - DNA, 400 bp, Homo sapiens
  misc_feature: GYAE6OF02IQY5F.23.27.C05.1.454.CMB.1.raw
  modified_base (238)..(238): a, c, t, g, unknown or other
  misc_feature (238)..(238): n is a, c, g, or t
  modified_base (391)..(391): a, c, t, g, unknown or other
  misc_feature (391)..(391): n is a, c, g, or t
  modified_base (397)..(400): a, c, t, g, unknown or other
  misc_feature (397)..(400): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaaggcccatcggtcttccccctggcgccctgctccaggagcacctctgggggcacagcggccctgggctgcctggtcaaggactacttccatactcgcgtctgagcggctggcaaggcncatagnnnn

SEQ ID NO: 153461 - DNA, 402 bp, Homo sapiens
  misc_feature: GYAE6OF02GSNLK.23.27.C05.1.454.CMB.1.raw
  modified_base (400)..(402): a, c, t, g, unknown or other
  misc_feature (400)..(402): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctctgggggcacagcggccctgggctgcctggtcaaggactacttccatactcgcgttctgagcgggctggcaaggcgcatagnnn

SEQ ID NO: 153462 - DNA, 551 bp, Homo sapiens
  misc_feature: GYAE6OF02HTLPG.23.27.C05.1.454.CMB.1.raw
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
  modified_base (536)..(536): a, c, t, g, unknown or other
  misc_feature (536)..(536): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccagggaagggtcttgagtggattggagatatctgtcccggtaggggcacttattacaacccgtccctcaaaagacggccgccctatcaggggacacggccaagaaggaattcgtcgctgagtttgactttctgtgaccgccgcagacacggccgtctattttgngcgaggagaaactactacttcgatctctggggccncggcatcctgggtcacttgtctcctcggcttcccgaccaacgggcccagttccggtcttcccccgnggccgccctgctccg

SEQ ID NO: 153463 - DNA, 406 bp, Homo sapiens
  misc_feature: GYAE6OF02I7QE4.23.27.C05.1.454.CMB.1.raw
  modified_base (238)..(238): a, c, t, g, unknown or other
  misc_feature (238)..(238): n is a, c, g, or t
  modified_base (399)..(406): a, c, t, g, unknown or other
  misc_feature (399)..(406): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaaggcccatcggtcttccccctggcgccctgctccaggagcacctctgggggcacgagcggccctgggctgcctggtcaaggactacttccatactcgcgtctgagcgggctggcaaggcgcatagnnnnnnnn

SEQ ID NO: 153464 - DNA, 408 bp, Homo sapiens
  misc_feature: GYAE6OF02JV0YL.23.27.C05.1.454.CMB.1.raw
  modified_base (238)..(238): a, c, t, g, unknown or other
  misc_feature (238)..(238): n is a, c, g, or t
  modified_base (398)..(408): a, c, t, g, unknown or other
  misc_feature (398)..(408): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaaggcccatcggtcttccccctggcgccctgctccaggagcacctctgggggcacagcggccctgggctgcctggtcaaggactacttccatactcgcgtctgagcgggctggcaaggcgcatagnnnnnnnnnnn

SEQ ID NO: 153465 - DNA, 188 bp, Homo sapiens
  misc_feature: GYAE6OF02H60QN.23.27.C05.1.454.CMB.1.raw
  modified_base (188)..(188): a, c, t, g, unknown or other
  misc_feature (188)..(188): n is a, c, g, or t
tcagacgcgagtatcacgaccggtgctcgatttagacgcgatcgaagggtttggggaggtgtgtcacaagatttgggctctgggcaccgtgggcacgggggaggtgtgtcacaagatttgggccctgggctgcctggtcaaggactacttccatactcgcgtctgagcgggctggcaaggcgcatagn

SEQ ID NO: 153466 - DNA, 542 bp, Homo sapiens
  misc_feature: GYAE6OF02IU01P.23.27.C05.1.454.CMB.1.raw
  modified_base (435)..(435): a, c, t, g, unknown or other
  misc_feature (435)..(435): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgacattttcggttctttagtctggtatcaacaaaaaccagggtttgcccctaccgtcctcgtcgctgtcactgacgagttacaaaggtggggtccatcgagattcagtggcagtggaggtgggtacctttacactctcacatcgccggctgcgctgaagtattttgggactttacttctgtcagcagttattacatacgtccccgtanactatttggccaaggggaccctaaaggttcgacctcaactacgaactgtggctgctacatctgtcttcattcctcccgcacttctagaactcctcgcgttctgacgg

SEQ ID NO: 153467 - DNA, 404 bp, Homo sapiens; identical to SEQ ID NO: 153275
  misc_feature: GYAE6OF02FL4PE.23.27.C05.1.454.CMB.1.raw
  modified_base (399)..(404): a, c, t, g, unknown or other
  misc_feature (399)..(404): n is a, c, g, or t

SEQ ID NO: 153468 - DNA, 669 bp, Homo sapiens
  misc_feature: GYAE6OF02GJRF4.23.27.C05.1.454.CMB.1.raw
  modified_base (362)..(362): a, c, t, g, unknown or other
  misc_feature (362)..(362): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttgccgggcgagtcgtgactattttcggttctttagtctggtatcaacaaaaaccagggtttcgcccctaccgtcctcgtcgctgtcactgacgagttacaaagtggggtcccagtcgagattcagtggcagtggaggtggaccttttanactctcacaatcgccgctgcggcctgagtattttgggacttacttctgtcagctagttattacatacgtcccgtactactagtttcggccgaaggggtaccctaaaaggtttcgaacccttcgaacttaaccggtaaacttgggttacgggtacctttacgggaccctaaacccgtaacgtttcccttacggtttacccttttaccgtaacctttccccgttttccccccggacccttaacgtttcccgttaacggtaaaccgtttacccgttacccggttacccggtttccgttacgggaaccggg

SEQ ID NO: 153469 - DNA, 556 bp, Homo sapiens
  misc_feature: GYAE6OF02J2VJE.23.27.C05.1.454.CMB.1.raw
  modified_base (271)..(271): a, c, t, g, unknown or other
  misc_feature (271)..(271): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccgcaaccccngggaaggtctgagtggattggagatatctgtcccggtaggggcacttataccaacccgtcctacaaagcgggccgccctatcgagggggaccacgggccaaggaaggaattctcgctgagtttgactttcgtgtcgaccgccgcacggacacggccgttcttatttttgngcgaggacgaactctactcgatctcgtgggccncggcactccgtggtcacgtgtctccgtcgcttccacgtaacggccctagtccggtccttccccgnggtccnccctgcctccg

SEQ ID NO: 153470 - DNA, 266 bp, Homo sapiens
  misc_feature: GYAE6OF02F9YPI.23.27.C05.1.454.CMB.1.raw
  modified_base (263)..(266): a, c, t, g, unknown or other
  misc_feature (263)..(266): n is a, c, g, or t
tcagacgcgagtatcacgaccggtgctcgatttagacgcgatcgaagggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccatactcgcgtctgagcgggctggcaaggcgcatagnnnn

SEQ ID NO: 153471 - DNA, 609 bp, Homo sapiens
  misc_feature: GYAE6OF02F69XL.23.27.C05.1.454.CMB.1.raw
  modified_base (415)..(415): a, c, t, g, unknown or other
  misc_feature (415)..(415): n is a, c, g, or t
  modified_base (581)..(581): a, c, t, g, unknown or other
  misc_feature (581)..(581): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccgaggaaggtctgagtggatggagatatctggtcccggtagggcacttataccaacccgtcctacaaaacggacggccgcctagtcgagggacacggaccaagaaggaattcacgctgtagttgactttcgtgtcgaccgccgnacgacacggtccgtctttattttgcgtacgaggagtaaactactacttcgacttcgtcgtacggggccgcggactacgttccgtggtacctacgttcgtcctccgtcggtaccctttcccgaaccgtaacgggccccctaggttcccggtacccgtttcccccggnggtcccgcccccgttggccccttaccgg

SEQ ID NO: 153472 - DNA, 594 bp, Homo sapiens
  misc_feature: GYAE6OF02GFI62.23.27.C05.1.454.CMB.1.raw
  modified_base (101)..(101): a, c, t, g, unknown or other
  misc_feature (101)..(101): n is a, c, g, or t
  modified_base (148)..(148): a, c, t, g, unknown or other
  misc_feature (148)..(148): n is a, c, g, or t
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
tcagacgcgagtatcacgaccggtgctcgatttagacgcgatcgaagggtttgggggagtcagaccctgtcaggacacagcatggacatgagggtccccgntcagctcctggggctcctgctgctctggctcccaggaacgaagggtnacgttcagatgacccagtctccaccctccctgtctgcatctgttggggaccagtcaccatcacttgccgggnagtcgtgactattttcggttctttagtctggtatcaaacaaaacctgggtttcnccctaccgtcctcgtcgctgtcactgacgagttacaaaggtcggggtcccagtcgagtattcagtggcaggtggaggtggtaccttttacactctcacaatccgcgctgcgcctgaagtgttttgggactttacgttctgtcagtctagttattacattacgtcccgtatactagtttcggaccctaaggggacctaaaggttcgacctacacttaccgaacttggtacgctcggaccaccgtattccgttgttcctacgtacttcccttcccgacctacgttctacgtaacttccgttaccggtccgttactggtacgg

SEQ ID NO: 153473 - DNA, 589 bp, Homo sapiens
  misc_feature: GYAE6OF02HKUED.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccgagggaagggtcttgagtggatggagatatcgtcgtccgggtaggggcacttattaccacccgtcctacaaacggacggccgcctatcgagggacacggccaagaagatctcgctgtagttgactttctgtcgaccgccgacacgacgacggccgttcttagttttcgtgacggtaggtaacgtaaactactacttcgactcgttcgtcggggccgtcggctacgtccgtcggtcacttcgtcctccgtcggtaccttccacccgtacgggccctacgtcccggttcccttccccgtggcccgtcccgtgccctccgg

SEQ ID NO: 153474 - DNA, 553 bp, Homo sapiens
  misc_feature: GYAE6OF02G02KN.23.27.C05.1.454.CMB.1.raw
  modified_base (277)..(277): a, c, t, g, unknown or other
  misc_feature (277)..(277): n is a, c, g, or t
  modified_base (453)..(453): a, c, t, g, unknown or other
  misc_feature (453)..(453): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
  modified_base (548)..(548): a, c, t, g, unknown or other
  misc_feature (548)..(548): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttgggaccgagtcaccatcacttgccgggcgagtcgtgactattttcggttctttagtctggtatacaaacaaaaacctgggtttcncccctaccgtcctcgtcgctgtcactgacgagttaacaaaggtcggggtcccagtcgagattcagtggcaggtgggaggtgggtaccttttacactctacacaactcgccgctgcgcctgaagtagttttcgggactttacttctgtcagtctagttattacattacgtcccgtanactagtttcggaccgaagggtacctaaagttcgacctcactacgactgtgctgcacntctntctcncttcctccnctatctanactctcgcgtcngacgg

SEQ ID NO: 153475 - DNA, 403 bp, Homo sapiens
  misc_feature: GYAE6OF02G3SFO.23.27.C05.1.454.CMB.1.raw
  modified_base (399)..(403): a, c, t, g, unknown or other
  misc_feature (399)..(403): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggcgccctgctccaggagcacctctgggggcacagcggccctgggctgcctggtcaaggactacttccatactcgcgtctgagcgggctggcaaggcgcatagnnnnn

SEQ ID NO: 153476 - DNA, 853 bp, Homo sapiens
  misc_feature: GYAE6OF02IG0XB.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctcgggtccggaccaacccccggagggacgggttcgtgaggtggtagttggagattactcgttcggtacccgggtaggggctaaccgtttattaacccaaccccgttaccctaacgaaaacggccgggaccccgtccctaacgtaccggaacggggtaccgaacccgggaccgaaaaggaaacggtaactttaccgtaccggtacgttaggttaacgttttacgtaccgtttccggttcggtacggaaccccggcccggtacgaaccggtaaccccggtaacccgggtccccgtttagttttaacggtttttacgggacggtaccgggtaaacgggtaaacgttaaaaccgtttaaccgtttacgtttaccgttaacttccggttccgggttacggggggcccggtccgggtacgtaccgtttcccggttcgggttaccctacgttccggttacccgttcccgttcccggtaccgtttaccccgaacccgggtaaccggggtccccctacgggtttccccgggttcccccttttaccccccgggtccggttaccccggtccccccgtacgggtcccttaccccgggacgggtaaccccgg

SEQ ID NO: 153477 - DNA, 556 bp, Homo sapiens
  misc_feature: GYAE6OF02FSAZC.23.27.C05.1.454.CMB.1.raw
  modified_base (273)..(273): a, c, t, g, unknown or other
  misc_feature (273)..(273): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccngggaagggtctgagtggattggagatatctgtcccggtagggcacttattacaacccgtcctcaaagacgggccncctatcaggggacacggccaagaagaattcncgctgagtttgacttctgtgaccgccgcagacncggccgtcttattttgngcgaggagaactactacttcgattctcgtggggccgcggcacgttccgtggtcacgttcgtcctccgtcggcttcccaccacgggccctagttccggtccttccccgtggccctccctcgcctaccg

SEQ ID NO: 153478 - DNA, 599 bp, Homo sapiens
  misc_feature: GYAE6OF02H9ZDA.23.27.C05.1.454.CMB.1.raw
  modified_base (218)..(218): a, c, t, g, unknown or other
  misc_feature (218)..(218): n is a, c, g, or t
  modified_base (452)..(452): a, c, t, g, unknown or other
  misc_feature (452)..(452): n is a, c, g, or t
  modified_base (507)..(507): a, c, t, g, unknown or other
  misc_feature (507)..(507): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaaggtgacgttcagatgacccagtctccaccctccctgtctgcatctgttggggaccagtcaccatcactgccgggntagtcgtgactattttcggtcttttagctaggtatacaaacaaaaacctaggtttcgcccctaacgtcctcgtcgctgtcactgacgagttacaaagtgggtcccatcgagtattcgagtgcaggtggaggtgggtacttttacactcgtacactaatccgccgtcgtcggcggccttggaagttagtttcgggtacttacttcgtgtcaggcagttattacattacgccgtanactagtttcgacgacgggtaactaaagtcgacctcgaactacgtactgtagcttnacgacctatctgttaccttcgaacttcccgttacccaccgttaactccgttaagtaaccgtaaccgtttccggtcttaccgtggtaaccggg

SEQ ID NO: 153479 - DNA, 555 bp, Homo sapiens
  misc_feature: GYAE6OF02JE0YA.23.27.C05.1.454.CMB.1.raw
  modified_base (303)..(303): a, c, t, g, unknown or other
  misc_feature (303)..(303): n is a, c, g, or t
  modified_base (427)..(427): a, c, t, g, unknown or other
  misc_feature (427)..(427): n is a, c, g, or t
  modified_base (462)..(462): a, c, t, g, unknown or other
  misc_feature (462)..(462): n is a, c, g, or t
tcagacgcgagtatcacgaccggtgctcgatttagacgcgatcgaagggtttggggatgctctctgagagtcatggacctcctgtgcaagaacatgaagtacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccagggaaggtcttgagtggattggagatatcngtcccggtagggcacttatacaacccgtcctcaaaagcgggccgcctatcagggacacggccaagaaggatctcgctgagtttgactttctgtgaccgccgcagaccacggcctcttattttgngcgaggagaaactctacttcgatctcgtggggccncggcacgtccgtggtcacgtgtcctccgtcggcttcccaccgtaggccctagtccggtcccttcccccgtggccctcccgtgccctccacggg

SEQ ID NO: 153480 - DNA, 564 bp, Homo sapiens
  misc_feature: GYAE6OF02FLPTM.23.27.C05.1.454.CMB.1.raw
  modified_base (438)..(438): a, c, t, g, unknown or other
  misc_feature (438)..(438): n is a, c, g, or t
  modified_base (470)..(470): a, c, t, g, unknown or other
  misc_feature (470)..(470): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgaatccctgctggggctgggtccggcaacccccagggaagggtcttgagtggattggagatatctgtcccggtagggcacttattacaacccgtccctcaaaagacgggccgcctatcaggggacacgggccaagaaggaattctcgctgagtttgactttctgtgaccgccgcagaccacggccgtcttatttttgngtcgaggagaaacttactacttcgatcttcgnggggccgcggctatcctggtcacgttgtctcctcggccttccaccaacgggcccagtccggtccttcccccgtggcccgtcccgtgcctacccg

SEQ ID NO: 153481 - DNA, 584 bp, Homo sapiens
  misc_feature: GYAE6OF02ILE9Y.23.27.C05.1.454.CMB.1.raw
  modified_base (350)..(350): a, c, t, g, unknown or other
  misc_feature (350)..(350): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgagggaacgggtctgagtggattggagatatcgtgtcccggtaggggcacttataccacccgtcctacaaaagcgggccncctatcagggacacggccaagaagattcgtcgctgtagtttgacttctgtcgaccgccgcacgacacggcctnttagttttgngcgaggagaaacttactacttcgatcgtcgtggggccgcggcacgtccgtggtccacgttcgtccttccgtccggccttacccgaccgtaacgggcccctagttcccggttcccttcccccgtggcccgtccctcggcctccgaggtaccg

SEQ ID NO: 153482 - DNA, 534 bp, Homo sapiens
  misc_feature: GYAE6OF02HRVOZ.23.27.C05.1.454.CMB.1.raw
  modified_base (272)..(272): a, c, t, g, unknown or other
  misc_feature (272)..(272): n is a, c, g, or t
  modified_base (435)..(435): a, c, t, g, unknown or other
  misc_feature (435)..(435): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcagtcgtgactattttcggtctttagtctggtatcaaacaaaaccagggtttncccctaccgtcctcgtcgctgtcactgacgagttacaaagtggggtcccatcgagattcagttggcaggtggaggtgggaccttttacactctcacaatcgcggcctgcgcctgaagtattttgggactttacttctgtcagcagtattacatagtcccgtanactatttggccgtagggaccaaagttcgactcatacgaactgtgctgcacatctgtcttcattccttcccgctatctagtaatacctcgcttctgacgg

SEQ ID NO: 153483 - DNA, 635 bp, Homo sapiens
  misc_feature: GYAE6OF02GC838.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgactccctgcgtggggctgggtccggccaaccccgagggaggtcttgagtggattggagatatcgtggtcccgggtagggcacttattaccaacccgtcctacgaaagccggccgcctatcgagggacacggaccaaggaaggaacttcgtcgctagtagtttgactttctgtcgacccggccgcgaacgaccgccgggtccgttctttagttttgtcggacggtaaggaacgtaaacttaccttacgtttaccgagttccgttcggtcggggcccgtcggtactacgtccgtgtctacgttcgtccttccgtccggtccttcccgaaccgtacgggcccctagttcccggttcccgtttcccccgtggtccccgtccccgtcgtccctacccgg

SEQ ID NO: 153484 - DNA, 628 bp, Homo sapiens
  misc_feature: GYAE6OF02IG9PG.23.27.C05.1.454.CMB.1.raw
  modified_base (212)..(212): a, c, t, g, unknown or other
  misc_feature (212)..(212): n is a, c, g, or t
  modified_base (452)..(452): a, c, t, g, unknown or other
  misc_feature (452)..(452): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttccngcactgtctctactgtctccgtcaccgatccctgctgggctggtccgcaaccccgaggaggtcttgagtggattggagatatcgtggtcccggtaggggctaacttacttaaccaacccgttccctacaaaaacggccgggtcccgacctatcgaaggggaccacggaccaaagaaggtaacttctcgctgtagtttgacttgtagtcgtaccgcgcagacacggtctacttagttttgngcgaagacgtaaatactactcgtatcgtacgtcggggccgtacgtacacttccgtaggtcctacgttcgtccgttccgtcccgtactttacccgaacccgtaacggggcccctagtaccccgggttccctttccccccggtggcccgtcccgtccggtacctccggaagtacccgg

SEQ ID NO: 153485 - DNA, 549 bp, Homo sapiens
  misc_feature: GYAE6OF02GUYM6.23.27.C05.1.454.CMB.1.raw
  modified_base (434)..(434): a, c, t, g, unknown or other
  misc_feature (434)..(434): n is a, c, g, or t
  modified_base (505)..(505): a, c, t, g, unknown or other
  misc_feature (505)..(505): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttgccgggcgagtcgtgactattttcggttctttagtctggtatcaaacaaaaaccaggtttcgcccctaccgtcctcgtcgctgtcactgacgagttacaaagtggggtcccatcgagattcagtgcagtggaggtcgggtaccttttacactctcacaatcgcgctgcgctgagtatttgggacttacttctgtcagctagtattacatacgtcccgtanactatttcggccaaggggaccaaaggttcgaacctcgaactacgaactggtagctgcaccatctgtcttcncttccttcccgctattcctagtaactcctcgcgttcgtggacgg

SEQ ID NO: 153486 - DNA, 228 bp, Homo sapiens
  misc_feature: GYAE6OF02FMOLK.23.27.C05.1.454.CMB.1.raw
  modified_base (218)..(228): a, c, t, g, unknown or other
  misc_feature (218)..(228): n is a, c, g, or t
tcagacgcgagtatcacgaccggtgctcgatttagacgcgatcgaagggtttgggggaagaggaagactgacggtcctcccaggagttcaggtgctgggcaccttgggcacgggggaggtgtgtcacaagatttgggctctgggcacagcggccctgggctgcctggtcaaggactacttccatactcgcgtctgagcgggctggcaaggcgcatagnnnnnnnnnnn

SEQ ID NO: 153487 - DNA, 589 bp, Homo sapiens
  misc_feature: GYAE6OF02FFW4Q.23.27.C05.1.454.CMB.1.raw
  modified_base (561)..(561): a, c, t, g, unknown or other
  misc_feature (561)..(561): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctccaggaacgaaggtgacgttcagatgacccagtctccaccctcctgtctgcatctgttgggaccgagtcaccatcacttgccgggcagtcgtgactattttcggttctttagtctggtatacaaacaaaaccgtggttcgccctaccgtcctcgtcgctgtcactgacgagttacaaaggtcgggtcccatcgagtattcgagtggcaggtggtagggttcggtaccttttacacttctacacaacgtccggccggtcctggccgtctaggaagttagttttcgggacttacgttctgtcagtctagttattactagttaccgtcccgtacacttagttcggaccgaaggggtacctaaaggttcacctcaagtaccgaacgttgacgtcgtacactacctattcttgtcttctactccctacccgactntactagaacttccgcgtcgtctggacgg

SEQ ID NO: 153488 - DNA, 612 bp, Homo sapiens
  misc_feature: GYAE6OF02GA8E4.23.27.C05.1.454.CMB.1.raw
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgactccctgctgggctcgggtccgccaaccccgagggaaggtctgagtggattggagatatcgtggtacccggtaggactacttactaccaacccgtcctacaaacggccggccncctatcgagggacacggcaagaagactcncgctgagtttgactttcgtgtcgaccgcgacacgacgacggtccgttcttagttttcgcggacggtaaggaacgtaaacttacttaacgttcgacttcgtcggtcggggcccgcgggtactacgttcccgtcggtacctacgttcgtccttccgtcggtccttacccgaccgaacgggtccctagttcccggttccttccccggtggccctccccgtgccctaccgg

SEQ ID NO: 153489 - DNA, 627 bp, Homo sapiens
  misc_feature: GYAE6OF02IKP7H.23.27.C05.1.454.CMB.1.raw
  modified_base (270)..(270): a, c, t, g, unknown or other
  misc_feature (270)..(270): n is a, c, g, or t
  modified_base (375)..(375): a, c, t, g, unknown or other
  misc_feature (375)..(375): n is a, c, g, or t
  modified_base (422)..(422): a, c, t, g, unknown or other
  misc_feature (422)..(422): n is a, c, g, or t
  modified_base (456)..(456): a, c, t, g, unknown or other
  misc_feature (456)..(456): n is a, c, g, or t
tcagacgcgagtatcacgaccggtgctcgatttagacgcgatcgaagggtttgggggagtcagaccctgtcaggacacagcatggacatgatggtccccgctcagctcctggggctcctgctgctctggctcccaggaacgaagggtgacgttcagatgacccagtctccaccctccctgtctgcatctgttggggaccagtcaccatcacttgccgggcgagtcgtgactatttttcggttctttagtctggtatcaaacaaaaaccgngggtttcgcccctaccgtcctcgtcgctgtcactgacgagttaacaaaggttcggggtacccatcgagtattcgagtggcaggtggaggtcgggtaccttttacnctctacacatcgccggctgcgctgaagtagttttcgggactttactntcgtctagctagttattacattacgtacccgtanacttagttcggaccgaacggggtacctaaaggttcgaaccttataacgtaccgtaaacgttcggtacgcgtacgaccctaacctcgttaccttcggttacctttctacgtttcccgttaccccgtaccttacttaccgtacgtaacgttacccgtcggtccgtgttacggg

SEQ ID NO: 153490 - DNA, 630 bp, Homo sapiens
  misc_feature: GYAE6OF02GYKAY.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgactccctgcgtggggctgggtccggaccaaccccgagggaaggtcttgagtggattggagatatctcggtcccgggtaggggctacttacttaccaaccccgtccctacgaaaacggaccgggcccgcctagtcgaggggaccacggaccaaaggaacggaattctcgctggtagtttgactttcgtgtcgaccgccgcgagacgacggccgtcttaaaaaaaaatttgtgcgaggagaaactactacttcgtatctcgtcgggccgcggctactccgtcgtcgtactcgtcctccgtccggtccgttcccgaccgtaaccgggacccgtaccgttcccggttcccgtttcccccgttccggtcccggtccccgtccgtcccgtcccgg

SEQ ID NO: 153491 - DNA, 421 bp, Homo sapiens
  misc_feature: GYAE6OF02JDLC4.23.27.C05.1.454.CMB.1.raw
  modified_base (237)..(237): a, c, t, g, unknown or other
  misc_feature (237)..(237): n is a, c, g, or t
  modified_base (403)..(407): a, c, t, g, unknown or other
  misc_feature (403)..(407): n is a, c, g, or t
  modified_base (409)..(421): a, c, t, g, unknown or other
  misc_feature (409)..(421): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaactactacttcgatctctggggccnggcatcctggtcactgtctcctggcttccaccaaggcccatcggtcttccccctggccgccctgctccaggcgcacctcgtcgggggcacgagccggccctgggctcgccgtggtcaaggcctagttccatacgtcgcgtactgacgcggctggcaagcgcatagnnnnngnnnnnnnnnnnnn

SEQ ID NO: 153492 - DNA, 615 bp, Homo sapiens
  misc_feature: GYAE6OF02H5SQ7.23.27.C05.1.454.CMB.1.raw
  modified_base (274)..(274): a, c, t, g, unknown or other
  misc_feature (274)..(274): n is a, c, g, or t
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgagggtgacgttcgagatgacccagtctccaccctccctgtctgcatctgttggggaccagtcaccatcacttgccgggcagtcgtgacagtttttcggtctttagtctggtatcaaacaaaaaccagggtttncccctaccgtcctcgtcgctgtcactgacgagttacaaagtggggtcccatcgagattcagtggcagtggaggtgggaccttttagactctcacaatcgccggctgccggctgaacgtnttttgggactttacttctgtcagctaagtattacattacgtcctanactagtttcggccgtaaggggacctaaagtttcgacctactaagtaccgtaaactcggtacgggtcttaggacctaacctattcctgtttcctttactaacggttcccctttaccccggaccttacttccgttacggtaaaccttacccgtccggtacgttccgtggtaacccggg

SEQ ID NO: 153493 - DNA, 612 bp, Homo sapiens
  misc_feature: GYAE6OF02I46OG.23.27.C05.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
tcagacgcgagtatcacgaccggtgctcgatttagacgcgatcgaagggtttggggactgctctctgagagtcatggaccgtcctgtgcaagaacatgaagcacctgtggttttgcctcctgctgggtggcagctcccagatgggccctgtcccaggcgcaagtgcaggagtcgggccaggactggtgaggccttcggaaaccctgtctctttcctgcactgtctctactgtctccgtctaccgatcctgctgggctggtccgcaaccccaggaggtctgngtggattgganatatctgtcccggtaggggctacttataccacccgtcctacaaacgcggccncctagtcacggggacacggcccaagagaatcgtacgctgagtttcgacttcgtgtcgaccgtccgcacgacacgggccttacgttatttttcggacgtggtaacggtacgtaaacttacctacttacgattaccgtcgtgggcccgcgctatccgtggtccacttcgttactccgttccggtccttaccacccggtaaacgggaccctaccgttccggttacccgttccccccgttagggaccccgtccccggttgcccgttacccgg

SEQ ID NO: 153494 - DNA, 635 bp, Homo sapiens
  misc_feature: GYAE6OF02FQNXV.23.27.C05.1.454.CMB.1.raw
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtgggctgggtccggccaaccccgagggaacgggtcttgagtggattggagatatctggtccggtagggcacttatacaacccgtcctacaaagcggccncctancgagggacacggcaagaagatcncgctgtagttgacttctgtcgaccgccgacgagaccgaccgggtccttacgttagtttttcggcggtacggtaagggtaacgtaaaacttaccgtaacgtttccggaattccgtacgttacgggggcccgcggtactacgttccgttggtaccacgttcgtacctccgtccggtccttacccgaaccgtaacggggtccccctaagttcccggttcccttccccccgtgggccccgtcccgtcggtcccttacccgg

SEQ ID NO: 153495 - DNA, 588 bp, Homo sapiens
  misc_feature: GYAE6OF02HLQN0.23.27.C05.1.454.CMB.1.raw
  modified_base (280)..(280): a, c, t, g, unknown or other
  misc_feature (280)..(280): n is a, c, g, or t
  modified_base (512)..(512): a, c, t, g, unknown or other
  misc_feature (512)..(512): n is a, c, g, or t
  modified_base (525)..(525): a, c, t, g, unknown or other
  misc_feature (525)..(525): n is a, c, g, or t
  modified_base (538)..(538): a, c, t, g, unknown or other
  misc_feature (538)..(538): n is a, c, g, or t
  modified_base (549)..(549): a, c, t, g, unknown or other
  misc_feature (549)..(549): n is a, c, g, or t
  modified_base (559)..(559): a, c, t, g, unknown or other
  misc_feature (559)..(559): n is a, c, g, or t
  modified_base (583)..(583): a, c, t, g, unknown or other
  misc_feature (583)..(583): n is a, c, g, or t
tcagacgcgagtatcacgaccggtgctcgatttagacgcgatcgaagggtttgggagagtcagaccctgtcaggacacagcatggacatgagggtccccgctcagctcctggggctcctgctgctctggctcccaggaacgaagggtgacgttcagatgacccagtctccaccctccctgtctgcatcgtgttggggaccgagtcaccatcacttggccgggcgagtcgtgactattttcggttctttagtctggtataccaaacaaaaccagggtttcncccctaccgtcctcgtcgctgtcactgacgtagttaacgaaaggtcggggtacccagtcgagtacttcgagtggcaggtggaggtcggtacctttacactctcactaacgtcgccggtcctggccggtcctaggtaacgttagttttcgggtactttacgttcgtcgtcagctaagttattacactacgtcccgtaatactagttcggacctagggacctaacgttgacctnactacgtacgtgngtactgctacgtntctcgttctcncttcctcccnctactctcggacttcgtcgtcgtntcggg

SEQ ID NO: 153496 - DNA, 666 bp, Homo sapiens
  misc_feature: GYAE6OF02IJSRF.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttgccgggcgagtcgtgactattttcggttctttagtctggtatcaacaaaaacaggtttgcccctacgtcctcgtcgctgtcactgacgagttacgaaaggtggggtcccatcgagattcgagtgcagtggaggtgggtacttttacactctcacaactcgccgctgcgcctgaagtattttgggactttcgttctgtcagcgaagttattacacgttaacgtcccgtaactaacgtaattttcgggacccgtaagggggaaccctaaaacggtttcgaacccttctaaacgtacggtaaacgttggttacgggccttacgggaccctaaaccgtattacccgtttgttacccttttaccgtactttacccgttttcccccggacccttaaagttccccgttacggtaaacctttacccggttaccggtaccggtttccgtaggtaaccgggg

SEQ ID NO: 153497 - DNA, 406 bp, Homo sapiens
  misc_feature: GYAE6OF02GW64W.23.27.C05.1.454.CMB.1.raw
  modified_base (299)..(299): a, c, t, g, unknown or other
  misc_feature (299)..(299): n is a, c, g, or t
  modified_base (400)..(406): a, c, t, g, unknown or other
  misc_feature (400)..(406): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctgggggccgcggcatcctggtcactgtctcctcggcttccaccaaggcccatcggtcttcccctggccnccctgctccaggagcacctctgggggcacagcggccctgggctgcctggtcaaggactacttccatactcgcgtctgagcgggctggcaaggcgcatacgnnnnnnn

SEQ ID NO: 153498 - DNA, 577 bp, Homo sapiens
  misc_feature: GYAE6OF02GBO1M.23.27.C05.1.454.CMB.1.raw
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
  modified_base (456)..(456): a, c, t, g, unknown or other
  misc_feature (456)..(456): n is a, c, g, or t
  modified_base (519)..(519): a, c, t, g, unknown or other
  misc_feature (519)..(519): n is a, c, g, or t
  modified_base (570)..(570): a, c, t, g, unknown or other
  misc_feature (570)..(570): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggngagtcgtgactattttcggttctttagtctggtatcaaacaaaacctggtttcncccctaccgtcctcgtcgctgtcactgacgagttacaaaggtcggggtcccatcgagattcgagtggcaggtgggaggtggtaccttttacacttctacacaatccggcccggctgccggcctggaagtagttttgggactttacttcgtgtcagtctagttattacagttacgtcccgtanacttagtttcggaccgaggggaacctaaagttcgaacctcaatacgaactggtcgctgcactntctgtctcacttccttcccgctattctagtaacttaccgtccgtcgttcgnggaccgg

SEQ ID NO: 153499 - DNA, 405 bp, Homo sapiens
  misc_feature: GYAE6OF02ISBJL.23.27.C05.1.454.CMB.1.raw
  modified_base (239)..(239): a, c, t, g, unknown or other
  misc_feature (239)..(239): n is a, c, g, or t
  modified_base (287)..(287): a, c, t, g, unknown or other
  misc_feature (287)..(287): n is a, c, g, or t
  modified_base (398)..(405): a, c, t, g, unknown or other
  misc_feature (398)..(405): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagttttgacttctgtgaccgccgcagacacggccgtctatttttgtgcgaggagaaactactacttcgatctctggggccnggcatcctggtcactgtctcctcggcttccaccaaggccccatcggtnttccccctggcgccctgctccaggagcacctctgggggcacagcggccctgggctgcctggtcaaggctacttccatactcgcgtctgagcgggctggcaaggcgcatagnnnnnnnn

SEQ ID NO: 153500 - DNA, 402 bp, Homo sapiens
  misc_feature: GYAE6OF02FUTXK.23.27.C05.1.454.CMB.1.raw
  modified_base (398)..(402): a, c, t, g, unknown or other
  misc_feature (398)..(402): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggcccatcggtcttccccctggcgccctgctccaggagcacctctgggggcacagcggccctgggctgcctggtcaaggactacttccatactcgcgtctgagcgggctggcaaggcgcatagnnnnn

SEQ ID NO: 153501 - DNA, 421 bp, Homo sapiens
  misc_feature: GYAE6OF02I3KO4.23.27.C05.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (408)..(421): a, c, t, g, unknown or other
  misc_feature (408)..(421): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaaggcccatcggtcttcccctggcgccctgctccaggancacctcgtgggggccacgagccggccctgggcctcgccgtggtcaagggactacttccgataccgtcgcgtctgagcggctggcaaggcgcagtagnnnnnnnnnnnnnn

SEQ ID NO: 153502 - DNA, 619 bp, Homo sapiens
  misc_feature: GYAE6OF02HS879.23.27.C05.1.454.CMB.1.raw
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctggttggggaccgagtccaccatcacttggccgggcgagtcgtgactatttttcggttctttagtctggtatacaaacaaaaaccngggtttcgcccctaccgtcctcgtcgctgtcactgacgagttacaaaggtggggtcccatcgagattcagtgcagtggaggtgggacctttanactctcacatcgccgctgcgctgaagnttttgggactttactctgtcagctagtattacagtacgtcccgtaacactagtttcggaccgtaggggtaacctaaaggtttcgaaccttcgaagttaccgaaacgttggtacggcttcggacaacccgtattccgttagtttccttacgtaacttcccctttaccccgacctacgttccgtaacgtaaccttaccgtaccggtacgttccgtaggtacccgggg

SEQ ID NO: 153503 - DNA, 668 bp, Homo sapiens
  misc_feature: GYAE6OF02JR34F.23.27.C05.1.454.CMB.1.raw
  modified_base (499)..(499): a, c, t, g, unknown or other
  misc_feature (499)..(499): n is a, c, g, or t
  modified_base (573)..(573): a, c, t, g, unknown or other
  misc_feature (573)..(573): n is a, c, g, or t
tcagacgcgagtatcacgaccggtgctcgatttagacgcgatcgaagggtttgggggaggtcagaccctgtcaggacacagcatggacatgagggtccccgctcagctcctggggctcctgctgctctggctcccaggaacgaagggtgacgttcagatgaccagtctccaccctccctgtctgcatcgtgttggggaccgagtcaccatcacttgccgggcagtcgtgactattttcggtctttagtctggtatcaaacaaaacctggtttcgcccctaccgtcttccgtcgctagtcactgacgtagtacaaggtgggtaccagtcgtagattacgagttcggctaggtgggtacgggttgggacctttttacacgttctacaactaacgttcgcccggtcttacggcggtaccctggaaagttcgttttcgggtaccttttacgtttccgtggttccgaagtccgtaattacgttacctagttaacgtccccgtanacgttacgtttcggaccggtaggggtaaccctaaagtttcgacccgttacaagttaacgaccgttagtcggttnaccggactaccattccgtcgttacttaccgaactttcccgttacccgtactaacttccgtaacgtagtacccttcggtcggttcttacggacggg

SEQ ID NO: 153504 - DNA, 858 bp, Homo sapiens
  misc_feature: GYAE6OF02J1YBS.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctcgggtccggcaaccccagggaacggtcttgagtcggattcggagatactctcggtccggtaggggctacgttattaccgaacccggtccctacgtaaaacggaccggggtccgtccccgtaacgtaccgacggggggtaaccaccgggaccctaaaggaaacgggtaaaacgtttccgtaaccggtcttaccggtaacggtttttacggaaccgtttttccgtacggggttcggtaaaccccgggtcccggtaccgaaacgggtaaccccggtaaaccggggttccccggtttacgtttaaaccgtttttttcgggtacgggtacccgggttaaacggggtaccggttaaaaaccgtttacccgtttaaccgttttaccgggaactttacccggttccgggttaccggggggaccccgtccggggtaccgtaaccgttcccgttacggggttaccctaaccgttcggttccccgttcccggttccggtacccgttttaccccgaaccccggtaaacggggtcccccgttaaccggtttccggttaccccgtttccccccggcgggttaccccggtcccctttacgggccccttaaccccggg

SEQ ID NO: 153505 - DNA, 579 bp, Homo sapiens
  misc_feature: GYAE6OF02JAG7B.23.27.C05.1.454.CMB.1.raw
  modified_base (215)..(215): a, c, t, g, unknown or other
  misc_feature (215)..(215): n is a, c, g, or t
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
  modified_base (442)..(442): a, c, t, g, unknown or other
  misc_feature (442)..(442): n is a, c, g, or t
tcagacgcgagtatcacgaccggtgctcgatttagacgcgatcgaagggtttgggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttccngcactgtctctactgtctccgtcaccgatccctgcgtggggctggggtccggcaacccccgagggaaggtcttggagtggattggagatatctggtcccggtaggggcacttattacaacccgtccctacaaagcgggccncctatcgaggggacacggcaagaagattcncgctgagtttgactttcgtgtcgaccgccgcaggacacggtccgtcttagttttgngtcgaggacgtaaactacttactcgatctcgtcggggccgcggcagtccgtggtcacgtcgtcctccgtcggtccttccgaccgaacgggccctagttcccggtccttccccgtggcccgcccgttgccctacccgg

SEQ ID NO: 153506 - DNA, 614 bp, Homo sapiens
  misc_feature: GYAE6OF02HGZU1.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctgggctgggtccgcaacccccgagggaaggtcttgagtggattggagatatcgtgtcccggtaggggctactttacttaccaacccgtccctacgaaaacgccgggtaccgcctagtcgaggggaccacggaccaaggaaggtaattcgtcgcgtgtagtttgtactttctagtcgaccgccgcgacgacacggccgttacgttattttggacgcggtaaaggtacgtaaacgttactacttcgacttcgtcgtcggggccgcggtactacgtccgttcggtcacgtcgtccgtccgtcgtccgttccgaaccgtaacgggccctagtcccgtccttccccgtggtcccgccctcgccctaccgg

SEQ ID NO: 153507 - DNA, 410 bp, Homo sapiens
  misc_feature: GYAE6OF02GHWMQ.23.27.C05.1.454.CMB.1.raw
  modified_base (298)..(298): a, c, t, g, unknown or other
  misc_feature (298)..(298): n is a, c, g, or t
  modified_base (399)..(399): a, c, t, g, unknown or other
  misc_feature (399)..(399): n is a, c, g, or t
  modified_base (405)..(410): a, c, t, g, unknown or other
  misc_feature (405)..(410): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggcccatcggtcttcccctggccncctgctccaggagcaccctcgtgggggcacgacggccggcccgtgggctcgccgtggtcaaggactacttccatactcgcgtctgagcggctggcaaggcncatagnnnnnn

SEQ ID NO: 153508 - DNA, 584 bp, Homo sapiens
  misc_feature: GYAE6OF02IN0JT.23.27.C05.1.454.CMB.1.raw
  modified_base (327)..(327): a, c, t, g, unknown or other
  misc_feature (327)..(327): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccacctccctgtctgcatctgttgggaccagtcaccatcacttgccgggcgagtcgtgactattttcggttctttagtctggtatcaacaaaacctggttcgcccctaccgtcctcgtcgctgtcactgacgtagttacaaaggtcggggtccatcganattcagtggcagtggaggtggtacctttacactctcacactcgccggctgcgctgagtattttcgggactttacttctgtacagtctaagttacttaacacgttacgttccccgtaactactagtttcgggaccgtaaggggtacccaaagtttcgacctactataccgtaacttggtcgtctcgactaaccattcgtcgttcttactacttccttcccgcctatccgtagtaacttccgtcgtcgttctaggtcgg

SEQ ID NO: 153509 - DNA, 570 bp, Homo sapiens
  misc_feature: GYAE6OF02G10TC.23.27.C05.1.454.CMB.1.raw
  modified_base (265)..(265): a, c, t, g, unknown or other
  misc_feature (265)..(265): n is a, c, g, or t
  modified_base (478)..(478): a, c, t, g, unknown or other
  misc_feature (478)..(478): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttgggaccagtcaccatcacttgccgggcgagtcgtgacattttcggtctttagtctggtatcaaacaaaaaccngggtttcgcccctaccgtcctcgtcgctgtcactgacgagttacaaagtggggtcccatcgagattcagtggcagtggaggtgggaccttttacgactctcacaatcgccggctgcgcctgaagtattttgggaactttacttctgtcagcagttattacatacgtcccgtacactagtttggacctaggggaacctaaagttcgacctacgntaaaaacgcgtagtggcttcgcctaccatctcgttcttccgattcccttcccgcctatccttagaacttaccgtacggtcgttctggtacgg

SEQ ID NO: 153510 - DNA, 675 bp, Homo sapiens
  misc_feature: GYAE6OF02I6960.23.27.C05.1.454.CMB.1.raw
  modified_base (275)..(275): a, c, t, g, unknown or other
  misc_feature (275)..(275): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggacgaggtgacgtccgagatgacccagtctccaccctccctgtctgcatctggttgggaccagtcaccatcacttgccgggcagtcgtgactattttcggttactttagtctaggtatacaaacaaaaaccgtggttcncccctaccgtcctcgtcgctgtcacgtgacgtagttaacaaaggttcgggtacccagtcgagattcagtgcaggtggacggtggtaccttttacgacttctacgtaacaacgtccggcccggtccttcggaccggtccttaggaacggtttacgttttcgggtaacctttacgttccgtagtaccgagtcctaagttaacttacgtattaccggtccctaactacgttaagtttccggaccgtaacggggtaacctaaaggtttaccgaaccttacgtaacgtacgtaactgggttacggacttcgacctaaccgtacttccgttacgttccttacgtccttacccgtttccccgaccttactcttaacgaccttaccgtcggtcgttacgtcggacggg

SEQ ID NO: 153511 - DNA, 608 bp, Homo sapiens
  misc_feature: GYAE6OF02FV3RG.23.27.C05.1.454.CMB.1.raw
  modified_base (600)..(600): a, c, t, g, unknown or other
  misc_feature (600)..(600): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcatctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgagggaagggtcttgagtggattgggagatatcgtcggtcccgggtaggggctacttattaccaaccccggtccctacgaaaaaggccgggccgtacccctatcgaggggaccacggaccaaggaaggaattctcgctgtagtttgacttctgtcgaccgccgcgacgaccacggccgttcttagtttttgcgacgaggagtaaactctaactcgatctcgtcgggccgcggcacgtccgtggtcacgtgtcctccgtcggccttaccaccgaacgggccccagttcccggtaccttcccccgtgggcccgtcccgtgcccttacccggnggtacccg

SEQ ID NO: 153512 - DNA, 671 bp, Homo sapiens
  misc_feature: GYAE6OF02HQODF.23.27.C05.1.454.CMB.1.raw
  modified_base (410)..(410): a, c, t, g, unknown or other
  misc_feature (410)..(410): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatcctgcgtcggggctgggtccgccaaccccggagggtaagggtcttggacgtggtagttagggatattagtcgtcggtccgggtaggggctacttacttaccaacccgtcctacgaaacggccggccgccgtatcgagggaccacggacaaggaagtaacttcgcgtntagtagtttgacttctgtcgaccgccgacacgaccgcggtccgttcttacgttttggcgtacggacggtaacgtaaactacgttactcgtacttcgtaccggtcggggcccgtcggacctacgttccggtaggtcctaacgttcggttcccttacccgtccggtaccttacccgaaccggtaaccgggtcccgttaacgttcccgggtttaccccttccccccggtagggtccccctcccggttccggcccttaacccggg

SEQ ID NO: 153513 - DNA, 543 bp, Homo sapiens
  misc_feature: GYAE6OF02FMSJ0.23.27.C05.1.454.CMB.1.raw
  modified_base (267)..(267): a, c, t, g, unknown or other
  misc_feature (267)..(267): n is a, c, g, or t
  modified_base (411)..(411): a, c, t, g, unknown or other
  misc_feature (411)..(411): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccggggcagtcgtgacattttcggttctttagtctggtatcaaacaaaaaccngggtttcgcccctaccgtcctcgtcgctgtcactgacgagttacaaagtgggtcccatcgagattcagtggcagtggaggtgggaccttttacactctcacaatcgccggcctgcgctgaagtatttgggacttacttctgtcngctagtattacatacgtcccgtacactatttcggccaggggacctaaagttcgaaccttcaatacgaactggtcgctgacaccatctgtcttcaatccttcccgctatctagaactcctcgcgttctgacgg

SEQ ID NO: 153514 - DNA, 401 bp, Homo sapiens
  misc_feature: GYAE6OF02IYVFR.23.27.C05.1.454.CMB.1.raw
  modified_base (238)..(238): a, c, t, g, unknown or other
  misc_feature (238)..(238): n is a, c, g, or t
  modified_base (398)..(401): a, c, t, g, unknown or other
  misc_feature (398)..(401): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttccccctggcgccctgctccaggagcacctctgggggcacagcggccctgggctgcctggtcaaggactacttccatactcgcgtctgagcggctggcaaggcgcatagnnnn

SEQ ID NO: 153515 - DNA, 637 bp, Homo sapiens
  misc_feature: GYAE6OF02I2WQJ.23.27.C05.1.454.CMB.1.raw
  modified_base (211)..(211): a, c, t, g, unknown or other
  misc_feature (211)..(211): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaccctgtctcttcngcactgtctctactgtctccgtcaccgatccctgcgtggggctcgggtccggccaacccccgaggggtaaggtccgttggaggtcggattggagagtatcttcggtaccgggtaggggcacgttataccgtaacccgtcctaacgaaaggaccggccgcctatcgacgggacgacggacgaacgaaggtacttcgtcgtacgtgtaagtttcgacgtttctggtcgacccgcgactacgacgaccggtccttagttacgttttgtaggcgtaggaacgtaacttacttacttcgaacttctcggtcgggacgcgtactcgtccgttcgtactcgtagtccttcgtccgtccttacccgaaccgaccgggtaccctcgttcccggttcccttccccggtcggacccgcccgttcggacccgtaccgg

SEQ ID NO: 153516 - DNA, 659 bp, Homo sapiens
  misc_feature: GYAE6OF02HIFQ6.23.27.C05.1.454.CMB.1.raw
  modified_base (454)..(454): a, c, t, g, unknown or other
  misc_feature (454)..(454): n is a, c, g, or t
  modified_base (486)..(486): a, c, t, g, unknown or other
  misc_feature (486)..(486): n is a, c, g, or t
  modified_base (549)..(549): a, c, t, g, unknown or other
  misc_feature (549)..(549): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctcgggtcccggaccaacccccgaggggaacggtccttaggaggtggtagttggagtatagttcgtcggtcccgggtagggctacgttactacaacccgtccctacgaaacgccggccgtcctagtcgaggggaccacggaccaaggaaggaacttcgtcgtactgtagtttcgtacgtttcgtagtcgaccgtccganacggtaccacggtccgttcgtttattttcggnggaccggtaagggaactaaacgttacttacgttcgacgttccgtcgggttaccggggcccggnggacctacgttccgttcgggtaccacgttcgttccctccgttcgtcccttacccgaccgtacgggccctagtcccggttccttcccgtcggcccgtcccgtgccctacgg

SEQ ID NO: 153517 - DNA, 834 bp, Homo sapiens
  misc_feature: GYAE6OF02F0BSF.23.27.C05.1.454.CMB.1.raw
  modified_base (212)..(212): a, c, t, g, unknown or other
  misc_feature (212)..(212): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttccngcactgtctctactgtcctccgtcaccgatccctgctggggctgggtccgcaaccccgagggaaggtcttgagtggattggagatatcgtcggtcccggtaggggcctacttacgttaccaaccccggttccctacgaaaaacggccgggcccgaccccgttaatccggtaacggggggaaccaccggggacccgtaaaaggaacgggtaaactttccgtacggacgttgggtaacggtttttggaaccgttttcgtcgggttcggaacccggtcccggacgtaacggaaccgtaccgggtcccggttacttaaacgtttttttcggtacggtacgggaacggggtaacgtaaaaccgttaaccgtttaacccgtttaccgtaaccgtttcgttaccgggttcggggggtacccggtaccggggtacccgtaacggtttcccggttacgggtttacccgtaaccgttcggttacccgttcccgttacccgggtcccgtttacccgtaacccgggtaaacccggggtaccccctaacgggtttaccccggttacccgtttcccccccggttacgggtccccggtaacccccgttcggtaccccgttcccggagggtaacccgg

SEQ ID NO: 153518 - DNA, 655 bp, Homo sapiens
  misc_feature: GYAE6OF02FK5MW.23.27.C05.1.454.CMB.1.raw
  modified_base (402)..(402): a, c, t, g, unknown or other
  misc_feature (402)..(402): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaacctgtctctttcctgcactgtctctactgtctccgtcaccgatccctgcgtggggctcgggtccggccaacccccgagggaagggtcttggagtggattggagatatctcggtcccggtagggctacttattaccaacccgtccctacgaaaacgccgggccgacctatccgagggggaccacggccaaaggaaggacttcncgctagagtttgactttcgtggtcgaccgccgacgacgaccgacggtccgttcttatttttggcgtacggaaggtaacgaaacttacttaacgttacgaattcctcggttcgggggcccgtcgggtacctacgttcccgttgggtaccctacgttcgtacccgttccgttccggtcctttcccgaacccgtacgggcccctagttcccggttcccttccccccggttggccccgtccccgtcgtcctacccgg

SEQ ID NO: 153519 - DNA, 662 bp, Homo sapiens
  misc_feature: GYAE6OF02GEKHX.23.27.C05.1.454.CMB.1.raw
  modified_base (300)..(300): a, c, t, g, unknown or other
  misc_feature (300)..(300): n is a, c, g, or t
tcagacgcgagtatcacgaccggtgctcgatttagacgcgatcgaagggtttggggatgctctctgagagtcatggacctcctgtgcaaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgactcctgcgtggggctgggtccggcaaccccgagggaacggtcttgagtggattgganatatcgtgtcccgggtaggggcacgttataccaacccgtccctacgaaaagacgggccctcctatccgaaggggaccacggaccgaagaaaggaacttctcggctagtacggtttgtaacctttcgtcggtacgaacccggccgtacaacggtaaccctacgggtccgttactttagtttttcggacggtacggtaaggtaacggtaaaccttaacgttacttacgacgttcgtacggttcggggcccgtacggtacctacgttcccgttggtacctacgtcgtccgttaccgtcggtccttacccgaaccgacggccctagttccggttacccttcccgtggcccgtccctcgcctaccgg

SEQ ID NO: 153520 - DNA, 595 bp, Homo sapiens
  misc_feature: GYAE6OF02GIDNJ.23.27.C05.1.454.CMB.1.raw
  modified_base (213)..(213): a, c, t, g, unknown or other
  misc_feature (213)..(213): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (440)..(440): a, c, t, g, unknown or other
  misc_feature (440)..(440): n is a, c, g, or t
  modified_base (578)..(578): a, c, t, g, unknown or other
  misc_feature (578)..(578): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaacctgtctctttccngcactgtctctactgtctccgtcaccgatccctgcgtggggctcgggtccggcaaccccgagggaagggtcttgagtggattggagatatctggtccggtagggctacttataccacccgtcctacaaaacgcggccncctatcgagggacacggcaagaagaacttcncgctgtagtttgacttcgtgtcgaccgccgacagacgacggccgttacttagttttgnggcgtaaggacgtaaacttacgtacttcgattcgtcgtcgggggcccgcgggctacgttccgtaggtcacgttcgtccttccgtcggtccttcccgaccgaacgggaccctagttccggttcccttccccgtggcccncccgttcgccctaccgg

SEQ ID NO: 153521 - DNA, 968 bp, Homo sapiens
  misc_feature: GYAE6OF02JFKU3.23.27.C05.1.454.CMB.1.raw
  modified_base (286)..(286): a, c, t, g, unknown or other
  misc_feature (286)..(286): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggcttcggaaaccctgtctctttcctgcactgtctctactgtctccgtcaccgactcctgctcggggctcgggtccgccaaccccgagggaacggtcttgngtggtattggagatactcgtcggtcccgggtaggggacctacgtttattacctaaccccgtccctacgaaaacggaccgggcccgacccgtagtcggaacgggggtaccaacggggcccgaaaaggtaacgggtaaacgttttaccgtaccggtacgttacggtaacggtttttcggtaaaccttttccgtttagggtttccggaaacccccggtcccgggtaccgtaacgggaaaccccgtacccgggggtaaccccgttttacccgttttaaacggtttttttcggggttaaccggtaccgggggtaaaacgggttaaaccgggttaaaaacccgtttaaacccgttttaaacccggtttttacccggtaaaaccttttcccggttttcccggggttaacggggggccccggggttaaccccggggacccgtttaaaaccggtttcccccgggtttaacggggtttaccctaaaccccggttttacggttcccccgtttaccccgggttaccccgggggtttccctttaaccccggtaacccccgggtaaaacccgggggttaacccccctaacgggtttaccccgggttacccccggttttacccccccggtcgggggttacccccgttccccccggttaccggaccccgttttccccggggaacgggttaaccccggg

SEQ ID NO: 153522 - DNA, 415 bp, Homo sapiens
  misc_feature: GYAE6OF02IDCYZ.23.27.C05.1.454.CMB.1.raw
  modified_base (297)..(297): a, c, t, g, unknown or other
  misc_feature (297)..(297): n is a, c, g, or t
  modified_base (400)..(415): a, c, t, g, unknown or other
  misc_feature (400)..(415): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggcccatcggtcttcccctggcnccctgctccaggagcacctcgtgggggcacgagccggccctgggctgcctggtcaaggactacttccatactcgcgtctgagcgggctggcaaggcgcatagnnnnnnnnnnnnnnnn

SEQ ID NO: 153523 - DNA, 789 bp, Homo sapiens
  misc_feature: GYAE6OF02J0OZ8.23.27.C05.1.454.CMB.1.raw
tcagacgcgagtatcacgaccggtgctcgatttagacgcgatcgaagggtttggggtagtgctctctgagagtcatggacctcctgtgcaagaacatgaagcacctgtggttttgcctcctgctggtggcagctcccagatgggccctgtacccgcggcgccaagtcgacacgggtagcgggccccgaggacctgggtgagggccctttagggaaacccctgtcgttccttttcctgacaccgtcgttcttacctcgttggttcctccggttacccaccggattcccccgtggtccgtcggggtcgtcggggtccccggccgaacccccgaggggtaacggttcgttcggacggtggacgttgggtacgacggttaatcggtcggtccgggtaacgggggtactacttttaacgttaacccgaaccccgttaccccgttaacggaaaaccggacgggtccccgacccgttacgtaccggaacgggggccaaccgggaccctaaagggaaacgtaattccctaggcccgtgtaaggtttcgaacgtttccgtagtacggtaccggaccgtacgacgtaccgacggtacccgttaccggttattttcggtacgtggtaacggtaagtaacgtaaccgtaaagttcctaacgtcgtaccgttcgggccgtacgactccgtacgtacgtcgaacttcgtaccttcggccgttccgttacccgaacgtaccggacccggtccttacccgggtccttaccccgtcggtacccgacccgttcgaccgttaccccgg

SEQ ID NO: 153524 - DNA, 400 bp, Homo sapiens
  misc_feature: GYAE6OF02FVD9O.23.27.C05.1.454.CMB.1.raw
  modified_base (238)..(238): a, c, t, g, unknown or other
  misc_feature (238)..(238): n is a, c, g, or t
  modified_base (398)..(400): a, c, t, g, unknown or other
  misc_feature (398)..(400): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccncggcatcctggtcactgtctcctcggcttccaccaagggcccatcggtcttccccctggcgccctgctccaggagcacctctgggggcacagcggccctgggctgcctggtcaaggctacttccatactcgcgtctgagcgggctggcaaggcgcatagnnn

SEQ ID NO: 153525 - DNA, 676 bp, Homo sapiens
  misc_feature: GYAE6OF02HM260.23.27.C05.1.454.CMB.1.raw
  modified_base (348)..(348): a, c, t, g, unknown or other
  misc_feature (348)..(348): n is a, c, g, or t
  modified_base (491)..(491): a, c, t, g, unknown or other
  misc_feature (491)..(491): n is a, c, g, or t
  modified_base (621)..(621): a, c, t, g, unknown or other
  misc_feature (621)..(621): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcatctcccagatgggccctgtcccaggcgcaagtgcaggagtcgggcccaggactggtgaggccttcggaaaccctgtctctttcctgcactgtctctactgtctccgtcaccgatccctgcgtggggcgtgggtccgcaaccccgagggaggtcttgagtggatggagatatctcggtccggtaggggcacttattaccaccgtccctacgaaacgcggccncctatcgagggacacggcaagagattcgcgctgagttgacttctgtcgaccgcgacgacgaccgacggtccttcttagttttggcgacggaggtaagtaaacgttcttacttacgaacttccgtaccggtcggggggaccccncgggacctacgttcccgtaggtaccgtaccgttcgtcccgttaccgttcccgggtacctttaccccggaacccggtaaacggggccccccttaacggttcccccgggttccccgttttaccccccccggnggggttcccccggtccccgttcccggttacccgttaccccggacgggttacccgg

SEQ ID NO: 153526 - DNA, 604 bp, Homo sapiens
  misc_feature: GYAE6OF02F50Z4.23.27.C05.1.454.CMB.1.raw
  modified_base (431)..(431): a, c, t, g, unknown or other
  misc_feature (431)..(431): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctgggctgggtccggcaacccccgagggaaggtcttgagtggattggagatatctgtcccggtagggcacttataccaacccgtcctacaaaagcggccgcctatcgagggacacggcaagaagatctcgctgagttgacttctgtcgacccgccgcacgacacggccgttcttagttttgngcgaggataaacttctacttcgattcgtcgtcggggccgcgggctacgtccgttaggtccctaacgttcgtccttcccgtccggtcccttcccgaacccgtaacgggtccccctaaggttccccggttccctttccccccggtagggccccgtccccgttggcccctacccgg

SEQ ID NO: 153527 - DNA, 708 bp, Homo sapiens
  misc_feature: GYAE6OF02FOQW0.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaacctgtctctttcctgcactgtctctactgtctccgtcaccgactccctgctggggctcgggtccggccgaacccccgagggaacggtcttgagtggattggagagtatcgtcggtccgggtagggcctacgtttacttaccgaacccgtaccctacgaaaacgaccgggcccgaccctagtccgaggggaccgacggaccgaaaggaaggtaacgttctcgtcgtgtagtttgtacgtttcgtggtcgacccgcccggacgacgacgccgggtccgttcgtttaagttttggtcgccggtaagggaacgtaaaaccgttacgttaacgttacgtaacgttcgttcggtacggggtcccaacgggtcctaacgttccgttcgtaccgtaaccgttcgttcccgttccgtcccggtctttccccgaaacccggtaaccggggtacccctacggtttacccggtccccgtttaccccccggtggtccccgtacccgtccgtcccgtacccgg

SEQ ID NO: 153528 - DNA, 723 bp, Homo sapiens
  misc_feature: GYAE6OF02HYO7I.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggtccttacggaaaccctgtctctttcctgcactgtctctactgtcctccgtcaccgatccctgcgtggggctgggtccgcaacccccgagggaaggtctgagtggattggagtatatcgtggtcccgggtaggggctacttacgtaacacccgtaccctacgaaaaggccggcccgtcctagtacgacggggaacacggaccaaaggaacggtaaacttccgtacgcgttaggaaggttttcgaccgtttcgtgtacggtacccggaccgaccgtaacgaccgtaccgggtccctttacttaagtttttcggtagtccggtaaaggtaacgtaaaaccttaacttaacgttcgaacgttcgtccggtcgggggcccgcgggtacctacgttcccgttaggtacctacgttacgttcccttaccgttaccgggtcccttaacccggaacccgtaaacggggtccccgtaacgttccccgggttaccccttacccccgggtcggccccggtacccgttccggacccttaaccccggg

SEQ ID NO: 153529 - DNA, 465 bp, Homo sapiens
  misc_feature: GYAE6OF02GMIXN.23.27.C05.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (444)..(465): a, c, t, g, unknown or other
  misc_feature (444)..(465): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgngcgaggagaaactactacttcgatctcgtgggccncggcatcctggtcactgtctccgtcggccttccaccgaacgggcccagtccggtccttcccccgtggccgcccctgcctccgaggacgccacctcgtgggggccacgacggccggcccgtgggcctcgccgtggtacaagggtaccttacgttccaattaccgtcggtcgtctggacggccgggcgtggacgaaggcgacagtagnnnnnnnnnnnnnnnnnnnnnn

SEQ ID NO: 153530 - DNA, 664 bp, Homo sapiens
  misc_feature: GYAE6OF02IJEAZ.23.27.C05.1.454.CMB.1.raw
  modified_base (214)..(214): a, c, t, g, unknown or other
  misc_feature (214)..(214): n is a, c, g, or t
  modified_base (640)..(640): a, c, t, g, unknown or other
  misc_feature (640)..(640): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttccngcactgtctctactgtcctccgtcaccgatccctgcgtggggctgggtccgaccaaccccgagggaacggtcttggagtggattggagattatcgttcggtccgggtagggctacgtttacttaccgaaccccgtacctacgaaaacggccgggtaccgaccctagtaccgaacggggaccacgggaccaaaggaaacggtaattccgtacgcgttaggtacgtttacgtactttcgtacggtcgaccggccgacacggaccgacggtccgttacgttagtttttgacggtacggaaggtaacgtaaacttacgttacgttcgacttcgtcggtcggggccgtcggacacgttccgtcggtctacgttcgttcctccgtccgtccgttaccgaccgacggtccctacgtcccggttcccttcccgnggtccctcccgtcgtccgtaccgg

SEQ ID NO: 153531 - DNA, 650 bp, Homo sapiens
  misc_feature: GYAE6OF02GABKR.23.27.C05.1.454.CMB.1.raw
  modified_base (284)..(284): a, c, t, g, unknown or other
  misc_feature (284)..(284): n is a, c, g, or t
  modified_base (536)..(536): a, c, t, g, unknown or other
  misc_feature (536)..(536): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtcctccaccctccctgtctgcatcgtgttggggaccagtcaccatcacgttggccgggcgagtcgtgtactagtttttcggttctttagtctggtactacaaaccaaaaccgtggttcncccctaccgtcctcgtcgctgtcactgacgtagttacgaaggtcgggtacccagtcgagtattcgagtggcaggtggtaggtcggtacctttacacttctacactactcggccgtccgtcggccggtacctaggtaagttacgttttacgggtactttacgtttcgtgtaccagtctaggttacttacgacttacgttaccccgaatacgtagtttccggacgtaacggggaacctaaggttccgaacctanacgtaacgacgttggttacgcttacgccgaccttgttaccgttcgttcttacctcgttcccttccccgaccgttattccgttaagacttccgtccgtacgttccaggtaccggg

SEQ ID NO: 153532 - DNA, 612 bp, Homo sapiens
  misc_feature: GYAE6OF02FYMEN.23.27.C05.1.454.CMB.1.raw
  modified_base (449)..(449): a, c, t, g, unknown or other
  misc_feature (449)..(449): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcatctcccagatgggccctgtcccaggcgcaagtgcaggagtcgggcccaggactggtgaggccttcggaaaccctgtctctttcctgcactgtctctactgtctccgtcaccgatccctgctggggctgggccgccaaccccgagggaaggtcttgagtggattggagatatctggtccggtaggggctacttataccaacccgtccctacaaaagccggccgacctatcgacggggacacggaccaagaacggaattcgtcgctagtagtttgactttcgtgtcgaccgccgacagacgacggccgttacttagtttttcgnggcgaggtacgaaactcttacttcgactcgtcgtcggggccgcggcacgttccgtggtcctacgttcgtcctcccgtccgtccttaccgaccggtaacgggcccctacgtcccggttcccttcccccggtggcccgtcccgttcgcccgttccgaggtacccg

SEQ ID NO: 153533 - DNA, 413 bp, Homo sapiens
  misc_feature: GYAE6OF02HUR0F.23.27.C05.1.454.CMB.1.raw
  modified_base (306)..(306): a, c, t, g, unknown or other
  misc_feature (306)..(306): n is a, c, g, or t
  modified_base (402)..(413): a, c, t, g, unknown or other
  misc_feature (402)..(413): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggccatcggtccttcccctgcgccctgctccnggagccacctcgtgggggcacgagcggccctgggcctgccgtggtcaaggacctacttccatactcgtcgtctgagcgggctggcgagcgcatagnnnnnnnnnnnn

SEQ ID NO: 153534 - DNA, 823 bp, Homo sapiens
  misc_feature: GYAE6OF02H9AND.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttacggaaaccctgtctctttcctgcactgtctctactgtctccgtcaccgatccctgcgtggggctcggggtccgaccaaccccgagggaacggtcttggagtggattggagtatatcgtcggtccgggtagggctacttactaccaaccgtccctacaaaacggccggccgaccctagtaccgaggggacacggacaacgaaagtaactcgtcgactaggtagtttcgactttcgtggtacggacccgccgtacgacggtaaccgacgggtcccgttacgtttaagtttttcgggtacggtaccgggtaaacgggtaaacgtaaaaacgttacctttaaaccgttaccggtaacttccggtttacccgggtacgggggggacccctaccggggtacccttaacggtttcccgttaccgggtacctaacccggtttccggttaccccgttaccccggtttcccggttaccccgttttaacccccggaaacccccggttaaaccggggggtccccccctttaaccgggtttacccccgggggtttaccccccgttttacccccccccgggtccgggggttacccccccgggttaccccccggttaccgggtaccccccgtttaaccccgggg

SEQ ID NO: 153535 - DNA, 860 bp, Homo sapiens
  misc_feature: GYAE6OF02J0Y9T.23.27.C05.1.454.CMB.1.raw
  modified_base (384)..(384): a, c, t, g, unknown or other
  misc_feature (384)..(384): n is a, c, g, or t
tcagacgcgagtatcacgaccggtgctcgatttagacgcgatcgaagggtttggggatgctctctgagagtcatggacctcctgtgcaagaacatgaagcacctgtgtttgcctctgctggtggcagctcccagatgggccctgtcccgaggcgcaagtgcgaggagtcgggcccaggactggtgaggccgttacggaaaccctgtcttctttcctgctactgtctctactgtctccgtcacgtactcctgcgtgggtcgtcgggtccggaccaaccccgaggggtacggtctaggaggtggtagttggacgtagtacgtcgtcggtaccgggtagggacctacgttacgttacccgaacccgtccgtacgaaacggccggccnccgttacgcggacgggacacggaccaaggaaggtactacgtcgtacgtgtacgtttacgtacgtttcgtggtacggacccgtccgacgtaaccggtaccgtaccgggtccgtttacgtttaggtttttcggtacgggaacggttaacggggtaaaccgtaaaccgtttacccgtttacgttacccggtaaagtttcccgggttacggggttaccgggggggtaccccgtacccgggttaccgtaccggttttacccgggtaacgggtttcccctaaccgggtttaccgggttttccccttaccccgggggtttccggtttaacccccgtttaacccccgggtaaacccccggggttacgggtaaaccccccctttacccggggttttccccggtttccccccccgtttaacccccggggttacccgggccccccggtttccccggttacccgggttaccccgttaacccccggggg

SEQ ID NO: 153536 - DNA, 628 bp, Homo sapiens
  misc_feature: GYAE6OF02HWFK0.23.27.C05.1.454.CMB.1.raw
  modified_base (460)..(460): a, c, t, g, unknown or other
  misc_feature (460)..(460): n is a, c, g, or t
tcagacgcgagtatcacgaccggtgctcgatttagacgcgatcgaagggtttgggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttctgcactgtctctactgtcctccgtcaccgatccctgcgtggggctgggtccggcaacccccgagggaaggtcttggagtggattggagatagtctggtccggtaggggctacttacttacaacccgtccctacgaaaacgacgggccgccctatacgacggggtacacggaccaagaaggaacttcgtcgctaggacgtttgacttcgtgtacgcccgcgcagacgacggcgttcttattttcggngacggaggacgtaaacctactacgttcgattctacggttggggcccgcggctactccgttcggtcaccgtgttcccttccgttcggtccccttccgaacccggaccgggtccctacgttacccgggttcccttcccccggtgggccccgtccccgttgcccctaccgg

SEQ ID NO: 153537 - DNA, 559 bp, Homo sapiens
  misc_feature: GYAE6OF02G1BKD.23.27.C05.1.454.CMB.1.raw
  modified_base (266)..(266): a, c, t, g, unknown or other
  misc_feature (266)..(266): n is a, c, g, or t
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (543)..(543): a, c, t, g, unknown or other
  misc_feature (543)..(543): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtcctccaccctcctgtctgcatctgttggggaccagtcaccatcacttgccgggcgagtcgtgactattttcggtctttagctggtatcaaacaaaaaccngggtttgcccctaccgtcctcgtcgctgtcactgacgagttacaaagtggggtcccatcgagattcagtggcagtggaggtgggtaccttttacactctcacaatcgcggcctgcggcctgaagtnttttgggactttactctgtcngcagtattanatacgtcccgtacactatttggaccaaggggacctaaagttcgacctcgtaactacgtaaactggtaggctggccactatctgttccttcacttccttcccgcctactctagaacttccnccgtcgttctgtacgg

SEQ ID NO: 153538 - DNA, 634 bp, Homo sapiens
  misc_feature: GYAE6OF02F2OMQ.23.27.C05.1.454.CMB.1.raw
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
  modified_base (462)..(462): a, c, t, g, unknown or other
  misc_feature (462)..(462): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctcgggtccggccaaccccgagggaaggtcttgagtggattggagatagtctcggtcccgggtagggcacttactaccaacccgtcctacgaaaacggacgggccncctagtcgacggggacacggccaaggaaggaacttcncgcgtagtagtttgacctttgtgtcgaccgccgacacggacgaccggtccgtcttacttttggngacggtaaggaagtaaactacttacttcgattcgtcggtcgggggccgcgggcctagttccgtggtacctacgtcgttccttccgttcggcccttcccgaaccgtaacgggccctaacggttcccggttcccgtttcccccgtagggtcccgtacccgtcggccctaccggg

SEQ ID NO: 153539 - DNA, 762 bp, Homo sapiens
  misc_feature: GYAE6OF02JO6DO.23.27.C05.1.454.CMB.1.raw
  modified_base (219)..(219): a, c, t, g, unknown or other
  misc_feature (219)..(219): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatcgggccctgtcccaggcgcaagtgcaggagtcgggccagggactgggtgacggccttacggaaaccctgtcctctttccngcactcgtctctactgtcctccgtacaccgtactcctgcgtggggtctcgggtccgacaaaccccgagggaacgggtcttaggagtcggtattcggatagtatcgtggtcccggtagggtcctacttacgtaccgacccgtcctaagaaacggccggcctcctacgtcgaacggggacctacggacgaaagacggtaacttcgtacgactagtacgtttcgaacctttcgtcggtcgaacccgccgtacgtacggaccgtacggtccgttacgtttacggtttttacggcggtaaccgggaaacggttaacgtaaaacccgtttaccgtacgtttaacggaacggtttaccgttacccggggttaaccggggccccgtacgggggtaacctaccgtttcccgggttacggtacccgtaaccgttcggttaccttcccgggttaccggtccctttaacccggaacccgtaacgggtaccctaggttccccggttaccccgttcccgtagggttcccccgtacccgtttgaccccgttaacccgg

SEQ ID NO: 153540 - DNA, 537 bp, Homo sapiens
  misc_feature: GYAE6OF02I5SVH.23.27.C05.1.454.CMB.1.raw
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
  modified_base (517)..(517): a, c, t, g, unknown or other
  misc_feature (517)..(517): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctgggctggtccggcaaccccagggaggtctgagtggattggagatatctggtcccggtaggggctacttattaccaacccgtccctacaaagacggccncctatcagggacacggcaaggaagattcncgctgagttgacttntgtgaccgcgcagacacggccgtcttnttttgngcgaganaactctacttgactctcgtgggccgngcatccgtgtcactgtctcctcgcttccaccgtacggcccagttcggtcccttccccgnggccctcccgtgcctaccgg

SEQ ID NO: 153541 - DNA, 599 bp, Homo sapiens
  misc_feature: GYAE6OF02GP4M7.23.27.C05.1.454.CMB.1.raw
  modified_base (451)..(451): a, c, t, g, unknown or other
  misc_feature (451)..(451): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctcttctgcactgtctctactgtctccgtcaccgactccctgcgtggggctcgggtccggccaaccccgagggaaggtcttgaggtggagttggagatatcgtcggtcccgggtagggctacttactaccaacccgtcctacgaaaacgcggccgacctatcgagggacacggacaagaagatctcgctgtagttgacttcgtgtcgacccgtccgcacgacgtacggtccttcgttagttttcgngacggaaggtaagtaaacttactacttcgtatccgtcggtcggggccgtcgctacgttccgtggtaccacgttcgtcctccgtcggtccttccgaccgtacggtccctagtcccggttccttccccgtggcccgtccctcgctaccgg

SEQ ID NO: 153542 - DNA, 705 bp, Homo sapiens
  misc_feature: GYAE6OF02H1OWL.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctgggtccggcaaacccgagggaggtctgagtggattggagatatcgttcgtccgggtagggctacttataccaaccccgtcctaacaaaacggcgggccacctagtcgagggaccacggacaaagaaggaattcgcgtacgtagtgtttagacttcgtcggtcgaacccgtcgactaacgacgacgggtccttagtttatttttggacgaccggtaaggtaaacgtaaaacgttacttacgtttaccgaattccgtacgggttcgggggacccgtacgggctagttacccggtggttaccaccgtttcgtacccgttccgttaccgggtacccttacccgaacccggtaaccgggtaccccttaacgggttccccgggtttaccccctttcccccggtaccgggtcccccgtccccggttaggtcccccgttaccggaacggggtaacccg

SEQ ID NO: 153543 - DNA, 564 bp, Homo sapiens
  misc_feature: GYAE6OF02F5OJ4.23.27.C05.1.454.CMB.1.raw
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
  modified_base (469)..(469): a, c, t, g, unknown or other
  misc_feature (469)..(469): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgagggaaggtcttgagtggattggagatatctgtccggtaggggcacttattacaacccgtcctacaaaagcggccncctatcgagggacacggccaagaaggaattcncgctgtagtttgactttctgtcgaccgccgcagacacggccgtctattttgngcgaggagaaactctacttcgatctcgtggggccncggcagtcctggtcactcgtctccgtcggtccttccgaccaacgggcccctaagttcccggttcccttcccccggtggcccgtccctgcctcccg

SEQ ID NO: 153544 - DNA, 574 bp, Homo sapiens
  misc_feature: GYAE6OF02FJ1QO.23.27.C05.1.454.CMB.1.raw
  modified_base (441)..(441): a, c, t, g, unknown or other
  misc_feature (441)..(441): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccgcaaccccagggaggtctgagtggattggagatatctggtcccggtaggggcacgttattaccaacccgtccctacaaaagacgggccgccctatcgagggggacacggccaaaggaaggaacttcgcgctggagtttgactttctgtgaccgccgcagacacggccgtcttattttgngcgaggagtaaactctactcgatctcgtgggccgcgcattccgtgtcactcgtcttccgtcggtccttccaccgtaacgggcccctagtccggttccctttcccccgtggcccgtcccctaggccctacccgg

SEQ ID NO: 153545 - DNA, 785 bp, Homo sapiens
  misc_feature: GYAE6OF02IY9LB.23.27.C05.1.454.CMB.1.raw
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctccaggaacgaagggtgacgttcagatcgacccagtctccaccctccctgtctgctatctggtgggaccgacgtcaccatcacgttcgccgggcgaggtcgtgactagtttttcggttctttagtctggtatacaaactaaaaacgtgggtttcaccctaccgtctacgtcgtctcgtcagtcgacggtaacgttaacgaacggttcgggtacccagtacgngtacttcgaggtcgntaggtaggagggttcggttaaccttttacacttacgtaccaacgtaacgttccggaccggtccgtcggtccggtactaggtaaaggtttaccggtttttcgggtaacctttaccgtttacgtcggttacgaacgtccgttaaagttacttaacgtaaccgttaccggttaacccgtaactacgttacggtttacccgggaacgtaccgggggttaaaccctaaagggtccttaaccgttaccgtaaacgttacggtaaaccgtttggggttaccgtacgtccggtaaccgtaaacccgtgtttccggacttttccgttaaactccccgtttaacccgggttcccctaacgtaacggtttaccttaacggtaaacccgtttcccgtaccgggttcccttacgggtccgtaaccgggggg

SEQ ID NO: 153546 - DNA, 728 bp, Homo sapiens
  misc_feature: GYAE6OF02JQRTO.23.27.C05.1.454.CMB.1.raw
tcagacgcgagtatcacgaccggtgctcgatttagacgcgatcgaagggtttgggggcgtctctgagagtcatggacctcctgtgcaagaacatgaagcacctgtggttttgcctcctgctggtggcagctcccagatgggccctgtcccaggcgcaagtgcaggagtcgggcccaggactggtgaggcctcggaaaccctgtctctttcctgcactgtctctactgtctccgtcaccgtactccctggctggggctgggtccgccaaccccgagggaacggttctggagtgattgggagatacgtcgtcggtaccgggtagggcctacgttaacttacccgtaaccccgtcctaccgtaaaaaggaccgggcccgtacccttaagtccggtaacggggaacaccgggaccaaaggtaacggtaaactttcgacgtcgtacgttagttacggtaacctttcgtggtacgacccgtcgacacggacgaccggtccgtactttagttttggagtaccggtagggaacgtaaaccttacgtacgtttacgaacttccgtcggtcggggaccgtcggcctactccggttacgtacctcggtcgttacccttccgttccggtccctttacccggaaccgtaacccggggttcccctagggttaccccgggttcccctttaccccgggtccggtccccggtcccgttacgggtccctacccggacggtacccgg

SEQ ID NO: 153547 - DNA, 711 bp, Homo sapiens
  misc_feature: GYAE6OF02J14C4.23.27.C05.1.454.CMB.1.raw
  modified_base (216)..(216): a, c, t, g, unknown or other
  misc_feature (216)..(216): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggtccttcggaaaccctgtcttctttccngcactgtctctactgtctccgtcaccgactccgtgcgtcgggctcgggtccgaccacccggagggtacggtcttgacggtggtagttggagatacgtcgtcgggtacccgggtaggggtcctaacgttttaaccgttaacccgtaaccccgttacccgtaaccgtaaaaccgggtccccggggtcccgacccgttaacgaccgggaccgggggtaaccgaaccgggaccgtaaagggaaacgtaactttccgtcggtcgtaggttacgtttcgtacctttcgtcggtaccggacccgtcgaccgtaacggaccgtaccggttccgtttacgtttagttttcgaggacgaaggttaactaacgttctacttcgacttcgtacgggcgggccgtacgctacgttccgtcgactcgtcttccgtcgcgttacctccgaaccgtcggtcccttagtcccgttacccttccccggtacggcccgtcctcgtcccgtaccg

SEQ ID NO: 153548 - DNA, 682 bp, Homo sapiens
  misc_feature: GYAE6OF02I0GQ6.23.27.C05.1.454.CMB.1.raw
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (295)..(295): a, c, t, g, unknown or other
  misc_feature (295)..(295): n is a, c, g, or t
  modified_base (391)..(391): a, c, t, g, unknown or other
  misc_feature (391)..(391): n is a, c, g, or t
tcagacgcgagtatcacgaccggtgctcgatttagacgcgatcgaagggtttggggatgctctctgagagtcatggacctcctgtgcaaagaacatgaagcacctgtggttttgcctcctgctggtggcagctcccagatgggccctgtcccaggcgcaagtgcaggagtcgggcccaggactggtgaggccttcggaaccctgtctctttccngcactgtctctactgtctccgtcaccgactcccngcgtgggcgtcgggtccgccaaccccgaggaggtctgagtgatgganatagtcgtcggtccggtagggctacgttactaccaacccgtcccaacgaaacggccggccgacctagtacgagggacacgacgaagaagtacttcncgctagtagttagtactttcgtgtcgaccgcgacgacgtacgaccggtcccgttactttagtttttcggcggtacggaacgggtaacgtaaaccgtttacttaaccgttaccggtaaccttcgtacgggttcgggggcccggtacggctacgttcccgtggttaccctacgttccgttaccgttcccggtccggttcccttaacccgtaccggaaccggggtcccttaacggttccccggttccccgttacccccgtcgggtaccccgtcccgttaccggcccgtacccgg

SEQ ID NO: 153549 - DNA, 685 bp, Homo sapiens
  misc_feature: GYAE6OF02HL7NU.23.27.C05.1.454.CMB.1.raw
tcagacgcgagtatcacgaccggtgctcgatttagacgcgatcgaagggtttgggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttacggaaaccctgtctctttcctgcactgtctctactgtctccgtcaccgatccctgcgtggggctgggtccgaccaaccccgagggaacggtctgagtggattggagtatactcgtcggtccgggtagggctacgttataccgaacccgtcctacaaaggaccggccgaccgtagtacgacggggtaccacggaccgaaaggaaacggtaacttcgtacgtcgtacggtacgtttacgactttacgtcggtacgacccgccgacgacgacgaccggtccgttactttagttttcggagtacggaaggtaacgtaaactacgttaccgttacgacgttctcgggttacggggccgaccggtaccgtacgttccgtcggtacctaacgtccgtcgttcccgtcgtcccgttaacccaccggaaccggtaccctaccggttcccggtcccgtttacccccggacgggtccccgtcccgtacgtcccgtaccggg

SEQ ID NO: 153550 - DNA, 737 bp, Homo sapiens
  misc_feature: GYAE6OF02GVC6S.23.27.C05.1.454.CMB.1.raw
  modified_base (271)..(271): a, c, t, g, unknown or other
  misc_feature (271)..(271): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctgggtccgcaaccccgngggaggtctgagtggattggagatactctcggtcccggtaggggctacgttactaaccaaccccgtccctacgaaaacggccgggaccgacccgtagtcggaacgggggaccaccggaccgaaaggaacggtaactttcgtcggacgtagtacggtttagacgtttcgtcggtacgacccgccgtaccgacggaccgacccgggtcccgttacgtttacgtttttcgggacggtacgggtaaacgggaacgtaaaaccgtttaccgttaacctttacggaacttccgttccgggtcgggggtaccccgacgggtactaccgttcccgttcggtacctacgttcgtacccgttccgttccggttaccttcccgaacccgggtaaccgggtcccctaacggttcccgggttcccctttacccccggcgggtcccgtccccgtcggtacctacccggaacggtacccgg

SEQ ID NO: 153551 - DNA, 688 bp, Homo sapiens
  misc_feature: GYAE6OF02JEXI1.23.27.C05.1.454.CMB.1.raw
  modified_base (362)..(362): a, c, t, g, unknown or other
  misc_feature (362)..(362): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgacggccttacggaaacctgtctctttctgcactgtctctactctcctccgtcaccgtctccctgcgtggggctcgggtccgccaaccccgagggaaggtctgagtggagttggagatatctcggtcccgggtagggctacgttactaccaacccgtccctacgaaacgccgggccncctagtcgaggggacacggaccaagaagtacttctcgacgtgtacgttgactttcgtgtcgacccgcgcgaacggactacggtccgttcttagttttcgcggcggaaggtaacgtaaaccttattaccgttcggtacttccgttcgggtaccggggtccggaccggtactaccggttaccgttcgggtaccctaacgttccggttccctccccggtttaccggtcccgtttaaccccgacccggtaaaccgggtcccctacgtttcccgggttacccccgtttcccccggtcgggttccccgtcccggtaccgttcccgtaccggg

SEQ ID NO: 153552 - DNA, 496 bp, Homo sapiens
  misc_feature: GYAE6OF02JRKFX.23.27.C05.1.454.CMB.1.raw
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
  modified_base (457)..(457): a, c, t, g, unknown or other
  misc_feature (457)..(457): n is a, c, g, or t
  modified_base (460)..(496): a, c, t, g, unknown or other
  misc_feature (460)..(496): n is a, c, g, or t
tcagacgcgagtatcacgaccggtgctcgatttagacgcgatcgaagggtcttgagtggattggagatatctgtcccggtaggggcacttattacaacccgtccctcaaagacgggccgccctatcagggacacggccaagaggaatctgctgagtttgacttctgtgaccgccgnagacncggccgtctatttttgtgcgnggagaaactctacttcgatctctggggccnggcatccctggtcacgtntctcctcggcttccaccgaagggccatcgtcttccccctggccnccctgacctccgcggacgcctacctcggtcgggggccacgacgccggcccgtggcctcggtcctcgggttcaacggtacctaccgttccagtacccttcggccggttactcggtacggcgggccgttcgggacgaacggccgacgacgttaaggctgaggtcngcnnnnnnnnnnnnnnnnnnnnnnnnnnnnnnnnnnnnn

SEQ ID NO: 153553 - DNA, 617 bp, Homo sapiens
  misc_feature: GYAE6OF02GUXXA.23.27.C05.1.454.CMB.1.raw
  modified_base (280)..(280): a, c, t, g, unknown or other
  misc_feature (280)..(280): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctcttctgcactgtctctactgtctccgtcaccgatcctgctgggctgggtccgcaaccccgaggtaggtctgngtgattggagatatcgtggtccggtagggcacttactacaacccgtccctagaaacgcgggccncctatcgagggacacggacaagaagattcncgctgtagttgactttcgtgtcgacccgcgacacgaccgacggtccgtactttagtttttcgcggtacggagggtaacgtaaacgttacttacgttcgtaacttccgttcggtcgggccgcggcctacgttcccgtggtccaacgttcgtaccgttccgtccggtccttacccgaccggtaaccgggtccctacggttccggttcccgttccccggtacggcccgtcccgtgtcccgtaccgg

SEQ ID NO: 153554 - DNA, 469 bp, Homo sapiens
  misc_feature: GYAE6OF02HZJM1.23.27.C05.1.454.CMB.1.raw
  modified_base (299)..(299): a, c, t, g, unknown or other
  misc_feature (299)..(299): n is a, c, g, or t
  modified_base (446)..(469): a, c, t, g, unknown or other
  misc_feature (446)..(469): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaaggcccatcggtccttcccctggccnccctgctccaggagccacctcgtgggggccacgacggccggcccgtgggcgtcgccgtgggtacaaacgggtaccttacccgttcctaactaccgtccggtccgttcgtggacggccgggtcgtcgggacgaacggccgacagtagnnnnnnnnnnnnnnnnnnnnnnnn

SEQ ID NO: 153555 - DNA, 700 bp, Homo sapiens
  misc_feature: GYAE6OF02F3MZ1.23.27.C05.1.454.CMB.1.raw
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (402)..(402): a, c, t, g, unknown or other
  misc_feature (402)..(402): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccgagggaggtcttgagtggattggagatatctgtcccgggtagggctacttattaccacccgtcctacaaagccggccncctancgaggggacacggccaaagaggaattctacgctgtagtttgactttntgtcgaccgccgcacgacacggtccgttacttacgtttttggacggtcggaagggtaacgtaaaaccgttaaccgttaaccgtttaccggactttaccgttccgggttacggggggccccgtacgggcctacgtttcccgtagggttaccctacgttcgttacccgtcccgttccgggtaccctttccccgaacccggtaaaccggggcccccttaacggttccccgggtttacccctttccccccccggtaggggtccccccgtacccccggtttcggtacccccgttaacccgggg

SEQ ID NO: 153556 - DNA, 647 bp, Homo sapiens
  misc_feature: GYAE6OF02H3FNU.23.27.C05.1.454.CMB.1.raw
  modified_base (391)..(391): a, c, t, g, unknown or other
  misc_feature (391)..(391): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactgggtgaggcctttcggaaaccctgtcctctttcctgcactgtctctactgtcctccgtcaccgactccctgcgtgggctgggtccggcaaccccgagggaggtctgagtggtagttggagattatcgtcggtccggtaggggctacttattaccacccgttcctacgaaacggcggcccgcctatcgagggacacggacaagagtatcncgctgtagttgactttcgtgacgtacccgccgtcgacgaccgtaccggtccgttctttagttttgcggtacgtagggtaaactaaacttacttacgttcgattcgtcgtacggggccacgggtacctacgtaccgtgggtaccacgttgttacccttccggttacgtcccgttacccgaacccggtacgggtcccctaacgtcccggtttccctttcccccggcgggtccccgtcccgttcggacccttacccggg

SEQ ID NO: 153557 - DNA, 404 bp, Homo sapiens
  misc_feature: GYAE6OF02H947Y.23.27.C05.1.454.CMB.1.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (399)..(404): a, c, t, g, unknown or other
  misc_feature (399)..(404): n is a, c, g, or t
tcagacgcgagtatcacgaccggtgctcgatttagacgcgatcgaagggtcttgagtggattggagatatctgtcccggtagggcacttattacaacccgtccctcaaaagacgggccgccctatcaggggacacggccaagaaggattctcgctgagtttgacttctgtgaccgccgcagacacggccgtctatttttgngcgaggagaaactactacttcgatctcgtggggccgcggcatcctggtcactgtctccgtcggcttccaccgaaggcccatcggtccttccccctggccgcccctgctccgaggagcaccgtcgtgggggcacgagccggcccgtgggctgcctggcaagactactccatactcgctngcgcggcngcgagcnatagnnnnnn

SEQ ID NO: 153558 - DNA, 639 bp, Homo sapiens
  misc_feature: GYAE6OF02F2CYZ.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctgggtccgccaaccccgagggaaggtcttgagtggattggagtatatctggtcccggtagggctacttataccaacccgtccctacgaaaacgccgggccgccctatccgacggggacacggaccaaaggaaggaacttcgcgctgtagtttgacttgtcgtcgaccgccgacagacgaccggtccgttacttatttttcggcgtcggaaggtaacgtaaactaccttacgttcgaattcctacggtgggcccgcggcctactcccgttaggtctaccgttcgtcctaccgtccggtccttacccgaaccgtaacgggccctaagttcccggttcctttacccccgtggtcccgtccccgtcggacccttccggacggtacccgg

SEQ ID NO: 153559 - DNA, 793 bp, Homo sapiens
  misc_feature: GYAE6OF02IA4PE.23.27.C05.1.454.CMB.1.raw
  modified_base (480)..(480): a, c, t, g, unknown or other
  misc_feature (480)..(480): n is a, c, g, or t
tcagacgcgagtatcacgaccggtgctcgatttagacgcgatcgaagggtttgggggagtcagaccctgtcaggacacagcatggacatgagggtccccgctcagctccgtgggctcctgctgctctggctccaggaacgaagggtgacgttcagatcgacccagtctacccaccctccctgtctagcctatcgtagggttgggacccgagtccaaccatcgtaacttcgggccgggcgtacggttccggtaagtacttacggttttttcccggtttctttaacggtcgttaggtacttaaccaaaaaccgtaaaaaaccgtcgggggttttaccaccccccgttaaccgttccgttccggtcctcttcggtccacgttgaaccgtagttaacgaaacggttcggggtcccagtccgtatacgttcacggtgaaccgttggtacgggtacgggttaggttacccttttacgacctttacncgaaactaggtcccgcgtccgcggtcgacttacggtaagttaacgtttcgggtactttacgtttcgttcgtcgacggtcttaaggtacttaagtactaccggttccctaactagtaccgtttgaccggaacgggttaaacgtaacgtccgtaaccgtttcaaaggtacccgtagttcggtacggttcctaagtaccgtaaccttaccacctttggtttaccctaccggttccttaccccgttcccggaacgtttaccctaggttactaaacccggttcgttacccgcccgttttagggccggttaccccgggg

SEQ ID NO: 153560 - DNA, 706 bp, Homo sapiens
  misc_feature: GYAE6OF02H4T2L.23.27.C05.1.454.CMB.1.raw
  modified_base (447)..(447): a, c, t, g, unknown or other
  misc_feature (447)..(447): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtgcagctcccagatgggccctgtcccaggccgcaagtgcaggagtccgggcccaggactggtgaggtccttaccggaaaccctgtctctttacctgcactgtctctactgtctccgtcaccgatccctgcgtgggctcgggtccgccaaccccgagggacggtacttggagtaggtattaggagacgtatcgttcggtacccgggtagggcctattaacttaccaacccgtcctaacaaaacggccggccaccctagtcgaacgggaactaccgggaccaaagggtaacgtaacttcctacggtacgtgttaacgggttttanaccgttttacgttggtaccggtaaccccgcggtaaccgtaacggtaacccgacccggggttccgtttaccgtttaaagttttttcgggaccggtaacggaacggtaaccgtaaaaccgtttaacgttaccgttacgaacgttcgtcgttacgggggcccgtcgaccttactacccgtgttaccagttcgacctccgttacgtcctaccaccggtaacggccctagtccgtcccgttacccgtcgcccgctcgccctacg

SEQ ID NO: 153561 - DNA, 723 bp, Homo sapiens
  misc_feature: GYAE6OF02HNFKU.23.27.C05.1.454.CMB.1.raw
  modified_base (214)..(214): a, c, t, g, unknown or other
  misc_feature (214)..(214): n is a, c, g, or t
  modified_base (506)..(506): a, c, t, g, unknown or other
  misc_feature (506)..(506): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactgggtgaggccttacggaaaccctgtctctttccngcactgtctctactgtctccgtcaccgctcccgtgcgtggggctgggtccgacaaccccgagggaaggtctgaggtgagttggagtatatcgtcggtccgggtaggggtcctacgttacttaaccgaaccccgttcccaacgaaaacggtaccgggcccgaccctagtccggtaacggggacaccgggacccaaagggaacggtatttccgacgcgttggtaagtttcgaactttcgtggttaccgacccgccgacgacggaccgtaccggtccgttacttacgttttcggngtaccgggaagggtaaaccgtaaaccgttacgttaaccttacggtacttcctaccgggttacggggaccgtcgggtcctaacgtccggtaagtcctacgtacggttccctacgtccgttaccttacccgaccggtaacggaccccgttaacgttcccggttccccgtttaccccggtcggtcccgtaccccggtgttccccgtaccgacggtacccg

SEQ ID NO: 153562 - DNA, 631 bp, Homo sapiens
  misc_feature: GYAE6OF02GHW1V.23.27.C05.1.454.CMB.1.raw
  modified_base (212)..(212): a, c, t, g, unknown or other
  misc_feature (212)..(212): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaacctgtctctttccngcactgtctctactgtctccgtcaccgactcctgcgtggggctcgggtccgccaaccccgagggacggtcttgagtggtattggagatatcgtgtcccggtagggctacttactaccaccgtccacaaaggccggccacctagcgacgggacacggacaagaagatctcgtcgtgtagttgtacctttgtcggtcgaccgtccgacgacgtacgaccggtccgttactttacgtttttaggcgtacggtaacggtaacgtaaacctacttaacgtcgtacttcgtcggtcgggccgtcggtcctagttccgtacgtcctacgttcgtccgttccgtccggtctacccgacccggtaaccggccctacggttcccgttccccgttccccggtacggtccccgtcccgtcgccgtacccgg

SEQ ID NO: 153563 - DNA, 719 bp, Homo sapiens
  misc_feature: GYAE6OF02HAJSZ.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggaggtccgggcccaggacgtggtgacggccttacggaaaccctgtctctttcctgcactgtctctactgtctccgtcaccgactcctgcgtgggcgtcgggccgaccaacccgagggacggtctggagtggtagttggagtagtatcgtcggtccgggtagggactacgttacttaccgaacccgtcctacgaaacggccggaccgcctagacgacggggacacggaccaaaggaagtaacttcgtcgcgttagtacgtttgtactttcgtcgtacggacccgtcggacgagaaccgtaccggtccgttactttaggtttttcggacggacggtaacgggtaactaaaccttaccgttaacttacggtaccgttcgttaccgggtacggggacccgtaacgggtacctacgttacccgttgggtacctacgttcgttccctccggttccgttacccgtacccggtaacccggtaaccggggtccccttacgggtttacccggttccccttccccgggtacggtccccgtacccgttcggaccccttaacccggg

SEQ ID NO: 153564 - DNA, 726 bp, Homo sapiens
  misc_feature: GYAE6OF02GET57.23.27.C05.1.454.CMB.1.raw
  modified_base (570)..(570): a, c, t, g, unknown or other
  misc_feature (570)..(570): n is a, c, g, or t
tcagacgcgagtatcacgaccggtgctcgatttagacgcgatcgaagggtttggggatgctctctgagagtcatggacctcctgtgcaagaacatgaagcacctgtgttttgcctcctgctggtggcagcctcccagagtcgggccctgtcccaggcgcaagtgcaggagtccgggcccaggactggtgagtccttacggaaaccctgtctctttcctgccactgtctctactcgtcctccgtcaccgtactcccgtgcggtcgggtcgtccgggtccgacccgaaccccggagggtacggtcttaggaggtcggtagtaggagtatagtcgtcggtccgggtagggctacttaacgtaacccgtaaccccgtaccctaacgaaaacggccggaccggacccgtactacggacgggaaccggaaccggaaccggaacgaaacggtaacgttaccgtccgtacgtacgttagttacgtttcgttacgtacgtacgtacccggccgcgtacgaaccgtcggtaccgtctttacgttagttcgaggtacggaacgtaactacgttactacgtntcgtcgtcgggtccggcgtacgtccttaccgtgtaccgtactcgtaccttccgtccggtacccgttcccgaaaccgtacccgggtaacccttccgttacccggttccccgttaccccggttccccggcccgttccccggtccgtacccggtacccg

SEQ ID NO: 153565 - DNA, 673 bp, Homo sapiens
  misc_feature: GYAE6OF02HMQK4.23.27.C05.1.454.CMB.1.raw
  modified_base (214)..(214): a, c, t, g, unknown or other
  misc_feature (214)..(214): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctccagatgggccctgtcccaggcgcaagtgcaggagtcgggcccaggactggtgaggccttacggaaaccctgtcttcttccngcactgtctctactgtcctccgtcaccgtactccctgcgtggggctgggtccgccaaccccgagggacggtctgaggtggagtggagatatcgttcggtccgggtagggactacgttactaaccgtacccgtacctaacgaaaacggccgggcctaccgtagacggacgggacacggaccaaaggaacgtactcgtcgtgtagtacgttcgtacttcgtagtccgaccgccgacacggtaccaccggtcgttacgtttaggttttacgcgggtaacggaacggtaactaaaaccttacgtttaccttacgacttcgtcgggtacggggtccgcgtacctcgttccgtggtcacgttctccgtcccgttcggcccttaacccgccgggtaaccggtcccgtacggtttcccggtaccccttccccggacggtccccgtcccgttcggtaccctacccggg

SEQ ID NO: 153566 - DNA, 790 bp, Homo sapiens
  misc_feature: GYAE6OF02GUBSY.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctctgctggtggcagctcccagatcgggccctcgtcccaggcgcaagtgcaggagtcgggcccaggactggtgaggcccttacggaaaccctgtctcttcctgcactgtctctactcgtcctccgtccaccgactccgtgcgtggggcgtcgggtccgccaaccccgagggacggtctggacgtggattggagtatacgtcgtacggtccgggtaggggctaacgtttaactaccgtaaccccgtccctaacgaaaacgggcccggccaccgtacgtaccggaacggggaccaacggaccgaaaggtaacggtaacgttccgtacgtacgttaggtacggtttacgtaccgtttcgtcggttccggacccgtccggtaccgaacggacccggtacgggttcctttacgttttacgttttcgggacggtaccgggtaaaggtaaaccggttaaacccttacgttaccgtttacgtaccggttaccgttccggggtacccgggggcccgtacgggtaccttacgttcccgggttacggtccttacggttcgttaccccgttccgtccggttacccttaaccccgaaaccgggtaacccgggtcccctaacggtttccccggttacccctttccccgggccggtcccccgtacccgttcccgggacccttaaccccggg

SEQ ID NO: 153567 - DNA, 988 bp, Homo sapiens
  misc_feature: GYAE6OF02J1OGS.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccagggcgcgagtgcaggagtcgggcccaggactggtgaggccttacggaaaccctgtctctttcctgcactcgtctccttactcgtctccgtccaccgtactcccgtgtcggtcggggtcgttcgggtcccggccgtaacccccggaggggtaacgggttccgtttagacggttagggtagttgggaacggtagttaacgtccgttcggtaccccggggttaaggggtacctaaccgttttaaccgtttaaaccccgtaaaccccccggttacccgtaaaccggtaaaacggggtaaccccgggggtaccccgtaaccccgttacgttaacccggaacggggggtaacccgaaccgggaacccgaaaacgggtaaaaccgggttaaacgtttcgtacccggtacgtttacgggttaacggttttaccggtaacgttttaccggttacggttaccggtacccggacccggccggtaacggaaacccggttaccgggttccctttaaacgttttaacggttttttcgggtaccggtacccggggtaaaggtttaaaaccggaaaaccgttttaacccggttaacctttacgggtaaacccgtttcccggttaccggggttacggggggtacccccggaccggggttaccgtaaccgtttccccgggttaacgggtttacccgtaacgggttttccgttaacccggttcccggttacccggttacccgttaaccccggaaacccgggttaccgggtacccccgtaccggttttccccggttacccgtttcccccccgggtacgggttcccccgttcccggttaccggttccccctaacggg

SEQ ID NO: 153568 - DNA, 611 bp, Homo sapiens
  misc_feature: GYAE6OF02F8622.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtctgcatctgttggggaccgagtcaccatcacttggccgggcgagtcgtgactattttcggttctttagtctggtatacaaacaaaaaccagggttcgcccctaccgtcctcgtcgctgtcactgacgagttacaaaggtgggtccatcgagattcagtggcagtggaggtggacttttacactctcacatcgcgctgcgctgagtatttgggacttacgtctgtcagctagtattacagttacgtcccgtaacactagtttcggaccgaacggggtaacctaaaggtttcgaaccgtacaattaaccggtaaacgttcggtacggtctaggacctaccgtattccgttcgttacctttcctaacgttcccttccccgtaccctagttaccgtacggtaacttaccgtccggtaccgttcgtggtaccggg

SEQ ID NO: 153569 - DNA, 458 bp, Homo sapiens
  misc_feature: GYAE6OF02FIVZP.23.27.C05.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (419)..(458): a, c, t, g, unknown or other
  misc_feature (419)..(458): n is a, c, g, or t
tcagacgcgagtatcacgaccggtgctcgatttagacgcgatcgaagggtcttgagtggattggagatatctgtcccggtagggggcacttattacaacccgtccctcaaaagacgggccgccctatcaggggacacggccaagaaggaattctcgctgagtttgacttctgtgacccgccgcagacacggccgtctatttttgngcgaggagaaactactacttcgatctcgtggggccncggcatcctggtcactgtctctcggcttccacgaggccatcgtcttccccctgccgcctgctccaggacgcacctcgtggggcacgagccggcccgtgggcctcggcctgggtacaaggtacctacttccatctcgtcgtctggcgcgggctggactaacggcacagtcgntnangcnnnnnnnnnnnnnnnnnnnnnnnnnnnnnnnnnnnnnnnn

SEQ ID NO: 153570 - DNA, 694 bp, Homo sapiens
  misc_feature: GYAE6OF02IT3Q0.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgacccagtctccaccctccctgtcctgcatcgtggttacggggaccgagttccgaaccctatccgacgttggccgggacgtagtcgtgacctagttttcggttctttagtctggtactacaaactaaaaaccgtcggtttcgccccttaccgtctccgtcgcttcgtcacgtgacgtagttaaccgaaaggtccgggtaccagtcgatacttcgagtcggctacggtgggacggtcggtacctttacacgtcgtacacgtaacgtccggccgtacgtggaccggtcgtaagaacgtttgttttacgggactttacgttcgtcgtacgagtacgtacgttattacaagttaccggtacccgtactaacgttacgtttacggccgtaaagggacccttaaaaggtccgtaacctacgtaacgttaccgaacgttcggtacggacttcgtcctaaccgtagttccgttaccgtacttaccgctttacccgttccgacttacgttctaacgtaactccgtcgtaccgtcggtacgtacgg

SEQ ID NO: 153571 - DNA, 709 bp, Homo sapiens
  misc_feature: GYAE6OF02JJ9GZ.23.27.C05.1.454.CMB.1.raw
  modified_base (165)..(165): a, c, t, g, unknown or other
  misc_feature (165)..(165): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctcccaggaacgaagggtgacgttcagatgaacccngtctccaccctccctgtctgcatctgttggggaccagtccacatccgacttgccgggcacggtcgtgactattttcggttctttagtccttggtactacaaactaaaacctagggttcgcccctaccgtcctcgtcgctgtcacgtagacgtagtacgaaggtcgggtccatcggagtattgagtcgacgtagtgggtaggtacggtaccttttacgacttactcgactaacgtcgaccgtctcggcgtaccgtaggtaacgtagttttacgggtaactttacgtttcgagtttaccgagtacgtaagtttaacttaacgtacgttacgttaccccgttaactaccgttagtttacgggacccggtaagggggtaaccttaaaacggttaccggtaccttacgtaacttaaacggtaccgttaggtaccgggtcttacggacctaaccgtattccgtcgttaactttccgtaacttccgtcccgtaaccgtcgttaccgttaacgtaccgtttaccgtacgtaccggtttactcggtaacgggg

SEQ ID NO: 153572 - DNA, 712 bp, Homo sapiens
  misc_feature: GYAE6OF02I7T7F.23.27.C05.1.454.CMB.1.raw
  modified_base (213)..(213): a, c, t, g, unknown or other
  misc_feature (213)..(213): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggccaggactggtgaggccttcggaaaccctgtctctttccngcactgtctctacgtcgtctccgtcaccgactccctgcgtgggctcgggtccgccaaccccggagggaggtctgagtggattggagatacgtctcggtccgggtagggcctacgttactaaccgacccgtcccgtaagaaacgcgggacctcctacgtcggaagggactacggaccaaaggaacgtaacttcgacgtacgtacggtagtttcgtacgtttcgtgtaccgaccgaccgacgacgtaccggccgtccgttactttacgttttggacggtaccgaaggaacgtaacttacgtaccgttcgtagtccgttcggccgggaccgtccggctacgttcccggtacgttacccgtaacgttccgttaccgtcccggttccgttacccgtttaacccggaacccgggtaaccggtacccgtaaccggtttcccccgggttaacccgtttcccccggaaccgggtccccgtaccccggttacgcccggttaaccccggg

SEQ ID NO: 153573 - DNA, 745 bp, Homo sapiens
  misc_feature: GYAE6OF02G76VC.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggcctgtcccaggcgcaagtgcgaggagtcgggcccaggactggtgaggccttacggaaccctgtctcttcctgcactgtctctactgtctcgtccaccgtactccgtgcgtggggcgtcgggtccgccgaaccccgagggacggtctggagtggagttggagtatatcgtcggtcccgggtagggctaactttactacccgaaacccgtcccgtaacgaaaacggtccgggacccgtaccgtacgtacggacggggacaccggacgaaaggtaacgtacttctcgtacgtagtagttgtactttcgtcgtacgcccggtaccgacgaacgtaccgaccgggttccttacgtttagtttacgggtcgacggtaacggtaacgtaaaccgttaccgttaccgttcgtacgttcccgttcgggtaccgggggtcccaccgggtaccgtaacgttcccgggttggtacccttacgttcgttaccccggttccgttacccgggtacccttaccccggaaccgggtaaccggcccctttaacgggtcccccgtttaccccgttcccccgggccggtacccccggtcccgttaccggtcccgtaacccggg

SEQ ID NO: 153574 - DNA, 764 bp, Homo sapiens
  misc_feature: GYAE6OF02IRVBT.23.27.C05.1.454.CMB.1.raw
  modified_base (216)..(216): a, c, t, g, unknown or other
  misc_feature (216)..(216): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagcctcccagagtgggccctgtcccaggcgcaagtgcaggagtcgggccaggactggtgaggccttacggaaaccctgtctctttccngcactgtctctactcgtcctccgtcaccgactcccgtggcgtgggacgtcgggtccggaccgaacccccggaggggtaacggttcgtcggaggtggtagttggagtattcgtcgtcggtacccggggtaggggcctaacgtttacttaacccgaacccgttacccctaacgaaaacggaccgggacccgtaccgtactaccggaacgggaccaccgggaccgaaaggaaggtacttcgtacgtacgtagtacgtttacgtaccgtttcgtacggtaccgacccgtaccggcgaacggtacccgtaccggtcctttacgttagtttttcggacggtacggtaacggtaaacgtaaaccttacgttaccgttacgacgttccgtacgggttccgggggacccgtacgggacctacgttcccgttaggtacctacgttccgttcccgtccgttccgttcccgttacccgtaacccgggacggtaccccttacgggttccccgttccccggtttaccccggtggaccccgtcccgtaccgtcctaacccggg

SEQ ID NO: 153575 - DNA, 653 bp, Homo sapiens
  misc_feature: GYAE6OF02GINDN.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctcgtactgtctccgtcaccgactccctgcgtggggctcgggtccgccaaccccgagggaaggtcttgaggtggtagttggagtatatctggtcccgggtagggctacttatacaacctcgtacctacgaaaaggaccgggccgacctagtcgagggaccgacggaccgaagaaggtacttcgtacgctagtattgtacttctgtcgacccgcgcgacgtacgaccggtccgttctttagttttcggcgtacggacggtaaagtaaaccttacgttacgttacgtattcctcgggtcggggcccgccggtcgacttccggttcgtcctacgttccgtccgtcccgtcgtccgttacccaaccggtaaccgggcccctagttcccggttcccgtttcccccgacgggtcccgtccctcggtccctacggacccgg

SEQ ID NO: 153576 - DNA, 619 bp, Homo sapiens
  misc_feature: GYAE6OF02FZC1N.23.27.C05.1.454.CMB.1.raw
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
  modified_base (433)..(433): a, c, t, g, unknown or other
  misc_feature (433)..(433): n is a, c, g, or t
  modified_base (583)..(583): a, c, t, g, unknown or other
  misc_feature (583)..(583): n is a, c, g, or t
tcagacgcgagtatcacgaccggtgctcgatttagacgcgatcgaagggtttgggggctctctgagagtcatggacctcctgtgcaagaacatgaatcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggccggccaaccccgagggacgggtcttggagtggagttggggattatcgtggtcccgggtagggctacttattaccaccgtcctacgaaaagcggccncctancgagggacacggacaagaagacttcncgctgtagtttcgacttcgtgtcgaccgccgcacgaccgcggccgttnttattttgacgtcgaaggaacgtaaaccttacgttaccttcgtactcgtcggtcggggaccgtccggactacgtccgttcggtacctacgttcgtcctccgttcggaccctttccgaccgacgggtcccacgttccgtcccgttccccgnggtcccgtccgtccgtcccgtccgacggtacgtccc

SEQ ID NO: 153577 - DNA, 531 bp, Homo sapiens
  misc_feature: GYAE6OF02GITE2.23.27.C05.1.454.CMB.1.raw
  modified_base (480)..(480): a, c, t, g, unknown or other
  misc_feature (480)..(480): n is a, c, g, or t
  modified_base (483)..(486): a, c, t, g, unknown or other
  misc_feature (483)..(486): n is a, c, g, or t
  modified_base (488)..(490): a, c, t, g, unknown or other
  misc_feature (488)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(498): a, c, t, g, unknown or other
  misc_feature (496)..(498): n is a, c, g, or t
  modified_base (500)..(500): a, c, t, g, unknown or other
  misc_feature (500)..(500): n is a, c, g, or t
  modified_base (502)..(531): a, c, t, g, unknown or other
  misc_feature (502)..(531): n is a, c, g, or t
tcagacgcgagtatcacgaccggtgctcgatttagacgcgatcgaagggtcttgagtggattggagatatctgtcccggtaggggcacttattacaacccgtccctcaaaagacgggccgccctatcaggggacacggccaagaaggaattctcgctgagttttgacttctgtgaccgccgcagacacggccgtcttatttttgtgcgaggagaaactactacttcgatctcgtggggccgcggcactccgtggtcactgtcctcctcggtctcccaccgaacgggcccatccggtcttccccctggccgccctgcctccaggacgccacctcgtcggggggccacgacggccggacccgtggggcctcgtaccgtcgggtccgaaagggtaccttaccttccgacttaccgtccgtcgtcgtacggacgggtccggggacgtcgggacgaaacggggtcgacgtagtaacgctgcactncgnnnncnnngngncnnngngnnnnnnnnnnnnnnnnnnnnnnnnnnnnnn

SEQ ID NO: 153578 - DNA, 611 bp, Homo sapiens
  misc_feature: GYAE6OF02FJIQ5.23.27.C05.1.454.CMB.1.raw
  modified_base (288)..(288): a, c, t, g, unknown or other
  misc_feature (288)..(288): n is a, c, g, or t
  modified_base (362)..(362): a, c, t, g, unknown or other
  misc_feature (362)..(362): n is a, c, g, or t
  modified_base (534)..(534): a, c, t, g, unknown or other
  misc_feature (534)..(534): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgcgtggggctggggtccgccaaccccagggaaggtctggngtggattggagatatctggtccggtagggctacttacttaccaacccgtcctacaaaacggaccggccgcctancgagggacacggcaaggaagattcgcgctgagtttgacttcgtgtcgaccgcgacagaccgtacggccgttacttagttttgcgtcgaaggacgtaaacgttactacgttcgacttcgttcggtcggggcccgtcggacctacgttccgtggtctacgttcgtccttacccncgggtaccttcccgaccgtaacggccctaacgttccggtcccttcccccgtggtccccgtcccgtcgtccctaccgg

SEQ ID NO: 153579 - DNA, 597 bp, Homo sapiens
  misc_feature: GYAE6OF02GLJMU.23.27.C05.1.454.CMB.1.raw
  modified_base (358)..(358): a, c, t, g, unknown or other
  misc_feature (358)..(358): n is a, c, g, or t
  modified_base (414)..(414): a, c, t, g, unknown or other
  misc_feature (414)..(414): n is a, c, g, or t
  modified_base (452)..(452): a, c, t, g, unknown or other
  misc_feature (452)..(452): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccgcaaccccaggaggtcttgacgtggattggagatagtctcggtcccggtaggggcctacgtttacttacgaaccccgtcctacaaaacggccgggccnccctatcgagggacacggaccaaagaaggatttcgcgtctcgagttttgacgttcnggtgacccgcgacagacgacggcctcttagtttttagngtcgaggagtaaactcgtacttcgatcgtcgtgggccgacggcacgtccgtagtctactgtcctaccgtcgtccttccgaccgtaacgggcccttacgtcggttcccttccccgacggtcccgcccgttcggcctccgaggtccg

SEQ ID NO: 153580 - DNA, 760 bp, Homo sapiens
  misc_feature: GYAE6OF02IXLJ4.23.27.C05.1.454.CMB.1.raw
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
tcagacgcgagtatcacgaccggtgctcgatttagacgcgatcgaagggtttgggggctctctgagagtcatggacctcctgtgcaagaacatgaagcacctgtggttttgcctctgctggtggcagctccagatcgggccctgtcccaggcgcaagtgcaggagtccgggccaggcgtggtgagccttcggaaacccttgtcttctttcgngcacgtntctctactgtcctccgtcaccgtctcctgtcgtcgggtcgtcgggtccgaccaaccccggagggtaacggttctaggtaggtggtacggttaggagtaacgttactcggttaccggtaccgggtacggggtacctaacgtttaaccgttaacctaacccccggttccgttaaaccgaaaacgggtacccgggtaccccgtaccgttacgtacgggaaccggggaccgtaaccgggaaccgaaacggtaaacgtaacgtttaccgacggtcgttacgtaacgtttcgtaacttccgtcgtacggaccgaccggactaacggaaccgttacccggaccgttttactttacggttttggcggtacgtaaaggtaaccggtaacttacccgttacgttacgtactttacggccgggttaacgggcccggtacgtacgtaccgttcgtacggtcgtacgtctacccgtcgtccgtcctacggacctcggtacctacgtccttacccgttcccgacgtcccgtcccgtacgtccgtacgacgtccgg

SEQ ID NO: 153581 - DNA, 886 bp, Homo sapiens
  misc_feature: GYAE6OF02GEJ04.23.27.C05.1.454.CMB.1.raw
  modified_base (495)..(495): a, c, t, g, unknown or other
  misc_feature (495)..(495): n is a, c, g, or t
tcagacgcgagtatcacgaccggtgctcgatttagacgcgatcgaagggtttgggggagtgctctctgagagtcatggacctcctgtgcaagaacatgaagcacctgtggttttgcctcctgctggtggcagctcccagatcgggcctcgtacccagggcgcctaaggtcgcaggaggtccgggcccgaaggtcgtgggtggacggtccctttacggaaaccccttggtctcctttccgtagcctacttgtctctactcgttcctccgtccaccgtactccctcggcgttcggggcgtaccggggtccggtacccaaacccccggagggggtaacgggttccgttagtacgggtcggtagttgggtaacgtagtaaccgtcgtcggggtcccgggttaaggggtcctaacgttttaacttacccggaaccccggttaccctaagtaaaacgggtcccgggacccgtacccgtagttaccggaaggggggaacccnccggtaaacgaaggtaaacggtaacgttccgacgttaacgcggttacgttttcgaaccttttcggtacgggtaccgacccgggttaccgacgggaaacgtccccgggtaacgtacccggtttctttaaacgggtttttccggaaacggtaccgggttaaaggtaaaccggttaaacccgttaacgttaacggtttaaccggtaccttaaccggtttccggcggggggtacccgtccgaccggtttaaccgtcccggtttacggtccgtttaacgggtccttaccgttaccggttccgtacccggtttcccggaaacccgcgggttaaccccctaaggtttcccggtaccccttccccggtacgggtccctacccggtctacgggtacccgg

SEQ ID NO: 153582 - DNA, 822 bp, Homo sapiens
  misc_feature: GYAE6OF02HXRQG.23.27.C05.1.454.CMB.1.raw
  modified_base (212)..(212): a, c, t, g, unknown or other
  misc_feature (212)..(212): n is a, c, g, or t
  modified_base (297)..(297): a, c, t, g, unknown or other
  misc_feature (297)..(297): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagcctcccagatgggccctgtcccaggcgcaagtgcaggagtcgggcccaggactggtgagtccttacggaacctgtctcttcngctatgtctctactgtcctccgtcaccgtactcccgtgcgtggggccgtcggggtccgaccaaccccggagggacggttcgttgnggtaggtagttaggagtattactcgttcggtcccgggtagggctacttactaccaacccgtcctaaacgaacggccggtccgacctagtacggacggggacctaccgggaaccaagggtaacggtaacgttccgtcggtacgttaggttacggtttacgtcgtttaccgtcggtaccggacccgtccgacggtaaaccggtaccggaccgggttcccgttactttaacggtttttcggacgggtaacggtaaacgggtaaacttaaaccgttaccggtttaaccttacggtaccgttccggttaccgggtcggggggaccccgtccgggactttacccgggtaccgtttccgggttacctaaccgtttccgttcccgtttacccggtccggttacccgtttaaccccgggaaacccggtaccggggtaccccctttaacgggtttcccccggtttacccccggttccccccggtaccgggttacccccccggtccgttttacccgggaccccgtttaacccgggg

SEQ ID NO: 153583 - DNA, 1030 bp, Homo sapiens
  misc_feature: GYAE6OF02GCQ55.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctccgtggggctcctgctgctctggcctccgaggaacgaagggtgacgttcagatcgacccagtctcccacccctcccgtgtctgctacttcgtgggttcgggaccgtagtccaaccgtatccgtacgttcggcccgggtacgtagttcggtacgttacctttacgttttttccgggttttacttttacggttcgttaggttaactaacccgtaaaaaaccgtaaaaaacccggtttcggggtttttaccccggaacccccccgtttacccggtttacccgtcccgggttcccgtccgtttacggttacccgtagttaccggaacggttaacggttaaaccgtaaacgggggttccggggtacccctaggttacccggtaaggtaactttaccggagggttacggaccggtaaggggtttacgggggacggggtttaccgggttttaacccctttttaaccggacccttacccgttaacccgtaaacgttaacccggtacccgggttccccgggtaacccggtcgggtaccccgggtacccgttaagggtttaaacggttttaacgggttttttcgggtaaaccccttttttacgtttcggtttacggtacgtaccggtaacgtttaacggtttaactttaaccgtaacgtttacccggtaacccgttaaccgtaaccgtttaagtttacccggggtcgggtaaaaccgggtaacccgttaaacgggtttccgaacccttaccggaaattaccgggtaacttcccgggttacggaccttccggaacccttaacccgtagttttacccgtttacgttacccgttacctttacccggtttaccccggtttacccctaaccgtacgttttccgaaccgttaaccgtttacccggttcccggtaaccggttaccgttaggggcccgggg

SEQ ID NO: 153584 - DNA, 767 bp, Homo sapiens
  misc_feature: GYAE6OF02FRSRR.23.27.C05.1.454.CMB.1.raw
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtcctccgtcaccgatccctgcgtggggcgtcgggtccgccaacccccgagggaacggtcttggagtggattggagtatatcgtgtcccggtaggggctacttacgtaacctaacccgtccctacgaaaaaggacgggacccgtccctacgcgaaggggaccgacggaccgaaagaacggaatttccgtcgcgtagtacgtttgtaaccgtttcgttacgtcggacccgacccggtacacgaaccgtacggtccgttacgtttaacgttttttggacggtacggaacggtaacgtaaaaacctttaaccgtttaaccgtttaccgtaagtttcccgttacggttaccgggggacccgggtccgggacgttaccgttcccttacggggttcctaaccggtttcttacccgtttacccgttcccggtacgttttcccccaaacccgggtaaccgggtacccccttaacggttccccggtttaccccgttccccccggttcgggtccccgtaccccgttcgcccgttacccgtaaggtacccgg

SEQ ID NO: 153585 - DNA, 420 bp, Homo sapiens
  misc_feature: GYAE6OF02HXXRN.23.27.C05.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (398)..(420): a, c, t, g, unknown or other
  misc_feature (398)..(420): n is a, c, g, or t
tcagacgcgagtatcacgaccggtgctcgatttagacgcgatcgaagggtcttgagtggattggagatatctgtcccggtaggggcacttattacaacccgtccctacaaaagcgggccgccctatcaggggacacggccaagaaggaattctcgctgagttttgacttctgtgaccgccgcagacacggccgtctatttttgngcgaggaagaaactactacttcgatctcgtggggccgnggcactcctggtcactgtcctcctcggcttccaccgaaggcccatccggtccttcccccgtggccncctgctcaggnccacctcggnggggcncagccgcgnggctgctgnagctctcntcgcgctgtgnggcggnaggcaacggcncanagnagnnnnnnnnnnnnnnnnnnnnnnn

SEQ ID NO: 153586 - DNA, 946 bp, Homo sapiens
  misc_feature: GYAE6OF02H7POY.23.27.C05.1.454.CMB.1.raw
tcagacgcgagtatcacgaccggtgctcgatttagacgcgatcgaaggggtttgggggagtcagaccctgtcaggacacagcattgacatgagggtccccgctcagctccgtggggctcctgctgctctggctcccgaggaacggaagggtgacgttcagatcgacccagtcctcccacccctccctgtctcgcacgttcgttgggttcggggaccgtagtccacctatctacgttcggccgggcgacggtcggtgacttacgtttttcggttctttagtcgtaggtaactaacaaaaccgtaaaaccggttcgggtttaccgtacccccgttaccgttccgttccgtccgtcgtttcgtacctacgtacggtaaccggttaacgttaaaccggtaaacgggttccggggttaccccaagttaccggaagtttacctttcggagggttcggacgtacggggttacggggtaggggttaccgggtttaaccctttttaccgaccgttaccgtaacccgtaacgtaaccgtcccgggtcccggttacccggtcgggtcccgggtacctaagggtttaacggtttacggtttttcggggttaacccttttacgtttcggttacgttaccgtaacgggttactaaaggtttaaccgttaacgtaaccggtttaaccgttaccccggtaaaccttacggttttaacgggttaccgggaaacccgggtaacggggttaaacctaaacggtttccgaacgttaacgtaaccgttacgtaacgttcgggtcggttacctcgtaaacccgtaccgttacgttaccgttcgtttaccccgttaccgttaaccccgtttcccccgttacccgtaccccgtttacgtaacccggtttaaacggtaacccgtttacccggttcccgggttaccgttaacggggttccggaacccggggg

SEQ ID NO: 153587 - DNA, 879 bp, Homo sapiens
  misc_feature: GYAE6OF02J1GWI.23.27.C05.1.454.CMB.1.raw
  modified_base (220)..(220): a, c, t, g, unknown or other
  misc_feature (220)..(220): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagcctccagatcgggccctgtcccaggcgcaagtgcgaggagtcgggcccaggactggtgacggccgttacggaaccctggtcttcctttcngctactgtctcgtactgtcctccgtcaccactccgtgcgtgggctcgggtccgaccgaaccccgtaggggaacggtcgttagcgtcggtagttggagtacgtagtccgtacgggtcccgggtagggacctactttaacgtaccgtaaccccgtccgtaacgaaacgggtcccggtcctacccgttagtaccggaaggggtaccaacggtaaccgtaaacggaacgggtaactttccgacgtacgtaggttaacggtttcgaaccgttttacgcggtttaaccggccccggtacgtaaccggaacggtcccggtaaacggttcccgtttacgttttaggtttaccggtacgtaccggtaaacgggtaaccgttaaaccttaccgttaaaccgtttccggtaaactttcgggtccccggttacggggtaccccggtacggtaaccgttacccggttaccggttacgggttaaacccgttaaaccggttcccggtaaccgttttccccgggtaacgtttcccccggtttaaaacccccgtacccgggtttaaaccgggtaccccctttaaggtttccccccggggtttaaccccctttcccccggggtaacggtttaccccccggtccccgtttacgggaaccccccgtttaaccccggggg

SEQ ID NO: 153588 - DNA, 848 bp, Homo sapiens
  misc_feature: GYAE6OF02HP3LR.23.27.C05.1.454.CMB.1.raw
tcagacgcgagtatcacgaccggtgctcgatttagacgcgatcgaagggtttgggggatgctctctgagagtcatggacctcctgtgcaagaacatgaagcacctgtggttttgcctcctgctggtggcagctcccagatgggccctgtcccaggcgcaagtgcaggagtcgggcccaggactgggtgaggccttacggaaacccttgtccttctttcctgccacttcgtcttacctacgttcgtcctccgtcaccgactcccctggccgtcgggggtcttcggggtccggtcccaacccccgagggtaacgggttcttgacgggtgagttgggagtatacgtcttcgggtccccgggtagggggtctacgtttaactacctaaccccgtacccgtacgaaaacgggccgggcccgtacccgttaatccggaaacggggaccaaccggggaaccgaaacgggaaacggtaaatttccgtacgggtacctttagggtacgttttacggtaaccttttcgtttaccggttacggtaaccccgggtcccgaccgtaacgggaacccgttacccggggtacccgtttacgtttttacggttttttacgggtcggtaaccggggaaacggggtaacgtaaaaccgtttacccgttaccgttttaccgggtaactttccgttaccgggtccggggggtccgacccgggtcctaacgttcccggtcggttcgtaacccgttcgttccccttaccggttccggttcccttacccgaacccgggttaaccggaccccgttagttccccggtttacccgttcccggccggtccccgtacccgttccgacccgtcccgg

SEQ ID NO: 153589 - DNA, 945 bp, Homo sapiens
  misc_feature: GYAE6OF02FQSCU.23.27.C05.1.454.CMB.1.raw
tcagacgcgagtatcacgaccggtgctcgatttagacgcgatcgaagggtttgggggagtcgagaccctgtcacggacacagcatggacactgagggtccccgctcagctccgtggggctcctgctgctctggctccgaggaacgaaggtcgtacgtcgagagtcgaccgtagtcctccacccgtcctgtctcgctacttcgttggttcgggaccgtagtacgacctattacctacgttcggccgggaccgtacggttcgtacgttacgtttacgttttccggtttacgtttacgttcgttacgttaactaacctaaaaccgtaaaaaccggttcgggtttacccaccccgttaccgtttccgtccggtcgtccgttacgtaccaacgttacgaacgttacgttaaacgaacggttccggggtacctaggttacggtaaacgttcgtttaccgaggtacggtacgttaggggtacgggttacggggttacggtttaaaccccttttttacgaccgttaccttaccgtaaaccgttaaccgtacccgggccccggttcggttacgaccggggttaacctttaggtaaacgttttacgggttttacgggtaacttttccgtttacgttacgtttaaccgacggtacgtttaaacggttacttaaccgtacgtttacccgtaacccgtaaccgtacgtttaccggtttaccgggtaacccggttacggggtaaacccttacggtttaccgtaaccttacggtaaccgttaaccgggtaaacgtttcgggtaccgtacgttaccgggtaacccttaaccgttacgtttccggtttactacccgtttttacgtaccccgttttaccccgttacccggttaccctaggttttacccgttaacgttaacccgtttcccgtaccggtttaccggttccgttaaccgggcgggg

SEQ ID NO: 153590 - DNA, 768 bp, Homo sapiens
  misc_feature: GYAE6OF02HKIGV.23.27.C05.1.454.CMB.1.raw
  modified_base (261)..(261): a, c, t, g, unknown or other
  misc_feature (261)..(261): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagcctcccagatgggccctgtcccgaggccgacaaggtgcgaggacggtcgggcccaggacgtggtggacggtccttaccggaaacccttgtcttcctttcctgctacgtgttctcctactgtcctccgtacnccgtactcccgtgcgtgggcgtcggtccgaccaaccccggagggtacggtcgtggaggttggagtaggagtatacgtcgtcggtccggtaagggtctacgttacgtaccgacccgtacaacgaaacggccggcccgtacctagtaccggacggacgaccggacgaaggtaacgtacttcgtcgtagtggttagtcgttacgttcgtggtacccgacccggccgacgaccggtaccgtaccggttccgtttacgtttcggttttaggccgtaacggtaaggttaaccgtaaccttaccgttcgtacgtaccgttggtacccggttccggggcccggtacggtaccctaccggtttaccggtccgttaaccggtacgtttccgttcccgtcccgttaccggtccccgttaaccgaacccccggtaacgggtacccccgttacgtccccgggttttcccccgtacccgtcccgggtaccccgtccccggttcccggtaccgtaccccggg

SEQ ID NO: 153591 - DNA, 658 bp, Homo sapiens
  misc_feature: GYAE6OF02FGSR6.23.27.C05.1.454.CMB.1.raw
  modified_base (271)..(271): a, c, t, g, unknown or other
  misc_feature (271)..(271): n is a, c, g, or t
  modified_base (363)..(363): a, c, t, g, unknown or other
  misc_feature (363)..(363): n is a, c, g, or t
  modified_base (455)..(455): a, c, t, g, unknown or other
  misc_feature (455)..(455): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccagcgcaagtgcaggagtcgggcccaggactggtgaggccttcggaaaccctgtctctttcctgcactgtctctactgtctccgtcaccgatccctgctggggctgggtccggcaacccccgngggaaggtcttggagtggtattgggagtatagtctggtcccggtaggggctacttataccaacccgtccctacaaaaggccgggccgcctancgtagggacacggaccaagaaggaactcgcgctgtagtttcgacttcgtgtcgaccgccgcaacgcgaccggtccgttcttagtttttcggngcggaaggtaacgtaaacctacgtttacttcgaacttcctccggttacgggggcccgtcgggtctacgttccgtacggtcctacttcgttccgttcccgttccggtccttacccgaaccggtaaccgggtcccctacgttcccgggttcccctttaccccccgtgggtaccccgtccccgttggccccttccggacgtaccgg

SEQ ID NO: 153592 - DNA, 810 bp, Homo sapiens
  misc_feature: GYAE6OF02IHVTA.23.27.C05.1.454.CMB.1.raw
  modified_base (249)..(249): a, c, t, g, unknown or other
  misc_feature (249)..(249): n is a, c, g, or t
tcagacgcgagtatcacgaccggtgctcgatttagacgcgatcgaagggtttgggggctctctgagagtcatggacctcctgtgcaagaacatgaagcacctgtggtttgcctcctgctggtggcagctcccagatgggccctgtcccaggcgcaagtgcaggagtcggcccaggactggtgaggccttacggaaaccctgtctcttcctgcaacgtgtctcttacgtcgttctaccgtccaaccggtntcccctgccggtggggtaccgtcggggtcccggacccgaaacccccggacggggtaagggttcgttacggaggtacggtaagttgggagtatacgtcgtcgtacccgggtagggctaacgttacttaccgtaacccgtccctaacgaaaacggtccgggccctaccgtagtaccgaacgggggaccaaccggacctaaaggaaacggttaacgttctacggtacttaggtaagtttacgtaaccgtttcgtacgttacggaacccgccgacgaacgaaccggaccgtaccgggtttactttagttttacgggtacggtacggaagggtaacgtaaaaccgtacttaccgttaaccgagtcgtaccggtcggggtacccgacgggtacctaacggttccgtacggttaccgtaacgtttcgcccgttaaccggttcccggtaacccgtttcccgaaacccgggtacccgggtaaccccgttacgttaccccggggttcccttttacccccggcgggttaccccgtcccgttacccgggtccctaccccgggagtaaccccgg

SEQ ID NO: 153593 - DNA, 740 bp, Homo sapiens
  misc_feature: GYAE6OF02GTS2U.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggtttttgcctcctgctggtggcagctcccagatgggccctgtcccaggcgcaagtgcaggagtcgggcccaggactggtgaggccttcggaaacctgtctctttcctgcactgtctctactgtcctccgtccaccgtactcctgcgtggggcgtcggggtccggccgaaccccgaggggtaacgggtcttggagtggtagttggagtatcgtcgtcggtccgggtagggcctacttaacgtaccaacccgtccctaacgaaacggaccggccgtacctagtaccggaggggaaccacggaccgaaaggtaaggtaacttcgtacgcgtgtagtttcgactttcgtcgtcgacccggccgacgacggtaaccgtaccggtccgtttctttagtttttcggacggacggtaacggtaaacgtaaacgttaccttacgttaccggtacttccgttaccgggtccggggtaccctacggtcctacgttccgttacggttacctaccgttcggttcccttcccggttccggtaccctttaacccggaacccggtaaaccgggtcccgttaaccggtttcccggttccccgtttccccccggtcggggtaccccgtcccgtaccggtccgtaccccggg

SEQ ID NO: 153594 - DNA, 929 bp, Homo sapiens
  misc_feature: GYAE6OF02HJNKD.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagcctcccagagtcgggccctgtcccgaggcgacaaggtcgcgaagggtacggtccgggccccgaagggaccgtggggtacggacggtacccgtttaccggggaaaaccccttcggttcctttcccgttttcccgtcggaccttaccgttcggttcccttccgttaaccgttcggttacccgttccccgttaccgaacccgtaaccttccccggtgggtccggtcgggggtccgttaccgggggtccccggaacccgaaacccccgggtaagggggtaaccggttcgttagggacgggtagggtacgttagggaacgttacgtacgttccggttaccggggtaccgggggtaacggtccttaacgtttaaccgttaacccggtaaaccccccgttaaccgtaaaccggaaaaccgggtaccccgggtacccgttaccccgtaaggtaaccgggtaaccggggaaaccgaccgggaaaccggtaaagggtaaaccgtacgttccggaccgtagtttacggttaacggtttaccgtacgtttacggtcggtaaccggacccggtaccgtacgtaacggacccgtaccggttccgtttacgtttatttcgggacgtacggtaaagtaaccgttaaacttccgtacgtacgaccgttcggtaccgggtcgggtcccgagttacctacccgttcgtaccgggtactaccgttccgttccgtaccgttccgtacctaaccggaccgtacccggtaccgtcgtttacccggccccttccggcggtccccgtccgttcgaccgtaccgg

SEQ ID NO: 153595 - DNA, 880 bp, Homo sapiens
  misc_feature: GYAE6OF02H08T5.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtgttttgcctcctgctggtggcagcctcccagagtcgggccatgtcccaggccgacaagtgcgagggacgtccgggcccgaggacgtgggtggacggtccgttaccggaaaccctcgtccttctttcctgctactgtctctactcgtcctccgtccgaccgtactccctggtcggtcggggtcggttccgggtccccggacccgtaacccccggaggggtaacgggtcgttaggacggtaggtagttagggaagtacttacgtccggttcgggtacccggggtacgggtaccgttaaccgtttaaccgttaacccgttaacccccgtacccgtaaccggaaaaccgggtacccgggtacccgtacccgttaacgtacccgggaacggggaaccgaccgggaaccgtaaaacgggtaaacgtaacgttaccgtacggtacgttacgggttaacgtttacgttaccgtttcgttacggtcccggtaacccggccggtaaccggtaccggtaaccggtacccgggttaccggtttacttttaacgggtttttcgaacggttacgggtaaacggtaaaccgttaaaccgtttaacccgttaccgttaccggttcgttaccgggtccggtccggggacccgtcgtaccgtacgttcccgttacggtccgtaccgttccgttacccgttccgtaccggtacccttaccgaacccggtacccggttaccgacccggtttcccgttacccttcccccgggtagtcccgtcccgtcggtacccg

SEQ ID NO: 153596 - DNA, 854 bp, Homo sapiens
  misc_feature: GYAE6OF02HDSJQ.23.27.C05.1.454.CMB.1.raw
  modified_base (844)..(844): a, c, t, g, unknown or other
  misc_feature (844)..(844): n is a, c, g, or t
tcagacgcgagtatcacgaccggtgctcgatttagacgcgatcgaagggttgggggctctctgagagtcatggactcctgtgcaagaacatgaacgcacctgtggtttgcctcctgctggtggcagctccagatggcctgtccaggcgcaagtgcaggagtcggccaggactggtgaggccttcggaaacctgtctcttcctgctactgtctactacgtcgtacgttccgtacaccgtacttccccgtaggtccggttcggggtccgttcggggtaccccggtaacccgtaaaccccccgggaggggggtaaaccgggttccgttacggaaccggttcggggtaaccgtttcgggggtaacgtaacgtttacgttaccggttaccgggggttacccggggtagggggtacctaacgttttaaccgttaacccgtaaccccggttaccctaaacggtaaaacggggcccgggtacccgtaccccgtaagttacccgggaacggggtaaccgtacccgggaaccgtaaaggaacggttaactttccggtaccgtacgttaggttacggttttaccgacgttacgtccggtacgacccggtaccgtacgaacgtaaccgaccgggtccttagtttacgttttcggacggtaacggtaaggtaacgtaaacttcttacgttacggtacgttacgtccgggtacgggtcccgtacggtacgtacgtcccgttgtaccgttaccgttcgtaccgttaccgaccggtaccttaccggaaccggaacggtccccgtaagttcccggtacccttacccgggtcggtaccgtccgtacccggtacggtacccgnggtaaccccg

SEQ ID NO: 153597 - DNA, 665 bp, Homo sapiens
  misc_feature: GYAE6OF02HK7S3.23.27.C05.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (574)..(574): a, c, t, g, unknown or other
  misc_feature (574)..(574): n is a, c, g, or t
  modified_base (592)..(592): a, c, t, g, unknown or other
  misc_feature (592)..(592): n is a, c, g, or t
tcagacgcgagtatcacgaccggtgctcgatttagacgcgatcgaagggtcttgagtggattggagatatctgtcccggtagggcacttattacaacccgtccctcaaaagacgggccgccctatcaggggacacggccaagaaggaattctcgctgagtttgacttctgtcgaccgccgcagacacggccgtctagtttttgngcgaggagaaactactacttcgatcgtcgtggggccgcggcatccctggtcacgttgtctccgtcggcttccaccgaacggccctaagtccggtccctttaccccgnggaccgcccctgccttaccgaggacgaccctaccgttcggcggggacctaaccgacggccggtcccgtgggcctacgccgttggtaccgtaaagggtaccttaccgttaccgacttaccgtccgtaccgtacgtcgggacggtcccgggactcgggaaccgaacgggtcccgtaacgtaacgtaccggtnttacggctacgnccaagccgttaancgnacgacactacgacgtactgtacgacgtacacgtacgacacgtacncgacgacgtacgtagtanaacgacgtacgtaggtacacgtggacgtacgacgtacggtacgactaacgtaccgtacctacgtacgacgacg

SEQ ID NO: 153598 - DNA, 674 bp, Homo sapiens
  misc_feature: GYAE6OF02G9KYI.23.27.C05.1.454.CMB.1.raw
  modified_base (456)..(456): a, c, t, g, unknown or other
  misc_feature (456)..(456): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcatctcccagatgggccctgtcccaggcgcaagtgcaggagtcgggcccaggactggtgaggccttcggaaaccctgtctctttcctgcactgtctctactgtctccgtcaccgatccctgctggggctgggtccggcaacccccgagggaacggtcttgagtggattggagatatctggtccggtagggctacttacttaccaacccgttcctacaaacgcgggccacctagtcaggggacacggccaagaacgattcacgctgtagtttgacttcgtgttacgaccggtccgacacgaaccgccggtccgttacgtttatttttacggngtaccggtaaggaacgtaaacgttaccttacgtttcgaattccgtaccggttcgggggcccgtacggtctaaccgttccgtacgggttcctaacgttcgttcctacccgtccggttcccttaccctaacccgggtaacgggtcccctaacgttcccggtttccccttacccccggtcgggtccccgtccccgttcgtacccgtaccggacggtacccg

SEQ ID NO: 153599 - DNA, 685 bp, Homo sapiens
  misc_feature: GYAE6OF02I5EAK.23.27.C05.1.454.CMB.1.raw
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (665)..(665): a, c, t, g, unknown or other
  misc_feature (665)..(665): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcatctccagatgggccctgtcccaggcgcaagtgcaggagtcggcccaggactggtgaggccttcggaaaccctgtctctttcctgcactgtctctactgtcctccgtcaccgactccctgcgtggggctcgggtccgccaaccccgagggaggttctggagtggattggagatntcgtggtcccggtagggctacgttactaccgacccgttccanaaacggccggcctcctagcgacggggacctacgggaccaaaggaacggtaacttcgtacgcgtagtacggtttacgaaccgttttcgtaggtttaccggacccggtcccgaccgtaacggtaccgtaaccgggtcccgtttacgtttacgtttttggacggtaaccggtaaggtaacgtaaaccttacgttaccgttacggtacttccgtccggttcggggcccgtcggactacgttccgttggtccttacgtcgttccgtccgttcgtccttaccgaccgtacggtccctaggttcccgttcctcccggtggcccgttccgngtcccgttccgaggtacccg

SEQ ID NO: 153600 - DNA, 290 bp, Homo sapiens
  misc_feature: GYAE6OF02JGYBR.23.27.C05.1.454.CMB.1.raw
  modified_base (259)..(259): a, c, t, g, unknown or other
  misc_feature (259)..(259): n is a, c, g, or t
  modified_base (265)..(290): a, c, t, g, unknown or other
  misc_feature (265)..(290): n is a, c, g, or t
tcagacgcgagtatcacgaccggtgctcgatttagacgcgatcgaagggtttgggggaagaggaagactgacggtcctcccaggagttcaggtgctgggcaccttgggcacgggggaggtgtgtcacaagatttgggctctgggcaccgtgggcagtgggggaggtgtgtcacaagatttgggctctggcacagcggccctgggctgcctggtcaaggactactccatactcgcgtctgagcgggctgggccaaggcgnagtagnnnnnnnnnnnnnnnnnnnnnnnnnn

SEQ ID NO: 153601 - DNA, 799 bp, Homo sapiens
  misc_feature: GYAE6OF02IQ7C1.23.27.C05.1.454.CMB.1.raw
  modified_base (101)..(101): a, c, t, g, unknown or other
  misc_feature (101)..(101): n is a, c, g, or t
  modified_base (290)..(290): a, c, t, g, unknown or other
  misc_feature (290)..(290): n is a, c, g, or t
tcagacgcgagtatcacgaccggtgctcgatttagacgcgatcgaagggtttgggggagtcagaccctgtcaggacacagcatggacatgagggtccccgntcagctcctggggctcctgctgctctggctcccaggaacgaagggtgacgttcagatgacccagtctcccacctcctgtctgcatctggttcggggaccagtcaccatacacgttggccgggtgaggtccgtagtacttagttttcggttctttagtctggtactaccaaactaaaaccgtgggtttcnccccgttaccgtccgtcgtcgctgtcactgacgtaagttacgaacggtcgggaccctagtcgagtacgtcacggtgacgtaggtgggaggttcggtaccttttacgaccgttcgtaccgaactaacgtccggacccggtaccgtcggccggtaccgttaaggtaacggtttacggttttaccggggtacttttaccgtttacggttcgtaccggtaacggtaccgttaaaggttactttaaacgtaacggttaccgttaccccgttaaactaacggtttaacggttttccgggaacccgtaaacggggggttaaacccttaaaacggtttccgggtaaacccgtttacctaaacggttaacccggtaaacgttcgggttacgtaccgcggtaacccgtaaccgttacgtttccgttacgtttaccgtttacctacccgtttcccgtacccgtcctaacgttacggtaacgttaccgtaccgtcccgggttacgtaccgttgggaccggg

SEQ ID NO: 153602 - DNA, 801 bp, Homo sapiens
  misc_feature: GYAE6OF02JRB87.23.27.C05.1.454.CMB.1.raw
  modified_base (168)..(168): a, c, t, g, unknown or other
  misc_feature (168)..(168): n is a, c, g, or t
tcagacgcgagtatcacgaccggtgctcgatttagacgcgatcgaagggtttggggatgctctctgagagtcatggacctcctgtgcaagaacatgaagcacctgtgttttcgcctcctgctggtggcagctcccagatcgggccctgtcccaggcgcaagtgcaggngtcgggcccaggactggtgaggccttacggaaaccttgtctccttctacgcactgtctactctgttcctccggtaccaccggtctcccgtgtcgtcggggtcgtacgggtacccggtaccgaaccccggagggtaacggttcgtacggtaggtcgggtacgttacgggtaacgcgttacggtccgtaccgggttcccgggttaagggtaccttaacgttaacgttaacccggtaacccgttacccgtaacggtaaaaccgttccgggggaccctaccgttacggtacgaacgggggtaaccacgggtaccgaaagggtaacgtaacgttcgacggtacttggtacgttacgtctttacgtcggtaccgccggtccacgacgtaaccgtaccggtcgttacgtttagtttcgtacggaccggttaaggtaaaccgttacgtttaaccttaacgtcgtaaccgttcggtacgggttccgggtaccccggtggtaaacctcgttaccggtcgtacgtacggtcccgttctccggttccggtacccttacccggtaacggtccggtacccgttacgggttaaccgttccccggttcccgaaggttccccggttaccgttaccgtcccggtaaccggg

SEQ ID NO: 153603 - DNA, 728 bp, Homo sapiens
  misc_feature: GYAE6OF02HXI6A.23.27.C05.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (451)..(451): a, c, t, g, unknown or other
  misc_feature (451)..(451): n is a, c, g, or t
  modified_base (505)..(505): a, c, t, g, unknown or other
  misc_feature (505)..(505): n is a, c, g, or t
tcagacgcgagtatcacgaccggtgctcgatttagacgcgatcgaagggtttgggggagtcagaccctgtcaggacacagcatggacatgagggtccccgctcagctcctgggctcctgcctgctctggctcccaggaacgaaggtgacgttcgagagtgacccagtctccaaccctcctgtctcgcagtctggttaggggaccgatcaaccngtcacgttcggaccggngagttaccgtgactaacgtttttcgggttnttttaagcgttggtaactacaaaacgtaaaaccgtaaggtttcgaccccgttaaccgtccgttcggtacgtctcgaccgtacgttcgaacgtacgtaacaaacggtcggggtaccctagacgtagtattcgaggtgacgaggtcggaggtcggtacctttagacctctacgacaacgtcggacgcttacgngtacccgtaggtacggtgttttcgggtactttaccttcgtcgttacgacgttanaccgtataacgtaacgttaccgtacccgtacacgttacggtttacgaccggtaacggggaaaccttaaacggttccgtaaccgtactaacggttaaccggtaacccgttgtacgggtccttccggaccttaacccggtatccgttcgttacccgtactaacgtccctttacccgcgtaccctagtaccgaacgtaccgttcggtaccttacggtcgaaccggg

SEQ ID NO: 153604 - DNA, 876 bp, Homo sapiens
  misc_feature: GYAE6OF02FJX35.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggcctcccaggaacgaagggtgacgttcgagatcgacccagtcctcccaccctccctgtctcgctatcgtggttcgggaccgagtcacacgtcacgttcggccgggacgtacgtcgtagacgttagttttcggtttcttttagtcgttggtaactaccaaaacgtaaaaccgttacgggttccgtaccccgttaccgttccgtccggtaccgcgttcgtaccacgtcggtaacgtacgttaacgaaacgggttccggggtaccctagtaccggaacgtacttcgtagggccggtacgtacgggttagggtacggggtttacggttaccccgttttacaccgttaccgtacgaaaccgtacgtcccggacccgggtacctccgggaccggtaccgttagggaaacggtttacggtttttaccgggtaacccttttacgtttcgttacggtacgtaacggtactaacgtttacgttaaccgtacgttaacccggtacccgttaacgtaccgttaacgtttacccgggaaccggtaaccggggtaaaccgttaaacggttccggtacccgtaaaccgtaacgttaaccggtaccgttggttacgggaccgttacggaacccgttaccgttacgttaccgtttacgttaccgttaccgttaacccgtttccccgttacccgtaccttaaccgttaggttaaccgtaaccggtttcccgttaacccggtccggttaaccgtcgggtaacccggg

SEQ ID NO: 153605 - DNA, 532 bp, Homo sapiens
  misc_feature: GYAE6OF02GRTBI.23.27.C05.1.454.CMB.1.raw
  modified_base (198)..(198): a, c, t, g, unknown or other
  misc_feature (198)..(198): n is a, c, g, or t
  modified_base (336)..(336): a, c, t, g, unknown or other
  misc_feature (336)..(336): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (490)..(492): a, c, t, g, unknown or other
  misc_feature (490)..(492): n is a, c, g, or t
  modified_base (494)..(494): a, c, t, g, unknown or other
  misc_feature (494)..(494): n is a, c, g, or t
  modified_base (497)..(532): a, c, t, g, unknown or other
  misc_feature (497)..(532): n is a, c, g, or t
tcagacgcgagtatcacgaccggtgctcgatttagacgcgatcgaagggtttggggtggagttggagatatctgtcccggtaggggcacttattacaacccgtccctcaaaagacggccgccctatcgagggcacggcaagaaggatctcgctgagtttgacttctgtgaccgccgcagacacggcgttctattttgngcgagagaaactactactcgtatctcgtcgggcgcggctaatccgtggtcacgttgtcctccgtcggccttcccaaccgagggccctagtccgtccttccccccgtggccctcccgtcggacctaccgagggtaaccnccgtaccttcgggtcggggccacgacggtccggaccccggttggccgtacggtccgtacgtacgtaacggaacttacccttacgattccgtaccgtccggttcgtaggacgggtcggtacggtcggaccgacgggtccaacgttangcgancgnnngntcnnnnnnnnnnnnnnnnnnnnnnnnnnnnnnnnnnnn

SEQ ID NO: 153606 - DNA, 728 bp, Homo sapiens
  misc_feature: GYAE6OF02HWCFS.23.27.C05.1.454.CMB.1.raw
  modified_base (164)..(164): a, c, t, g, unknown or other
  misc_feature (164)..(164): n is a, c, g, or t
  modified_base (219)..(219): a, c, t, g, unknown or other
  misc_feature (219)..(219): n is a, c, g, or t
tcagacgcgagtatcacgaccggtgctcgatttagacgcgatcgaagggtttggggatgctctctgagagtcatggacctcctgtgcaagaacatgaagcacctgtggtttttgcctcctgctggtgcagcctcccagagtggccctgtacccaggcgcaagtncgaggagtcggcccaggacgtggtgaggtccttacggaaccctgttctctttccngcactgtctacgtctcgtcctccgtcaccgtactcccgtggtccggtggggacgttcgggtcccggccgtaaccccggaagggtacgggttccgttggtagtcggaggtttgagtattacgcgtcgggtccggttaggggactaccgttacttaaccctacccggttccctaacgaaacggtccggaccgtacccgtacgtcgacggggacctaccggaccgaacgaacgtacttcgtacgtctaggttacgtttagtccgtttacgtcggtaccgacggccgtacgacgtacgccgtcgttactttgtttcgtggacgtaagggacctaacgttaccttacgtacgtacttcgttaccgggcgggtccgacggtcctcgttacgtccggttcaacgtttccgtacttcccgtaccggttacctcccgtaaccggaacccggtccgtaccgtttcccgggtaccctttccccggccggtacccttccccggttacgcccgttaaccggg

SEQ ID NO: 153607 - DNA, 681 bp, Homo sapiens
  misc_feature: GYAE6OF02GF141.23.27.C05.1.454.CMB.1.raw
  modified_base (156)..(156): a, c, t, g, unknown or other
  misc_feature (156)..(156): n is a, c, g, or t
  modified_base (183)..(183): a, c, t, g, unknown or other
  misc_feature (183)..(183): n is a, c, g, or t
  modified_base (210)..(210): a, c, t, g, unknown or other
  misc_feature (210)..(210): n is a, c, g, or t
  modified_base (302)..(302): a, c, t, g, unknown or other
  misc_feature (302)..(302): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctccagatcgggccctgtcccaggcncagtgcaggagtcggaccaggactggngacgtccttacggaacctgtctcttcngcactgtctactacgtcgttcctccgtcaccgtactccctggacggtcggggcgttccggggccgacccaaccccggagggtacggtctggngtggtagtggatagtactgtcggtccgggtaggacctacttacgtacctaccgtaccagaaacggccggcctacacgtcggaacgggacacgtacgaaggtaagtactcgcgacgtagtagttcgtcttctggtccnccgtcngacgacgcggtaccttgttacgtttcggtacggcggtaaacgtaacgttaaacttacgttacgtactacgttcgtcgggtacgggcccggttgaccttcgtaccgtcgtaaccgtcgtttcgtccgttaccgttccggtaacccttacccggaaccggtaacccgggtccttaccggttacccccggttccccgttacccccggtcggtccccgtccccgtaggtccccgtacggg

SEQ ID NO: 153608 - DNA, 915 bp, Homo sapiens
  misc_feature: GYAE6OF02JN4WX.23.27.C05.1.454.CMB.1.raw
  modified_base (219)..(219): a, c, t, g, unknown or other
  misc_feature (219)..(219): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
tcagacgcgagtatcacgaccggtgctcgatttagacgcgatcgaagggtttggggagtgctctctgagagtcatggacctcctgtgcaagaacatgaagcacctgtggttttgcctcctgctggtggcagctcccagatgggccctgtcccaggcgcaagtgcaggagtcgggcccaggactgggtgacggccttacgggaaaccttgtctctttccngcactgtctctactgtctccgtcaccgtatccctgcctggggctcgggtccgccaaccccgagggacggttcttggacgtggagtgganagtagtctcggtccggtagggcacgttacgtacaaccgtcccgtanaaacggaccggccaccttancggacgggtaacacggtaccaaggtaaggacttcgtcgaccgttggtaaacgtttcggaactttcggtacggttacggaccccggtacggtaccgtaaacggtacccgaaccgggttcccgggtttacctttaacgggtttttttaccgggaccgggtaacccggggttaaacggggttaaaacccgttaaaaacccgtttaccggttttaaccgtttaacccggaaacttttccccgggtttcgggtacccggggggttaacccccgtaacggggggttacccttaaccgggtttccccggttacgggggtttaaccccttaaaccggttcgggtttaccccccttttaccgggggttaacccggtttaccccgggttttaaaccccccgaaacccggggttaaacccggggggtcccccttttaaaccccggggttaccccggggttttttaccccctttcccccccccgggggttagggggtttaacccccccggttacccccggttttcccggtacccccgggttttaacccccggg

SEQ ID NO: 153609 - DNA, 752 bp, Homo sapiens
  misc_feature: GYAE6OF02JX4NC.23.27.C05.1.454.CMB.1.raw
  modified_base (213)..(213): a, c, t, g, unknown or other
  misc_feature (213)..(213): n is a, c, g, or t
tcagacgcgagtatcacgaccggtgctcgatttagacgcgatcgaagggtttgggggctctctgagagtcatggacctcctgtgcaagaacatgaagcacctgttggttttgcctcctgctggtggcagctcccagagtcgggccctgtcccaggcgcaagtgcaggacgtcgggcccaggactggtgaggccttcggaacctgtctctttcngcatgtctctactcgtcctccgtcctaaccgctccgtggcgtcggggctcggggcccgtaccaaccccggagggtaacggttcttggtaagtgggtattggagtatagttcgtcggtcccgggtagggccttaacggttacttaaccgaaccccgttaccctaacgaaaacgggccggacccgtaccgtacggtacggaacggggtaccgaaccgggacgaaacgggtaaacgaacgtttcgacggtacgttacgggttaacgttcgggtaacctttcggtacggtttaccggcccgtacggacgtaacgaacggtaccggggtccttaacgttttgttttacggtggaacccggtaggtaacgtaaacctttacgtacgtttacggtcgtcgttaccggtcggggacctcgtactaccgttccgtacgtctacgttcgttccgttccgtcgttacccgacggtaaccggccgtacgttcccggtaccctttcccggtcgttacccggccctagtacccgtcgaccggacttccccggg

SEQ ID NO: 153610 - DNA, 730 bp, Homo sapiens
  misc_feature: GYAE6OF02I27QX.23.27.C05.1.454.CMB.1.raw
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (404)..(404): a, c, t, g, unknown or other
  misc_feature (404)..(404): n is a, c, g, or t
tcagacgcgagtatcacgaccggtgctcgatttagacgcgatcgaagggtttggggatgctctctgagagtcatggacctcctgtgcaaagaacatgaagcacctgtggttttgcctcctgctggtggcagcctcccagactcgggccctgtccccaggccgcaagtgacaggacggtccgggacccaggtacgtggtgacggccttaccggaaaccctgtctctttccngacnctcgtctctactgttcctacgtccacgactcccgtgcgtgggctacggtccgaccaaccccggaagggtaacggttcgtggaaggtgtagtggaagatgtctacggtccggtaggactactagtaccaacccgtccaacgaaacgtccggcctcctagtacggaaggacncgtaggaaccaaagaacgtactcgtcgagtcgtagttcgacttcgtacgtcgacccgtacgctaaacggaccgtaccggtaccttaacgtttcgttttaggaacggtacgggaaccgtaaacgtaaaccgttaacccgttacgttaaccgtaacttccgtacggttcccggggaccgtaccggtctaaccgtttccgaggttccgaaccgttccggttaacctcccggtacgttcccccgttaaccgaccggtaaacccggtcccgttaaccggtccccggtttaacccgttccccggtccgaccggtacccccgttaggtacccc

SEQ ID NO: 153611 - DNA, 837 bp, Homo sapiens
  misc_feature: GYAE6OF02HI9A2.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgcgtggtggcagctcccagagtcgggccctgtcccgaggcgccaagtcgcgaggacgtccgggcccaggacgtggtgacggtccgttacggaaaccctgttccttcgtttccgtgcgtaccttcgtcctccttacgttcgttcccttccgtaccaccggtacttcccgtggccgtcggggccgttcggggtccccggaccgtaacccccggtaggggtaaccggttcgttggacggtgggtacgttgggacgtacttacgtccgttaccgggtcccggggtagggccttaacgtttaccgttaacccgtaaccccgttcccgtaaacgaaaaccggccccggtacccgtaccgtacgtaccggaacggggacccaacggaaccgaaaggtaacccggttaagttcccgtacggtacttaggtacgttttacgtacctttggtccgtaccggcccggtaccgacgtaacgtaccggtaccggtccgtttacgtttacgttttcgacggtacggttaacggtaaacgtaaccgttactacgttcgtacgttccgtcgggtccgggccgtccggcgttacgttccgtacggtacctacgttcgttcccgtcccgttccggtacccgttacccgaccggtaccggtacccgttaccgtttcccggttaccccgttccccggtccggttaccccgtcccggttaccggtcccgttaacccggg

SEQ ID NO: 153612 - DNA, 858 bp, Homo sapiens
  misc_feature: GYAE6OF02JKPKJ.23.27.C05.1.454.CMB.1.raw
tcagacgcgagtatcacgaccggtgctcgatttagacgcgatcgaagggtttgggggatgctctctgagagtcatggacctcctgtgcaagaacatgaagcacctgtggttttgcctctgctggtggcagctccagagtcggcctacgtcccgaggcgcgtaagtgcgaggacggtcgggccaaggcgtggtgagccgttacggaacctgtctacttcgtcgacacgttcgtcgttctacgttgtaccttcggtaccaccgtaccttccggtcgtcggtacgggtcgttccggggtaccggtacccgaaccccggtaaggggttaccgggttacgttacgggtaggttacgggtaggtacgggtaacgtacgttaccgtaccgttccggggtacccgggttacgggtaccgttaaccttaaccgttacccgaacccgttacctaaacggtaacgggtacccggtaccgtaccgtacggtacggaccgggtacgaccggtaaccgaaggtaaaccggtcgtaaccggtcgacggttagttacgttacgttaccgtacgtcggtaccggacccggtcgtaaccgaggttaaacccggtcgggttaccctttgtttaaccgttttcgggacggttacggtaaacgtaccggttaaaactccggttacgttacgacggttaccgttacggggtccgggttacccggccgttaacgtccgttaccgggttagaccgttaacgtttccgaaccgggttcccgttacggtaccgttaccgaccgggttacgccgttttaaccggtcccggtttaaccggttcccggtaaccgtcccgggttaccctacgttacccggtaaccggg

SEQ ID NO: 153613 - DNA, 739 bp, Homo sapiens
  misc_feature: GYAE6OF02GHXS7.23.27.C05.1.454.CMB.1.raw
  modified_base (508)..(508): a, c, t, g, unknown or other
  misc_feature (508)..(508): n is a, c, g, or t
tcagacgcgagtatcacgaccggtgctcgatttagacgcgatcgaagggtttggggatgctctctgagagtcatggacctcctgtgcaagaacatgagcacctgtggttttgcctcctgctggtggcagctcccagagtgggccatcgtcccgaggcgacaagtgcgaggagtccgggcccgaggacgtggtgaggtcccttacggaaaccctgtccttcctttcctgcacttcgtcttctactcgtcttccgccaccgctcccgtgtcgtcggggcgtcgggtcccgccgaaccccgaggggacggtcgttggtaggtcggtagttggaagtactagtcgtcggtacccgggtagggacttacgtttaaccgttacccgaaccccgtccctaaccgaaaaccggaccgggccccgtccgtacgtccggagggaaccaccggaacgaaaggaacggtaacttccgtcgtacgtaggttacgtttcgtacttcgtgtaccgcccggccncgaacgtaccgccgtcgttcgtttagtttgcgtcgaacggtaattaaaccgttcgtctttacgactttacgccgggttacgggcccgacggtccgtacgttccgtacggttacccgcgtttccgtccgttccccgttccggttcccttaccccggacccgtaaccgggtcccctcggtttcccccgttcccggttacccccgtcgggtccccgtacccgtgtaacccccgg

SEQ ID NO: 153614 - DNA, 590 bp, Homo sapiens
  misc_feature: GYAE6OF02JIRFI.23.27.C05.1.454.CMB.1.raw
  modified_base (148)..(148): a, c, t, g, unknown or other
  misc_feature (148)..(148): n is a, c, g, or t
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (197)..(197): a, c, t, g, unknown or other
  misc_feature (197)..(197): n is a, c, g, or t
  modified_base (436)..(436): a, c, t, g, unknown or other
  misc_feature (436)..(436): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (557)..(557): a, c, t, g, unknown or other
  misc_feature (557)..(557): n is a, c, g, or t
  modified_base (568)..(568): a, c, t, g, unknown or other
  misc_feature (568)..(568): n is a, c, g, or t
tcagacgcgagtatcacgaccggtgctcgatttagacgcgatcgaaggtcgttgagtggattggagatatctgtcccggtagggcaccttagttacaacccgtcctcaaagacggccgcctatcagggacacggccaagaggaattcncgctgagttttnacttctgtgaccgcgnagacacggccgtctattttgngcgagagaactctattcgatctcgtgggcacggcatcccgtgtcactcgtctacctcggcttaccgacgaacggcccacgtcgttccgttccccgtcggtccgcccctcggaccttccgaacgacggtaccacccgttcccggtcgggggtcccaacgaccggtcccggcccgtacgggccgttccggtccggtcggtacgaacggtaccgtaccgttcctagtaccgtcgacgttcgngtacggcggtacgtggacgaacggtacgtaccgagttacggntcgcngacngcgacgcgcgacntcngngacntagcncgcgnagacngacgtcgcgcgcgcgacgacgagctacgtgcgngagcgcgacgngtacgacgcgtcgcgagtagcg

SEQ ID NO: 153615 - DNA, 897 bp, Homo sapiens
  misc_feature: GYAE6OF02G9KRP.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccgaggcgcgaagtgcgagggaggtccgggccccgagggtaccgtgggtggacgggtcccgttaccggaaaacccttgttccttccttttcctggcctacgttcgttccttaccgttaccttcggttcccgttacccgttaccgaacccgtaccttccccgttcggccggttcgggggccgttaccgggggtaccccggaccccgaaaccccccgggtagggggtaaacgggttccgttagggtacggttagggttacggtttagggaagtagttacgtcggttaccgggtacccggggtaacgggtaccttaaccgtttaaccgttaaacccgtaacccccggtaacccgtaaaccggtaaaaccggcccgggtaccccgtacccgttaacgtaccggtaaccggggaccgaaccgggtaaccgaaaacggtaaacggttaacgttccggtaccgtcgttacggttaacgtttacgtcgtttcgtacggtaccgaccgaccgtacgaacgaccgtaccggttcttacgtttagtttcggacggtacgttaaacggtaccgttaaaccttcgttaccgttagtaaccgttcggtccgggtcgggcccgtaggtcctaccgttccggtgttacgaccgtttcgtacccgttccggtccggttacccttacgggaacccgtacggtaccccttcggtttccccgtcccgttccccggtacggtcccggtacccttcggacccgtaccggg

SEQ ID NO: 153616 - DNA, 667 bp, Homo sapiens
  misc_feature: GYAE6OF02F0QMF.23.27.C05.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
  modified_base (575)..(575): a, c, t, g, unknown or other
  misc_feature (575)..(575): n is a, c, g, or t
  modified_base (606)..(606): a, c, t, g, unknown or other
  misc_feature (606)..(606): n is a, c, g, or t
tcagacgcgagtatcacgaccggtgctcgatttagacgcgatcgaagggtttggggatgctctctgagtagtcatggacctcctgtgcaagaacatgaagcacctgtggttttgcctcctgctgggtgctacgctcccagactgggcctagtcccaggcgcaaagtgcaggtacggtcgggccaggacttgggagacggtccttacggaacctggttcctctttaccngcacttgtactctactgtcctcgtaacacgtacnccctggcttgggctggtccgccaacccgnggcggtatgngtgnttagagtatgtcgtcggtaccggtggacctacgttataacccgacccgttaccctaacgaaaacgggtccggtcccnctacgtcggaacgggacctacgggaacaaaggaaacggtactttccgcgtacgtttaggtaactttcgaacgtttcgcggttaccggtccgacgtacgaacggaccgttacgccgtttaactttcgtttggacgggtaccgtaggaaaccgttaattaccgtactacggtacttcggtcgacgggtccacgtntaccttcgtcggtactagttcgtacttccgngttccgtaccaaccgacggtcctaggttccttcccgtacgtcgacccgtcttacgctacgg

SEQ ID NO: 153617 - DNA, 773 bp, Homo sapiens
  misc_feature: GYAE6OF02F8GLN.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtccaggcgcaagtgcaggacgtcgggcccaggactggtgaggccttacggaaacctgtcttcttctgctactgtctctactctcctccgtaccgaccgtactcccgtgcgtggggcgttcgggtccggacccgaaccccgtaggggtaacggtcgttagaggtggtagttacggagtattacgtcgttcgggtacccgggtaggggtacctaaccgtttaacttaacccgtaacccgttaccctaaccgaaaacgggtacccggggcccgtaccccgttaacgtaccggaacggggaccgtaaccgggaaccgtaaaagggaacggtaacgtttcgtaccgtacgttaggtaacgttttagtaccgttttcgtcggtacggcccgaccgtaccgacggtaccgaccgggtccgtttacgtttacgttttcggcggtacggtagtaacgtaaacgttccgttaacgttccgtacgtccgtcgggtaccggggccgtacggtaccgtacgttccgtacgtcctacgtcgtccgttcccgtaccgtcctccggtaacccggacgggtacccctacggtttcccggttccccgttccccggcgggtccccgtcccgttccggcgtacccg

SEQ ID NO: 153618 - DNA, 777 bp, Homo sapiens
  misc_feature: GYAE6OF02H38VK.23.27.C05.1.454.CMB.1.raw
tcagacgcgagtatcacgaccggtgctcgatttagacgcgatcgaagggtttgggggagtcagaccctgtcaggacacagcatggacatgagggtccccgctcagctcctggggctcctgctgctctggctccaggaacgaagggtgacgttcagtatcgacccagtcctccctaccccttccctgttctcgccattcgtggttcggggaccgagtccacactcctacgttcggccgggcgtacgttcgtactacgttagtttttccggttacttttagtcgttaggtactaacgaaaaccgtaaaaaccgtaggttttccgaccccctaccggtccgttacggtccgtctcgtacacgtcgtaacggtaagttacgtaaacggtcgggtacccagtcggagtacgtttacgtagggtacgcgagggttagggtaggggtaccggttaacttttaccgctaccgtacaacgtacgtccggacccggcgttccggaccgggtctaagggtaacgtttacggttttacgggttacctttaacgttctgtacacgtaacgtacgttaacttacgtacgtacgtcccttaacgtaacgttcgtttacggaccgggtaacggtaacttaacgttcgtaccgttaaagaccgttaacggtaacttgggtaccgttcgacctacctacgtacttccgttcgttccttcgtaacctttaccccgttccggaacctttagtaccggttacgtaacgttccgtaccggtcttcggtcggtaaccggg

SEQ ID NO: 153619 - DNA, 785 bp, Homo sapiens
  misc_feature: GYAE6OF02FUWQ3.23.27.C05.1.454.CMB.1.raw
  modified_base (218)..(218): a, c, t, g, unknown or other
  misc_feature (218)..(218): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagcctcccagagtcgggccctgtcccaggcgcaaggtgcgaggagtcgggccaggactggtgacggccttacggaaccctgtcttctttccngcactgtctctactgtcctccgtacaccgtctccctcgcgtggggcgtcgggtccggcccaaccccgaggggtaacggtcgttgacggtggtagtttagggagtatagtcgttacggtaccccggggtaggggtccttaacgttaacttaacccgtaacccccgttacccctaaacgtaaaaacggaccccggggtacccgtacccgtacgtacgggtaaccggggaccgaacccgggaccgtaaacggaacggttaaacgtttccgtaccggtacgtgttaaggttttacgaacctttcggttcggtaccgtacccgggacccgacggtacgaacccgtaccggtaccggtttaccgtttacgtttttacggcgggtacggaagggtaacgttaaaccgttaccttacgttaccggtacttccgtacgggttcgggccggtcggcgtaccgtccgtggttactcgttcgttccttcgtccgttaccttcccgaccgtaaccgggcccttacggtcccgttcccttccccgtcggcccgtcccttcggtccgtaccggacgtaccgg

SEQ ID NO: 153620 - DNA, 637 bp, Homo sapiens
  misc_feature: GYAE6OF02GFRME.23.27.C05.1.454.CMB.1.raw
  modified_base (211)..(211): a, c, t, g, unknown or other
  misc_feature (211)..(211): n is a, c, g, or t
  modified_base (607)..(607): a, c, t, g, unknown or other
  misc_feature (607)..(607): n is a, c, g, or t
tcagacgcgagtatcacgaccggtgctcgatttagacgcgatcgaagggtttgggggctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcngcactgtctctactgtctccgtcaccgtactcccgtgcgtggggctggggtcccgaccaacccccgagggaaggtcttggaggttggagttggagtatagtcgtggtcccgggtagggctacttactaaccaacccgtcccagaaaacggccggccaccctatcggacgggaccacggaccaaaggacggtatttccgacgcttgtaagtttgactttcgacgtcggaccgcacgacgtacgacggtccttattgttttcggagacggaggaacttaacgtctacgttcgtaactcgtcggtcgggcccgtggacctcgttccgttggtacctacctcgtccttccgtccgacttcccggaccgtaacgggccctacgtccgttacccttccccgngggtccctcccgttcgcctccgaggtcccg

SEQ ID NO: 153621 - DNA, 687 bp, Homo sapiens
  misc_feature: GYAE6OF02FU0F0.23.27.C05.1.454.CMB.1.raw
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
tcagacgcgagtatcacgaccggtgctcgatttagacgcgatcgaagggtttgggggagtcagaccctgtcaggacacagcatggacatgagggtccccgctcagctcctggggctcctgctgctctggctccaggaacgaagggtgacgttcagatgacccagtcctccaccctccctgtctgcatcctggttcggggaccgagtcaccatcacgttgccgggngagtcgtcgactattttcggttctttagtctggtanacaaacaaaaccgtggttacnccctaccgtcctcgtcgtctgtcactgacgtagttaacgaacggtcggggtacccagtcggtaagtattaccgaggtcgggactagggtgggtacgggttcggtaccttttaccgacttcctacaactaacgtccggacccggtcctcggaccggtccgtaggaaggttacgttttcgggtacctttacgtttccgtacggtctagtaccgtagttacttactagttaccgtacccgtaacgtacttaggtttacggaccggtaacgggtaacccttaaaggttcgtaacccgttactaaggtaaccgtaacgttggtcgtacttcgcctacgtacgttctcgttactcgtaacttccctaccggctacgttctaacgacgttaccgtcgtcgttcgaggtcggg

SEQ ID NO: 153622 - DNA, 796 bp, Homo sapiens
  misc_feature: GYAE6OF02J0YDN.23.27.C05.1.454.CMB.1.raw
  modified_base (544)..(544): a, c, t, g, unknown or other
  misc_feature (544)..(544): n is a, c, g, or t
tcagacgcgagtatcacgaccggtgctcgatttagacgcgatcgaagggtttggggatgctctctgagagtcatggacctcctgtgcaagaacatgaagcactgtggttttgcctctgctggtggcagcctccagatgggccctgtcccaggcgcgaagtgcgaggacgtcgggccaggctggtgacggtccttacggaaacctgtcgttcttccgtgcacttcgtctcgtactcggtctccgtacaccgtactccgtgtcgtgggtacgtcgggtccggaccgaaccccggtaggggtaacgggttcgttacggtaggtaggtacggttacggagtagttacgtccgttcgggtacccggtaggggtaccttacgtttaacgttacccgtaaccccgtccgttaacgtaaacgggtcccggccgtacctaacggttaccgggaacggggaccgacggaacgtaaacggtaacggtaacgtttaccgtcggtaactacgggttacgtttcgtaccgtttcggtcgtaaccggccggtaccgaanaccggtacccgtcggtacccggtttactttaggttttcggacgtacggtaagtaacgtaaacgttaccgttcttaaccggtacttaccggtcgggtaaccgggtccgtacggtctaacgtccgttaacgggtcaacccgtttggtacccgttcccgcggttacccgtaacccaaccgggtccggaccccgtttaacgggttcccgtcccgtttacccgggccgtcccgttaccgttccggaccgttacccgg

SEQ ID NO: 153623 - DNA, 682 bp, Homo sapiens
  misc_feature: GYAE6OF02G535T.23.27.C05.1.454.CMB.1.raw
  modified_base (214)..(214): a, c, t, g, unknown or other
  misc_feature (214)..(214): n is a, c, g, or t
  modified_base (649)..(649): a, c, t, g, unknown or other
  misc_feature (649)..(649): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttccngcactgtctctactgtcctccgtcaccgatccctgcgtggggctgggtccggccgaaccccccgagggaacgggtccttggaggttggagttggagtagtatcgtgtacccgggtaggggcctacgtttacttaaccaacccgtccctacgaaaacggtccggccctaccctagtccgaggggaccacggaccaaaggaacggaacttcgtcgcgtaggtagtttgacctttcgtgtacgacccgccgacgacgaccgacggccgttacttagttttcggcgtcggtaaggaacgtaaacgttactacgttcgtacttcgtacggtcggggccgcgtcgacgttccgtcggtaccacgttcgttcctcccgttcggtccttacccgaacccggtacgggtccccaggtttccccggttccccgtttacccccggnggtaccccgccccggttcgtaccgtaccccggg

SEQ ID NO: 153624 - DNA, 753 bp, Homo sapiens
  misc_feature: GYAE6OF02GYWJJ.23.27.C05.1.454.CMB.1.raw
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagatgggccctgtcccaggcacaagtcgcaggagtcgggccaggactggtgagccttacggaaaccctcgtctctttctgctacgtgtccttcgtactcgtctccgtacgaccgtactcctcgcgtggggcgtcgggtccggaccacccggaggggtaacggttgtacgagtcggtagttaggagtacgtatcgtcggtaccgggtacgggtactacttacgtacccgtaaccgtccaacgaaacggccggacctaccgtacggacgtacggggacgacggaaccaaggacgtaactcgtcgcgttgtacgttcgtacttcgtcgtcgaccgccganaggtaccaccgggtntaccgtttaagtttgacgtaggaaacggtaacgttaaacttaccgttaacgtccgtaagtttccggtacgggacgggtcccggtcgtaaacctccggtttaaccgtccgggttcgtaacgttccccgtttcggttccccgtaccggtttccccgttaaaccgaaacccccgggaacggggttaccccttaacgggtttttccccgggtacccccggtttcccggttcccgggaacccgtccccggttacggtccccgtaacccggg

SEQ ID NO: 153625 - DNA, 603 bp, Homo sapiens
  misc_feature: GYAE6OF02JKKFE.23.27.C05.1.454.CMB.1.raw
  modified_base (213)..(213): a, c, t, g, unknown or other
  misc_feature (213)..(213): n is a, c, g, or t
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (517)..(517): a, c, t, g, unknown or other
  misc_feature (517)..(517): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
tcagacgcgagtatcacgaccggtgctcgatttagacgcgatcgaagggtcttgagtggattggagatatctgtcccggtagggggcacttattacaacccgtccctcaaaagacgggccgccctatcaggggacacggccaagaaggaattctcgctgagtttgacttctgtgaccgccgcagacacggccgtcttatttttgtgcgagganaaactctacttcgatctacgtgggccgcggcatccgtgtcactgtctccgtcggcttccaaccgaacggcccatcggtctccccgtggccgcctcgcctccgagacgcaccttcggtcggggccacgacggcccggtaccgttcgggccgttcgccgtggtaccgaacggtaccgttaaccttcccgtaagttcccgaccggtccggttccgtcggtaacgggcccggggtctaaccggggacgtaacggggccgtaccgaagttaacggcagtcaccancgagcctgngcgtncagtntnntncgtactngactcnagtgcacnacncgacgtagtagtacgacgtacggtgtacganacncgtacagatatagtacgaccgtacgtac

SEQ ID NO: 153626 - DNA, 889 bp, Homo sapiens
  misc_feature: GYAE6OF02JYMAZ.23.27.C05.1.454.CMB.1.raw
tcagacgcgagtatcacgaccggtgctcgatttagacgcgatcgaagggtttggggatgctctctgagagtcatggacctcctgtgcaagaacatgaagcacctgtggttttgcctcctgctggtggcagctcccagagtgggccctgtcccaggcgcaagtgcgaggaggtccgggacccaggactggtgacgggtcccttaccggaaaccctgtcgttcttcctgctacttcgtctacctacgttcgtccgtccgtaccgtaccgtactcccgtgtccggtcggggtccgtcgggtcccggaccgaaccccggtaggggtaacggttcgttaggtacgtggtagtaggagtattcgtcgttcggtccggtagggctaacttactaccgtaccgtacctaacgaaacggtccggccctacctacgtacggacgggtaaccgaccggtacgaaacggtaacggtaactttccgcggtacgttacggtacgggtttaccgtaccgttttaccgtaggtacccgggaccccgtaccggtaaccgggaccggtaaaccccggttaccgggttccccgtttaacgtttaacggtttttccgggaaccggtacgggtaaaccgggtaaacgttaaaaccgttcccgttaacgttaccgggtaaacccgttcggttacccgggtcgggggtaacccgttaccggtaccgttacccgtttaccggttaccggtaccgttaaccgttcccgttaccgtcccgttcccggttaccccgtaacccggtaaacccgggttacccgggtcccccgtttaacggtttccccccgggttaccccgtttaccccggggccccgggttaacccggtccccgttaacgttccccgtaaacccgggg

SEQ ID NO: 153627 - DNA, 741 bp, Homo sapiens
  misc_feature: GYAE6OF01CANBM.24.59.F04.1.454.CMB.1.raw
  modified_base (154)..(154): a, c, t, g, unknown or other
  misc_feature (154)..(154): n is a, c, g, or t
  modified_base (156)..(156): a, c, t, g, unknown or other
  misc_feature (156)..(156): n is a, c, g, or t
  modified_base (183)..(183): a, c, t, g, unknown or other
  misc_feature (183)..(183): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggngngtttctaggcggctaattttaaaaggngtcagtgtgaggtgaagttgttggagtctgggggagccttggttcggcccgggggtcctgagctctcatgtgcagctctggattcacattaactacaaatggcatgagttggctccgccacggcgtccacgggaaggggccgggtggtaggtcgggtcggtccggtcgggttagggtgggtagggtggtcgtaacgaacaactaacgttacgtacggtcggtccggtccggtacggaacgggaccggtacgttaccgtaccgtacgtaccgtaccgtaacggttaccgtttaccgtaacgtaacgaaccgtacgtacgtaacgtacgtaacgtaagtaacgtaacgtacgtacgtacggtaacggtacggtacgtaaccgtaaccgtaccggttacccgttttaacgtttaacgttacgttacggtaacggtaacggtaacggttacggttaacggtacgggtaccggtaaccggtacggttacgttacccggttccgttaccgtacggtaacggtacgggtaccgggtaaccgggtaaccggtccggtccgtacccg

SEQ ID NO: 153628 - DNA, 578 bp, Homo sapiens
  misc_feature: GYAE6OF01BL6BM.24.59.F04.1.454.CMB.1.raw
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (231)..(233): a, c, t, g, unknown or other
  misc_feature (231)..(233): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagactactatgtcacgaccggtgctcgatttagtacacacacttagggagttggggtctgagtagaggagcccagccctgggattttcaggtgtttcatttggtgatcaggactgaacagagagaactcaccatggagtttgggctgagcggtctggttctaggcgctatttaaggngcngngngagtgagtgtgngcgnggntctgtcgcgggtcngnctntnatntnnnctntgntatatatactacangcncngagtgcgcgcgngcgcgaggaggcgtgnggtggtcgcgtcgtagtcggtcgtcgcgtacacactactacgtacgcgtcgtacgtacgaacggacgtactacactactctacgtacgtacgtactacgactacgtacgtacgacgtacgtacgaacgtacgaacgacgtacgtagtagagacgacgacgtaccgtaccgttacgttattacgttacgtacgtacgtaacggtacggtacgtacggtaccgtacgtacgttaccgttacccgtccgttacgtacgtacgtacggaccggaccggtaccgtccgtccgtaccg

SEQ ID NO: 153629 - DNA, 505 bp, Homo sapiens
  misc_feature: GYAE6OF01D1GID.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccaggggccccatcaaggttcagcggcagtagatcgtgggacagttcttcacctttcaccatcagcggcctgcagcctgaggatgttggcacattattactgtacaacaatatagacgataagtgtactacgttttggccgtaaggggacgaggtggagcgtacaaacgacgtggtggcgtgaccacatctagtcttctatccgttaccccg

SEQ ID NO: 153630 - DNA, 494 bp, Homo sapiens
  misc_feature: GYAE6OF01BOZNQ.24.59.F04.1.454.CMB.1.raw
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
tcagactactatgtcacgaccggtgctcgatttagtacacacacttagggattgggcacagcgtggacatgagggtccccgctcagctcctggggctcctgctactctggctccgaggtgccagatgtgacatccagatgacccagtctccatcctccctgtctgcatctgtaggagacagagtcaccatcacttgttgggcaagtgagaccattagcagctctttgagttggcatcaattcaaaccagggaaagccctaactcctgatctatactgcgtccaatttacacagtgggtcccatccaggttcagtgcaatggatctgggacagagttcactctcaccatcagcagtctgcaacctgaagtactttgactaacttactattgtacaactagagttacacgtttccccggtactaccgttcggcggtacgggaccaagggtgagatcacacgactgtgctgcacntctgtcttcatctcccgctntc

SEQ ID NO: 153631 - DNA, 568 bp, Homo sapiens
  misc_feature: GYAE6OF01C24F4.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggcttttcttgtggctattttaaaaggtgtccagtgtgaggtgaagttgttggagtctgggggagccttggttcggcccggggggtccctgagactctcatgtgcagcctctggattcacatttaactacaatggcatgagttggctccgccaggctccgagggaaggggctgggagtggggtcgccgtcgggttagtggggagtggctacaacacattctacgcgggctccgtgaagggccgattcaccatctccaaggtactttccaagaacacgctgaatctaggaaatgaacagtctgagagtcgacgacacggtccctttattattgtgcgaaaggaggttactagtggtccggacagttactcccgtcctttgacgtaacgtacggggccacgggacccgtggtaccg

SEQ ID NO: 153632 - DNA, 565 bp, Homo sapiens
  misc_feature: GYAE6OF01ALGRC.24.59.F04.1.454.CMB.1.raw
  modified_base (257)..(257): a, c, t, g, unknown or other
  misc_feature (257)..(257): n is a, c, g, or t
  modified_base (330)..(330): a, c, t, g, unknown or other
  misc_feature (330)..(330): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtcgtgtttctaggtcggctatttaaaggtgtcagtgtgagtgagttgtggagtctggggagccttggttcggccgggggtccctgagctctcatgtgcagcctntggattccactattttaacacaatggcatgagttcggctccgccaggctccgagggaaggctggagtgggtcnccgtaggtgtgggatggctacaacacattcacggcggcgttccgtgaacgggccattcaccatctaccaggtactttccaagacacgctataatctggaatanacagtntgagagtacgacgacgacgtacgttacttagttgtagtacgtagtaggtacgtagtcggtacggtacgtacgttacgtacgtcgttacgtacgtacgtacggacggacggtaccgtcgtcgtaccg

SEQ ID NO: 153633 - DNA, 570 bp, Homo sapiens
  misc_feature: GYAE6OF01DD89Q.24.59.F04.1.454.CMB.1.raw
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcgtgtgtttctaggtggctatttaaaaggtgtccagtgtgaggtgaagttgttggagtctgggggagccgttggttcggcccggggggtccctgagactctcatgtgcagcctctggattcactatttaactacaatggcatgagttggctccgccaggctccgaggggaagggctgggagtgggtcgccgtggttagngggngtggctacaacacatctacgcggctccgtgaggccgattcacatctccaagctttacaagacacgctagaatctaggaatgaacagtctgagagtcgacgacacggtccctttatacttgtagacgaaaggtagggttactaagtggtaccggtactagttactcccgtaccgtttgaacggtagtcggggaccaacggggaccctgggtacccg

SEQ ID NO: 153634 - DNA, 545 bp, Homo sapiens
  misc_feature: GYAE6OF01DZQBT.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggcaagggccctaaactcctggtcaacgatgcatcaatcggtgccagggcccatcaaggttcagcggcagtagatctgggactattcttcaccttcaccatcgagcgcctgcagcctgacgtagtgttcggcacgtatattactcgtacaaacaatatagacgtaattagtagtacctagttttcggaccgaaggggtacgtaaggtcgggaagtaccgtacaaaacgtaccgtggtaggcgttacggacctaaccgtacgtcttacgttcctttactacgttccgttacccccgg

SEQ ID NO: 153635 - DNA, 564 bp, Homo sapiens
  misc_feature: GYAE6OF01CR10R.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttgggttcggcccgggggtccctgagactctcatgtgcagcctctggattcacatttaactacaatggcatgagttggctccgccaggctccgagggagggctggagtgggtcgcctcgggttagtgggagtggctacaacacattctacgcgggctccgtgaagggccgattcaccatctccaaggtactttccaagaacacgctagaatctaggaatgaacagtctgagagtacgacgacacggtccctttattattgtgacgaagagggttactagtggtccggacgtagttatcccgtcctttgacgaagtcggggaccagggaaccctggtcgtacccg

SEQ ID NO: 153636 - DNA, 509 bp, Homo sapiens
  misc_feature: GYAE6OF01CR0O4.24.59.F04.1.454.CMB.1.raw
  modified_base (458)..(458): a, c, t, g, unknown or other
  misc_feature (458)..(458): n is a, c, g, or t
  modified_base (498)..(498): a, c, t, g, unknown or other
  misc_feature (498)..(498): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcaatacaaaaaccaggacaacgggccctaaactcctaggtacaacgatgacatccaagtcggtgccgacgggccccagtcaaggttcagcggcagtagatcgtagggactattctcaccttcaccatcacgcgcctgcagcctggagatgttcgacactatacttactgtacaactaatatgaacgtatatagtactacgtttggaccgagggacgtagggngagctacgaaagacgtggtgctgccacagtctgtacttcncgttctacccg

SEQ ID NO: 153637 - DNA, 565 bp, Homo sapiens
  misc_feature: GYAE6OF01DHMYQ.24.59.F04.1.454.CMB.1.raw
  modified_base (184)..(184): a, c, t, g, unknown or other
  misc_feature (184)..(184): n is a, c, g, or t
  modified_base (213)..(213): a, c, t, g, unknown or other
  misc_feature (213)..(213): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtcgtcgtttctaggtcggctaatttaaaggntcagtgtgagtgagttgtgagtctggggnccttggttcggccgggggttcctgacgactctcatgtgcagcctctgattttcatatttaactagatggcatgagttgcgtccgcgaggctcgagggaggggtntggagtggcgcgtcggtagtggagtgcacanacatctacggcggtctcgtgacggtccgattcactntctcagactttcaagtacagctgaatcaggaatgaacgngtacgagagacgtacgacgtacgtaccgttcctttagttagttgtagacgtaaggtaggttacgtagtcggtacgtacgtacgttacgtcccgttcgttaggacggtacggtcggtacgacgggtaccgtcggtaccgtccg

SEQ ID NO: 153638 - DNA, 603 bp, Homo sapiens
  misc_feature: GYAE6OF01CTPTE.24.59.F04.1.454.CMB.1.raw
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
  modified_base (474)..(474): a, c, t, g, unknown or other
  misc_feature (474)..(474): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtcgtttctaggtcggctaatttaaaggntcagtatgaggtgaagttgtggagtcgtggggntccgttggtccgggcccgggggtcctgagactctcgatgtcgcacgcctcgtggattccactaattttaaccataagtgganatgagttggctccgaccaggcaccgaggggaacgggtgtgggnggtgggtccgaccgttgggttagtgggacgtggctaacacnattcgacggcggtctcgnggaacgggccattccactatcctcgaaggttacctttcaaacgacacgtctagatactaggaatagaacaagtntagagagacgacgacgacggtacctttacttattgtgtacgaagtaggttaacgtagtcggtcgtacgtacgttacgtaccgtccgttacgtacgtacgtacggacggacggaccgtcggtcgtacccg

SEQ ID NO: 153639 - DNA, 689 bp, Homo sapiens
  misc_feature: GYAE6OF01CMKWB.24.59.F04.1.454.CMB.1.raw
  modified_base (183)..(183): a, c, t, g, unknown or other
  misc_feature (183)..(183): n is a, c, g, or t
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (359)..(359): a, c, t, g, unknown or other
  misc_feature (359)..(359): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtgtttctaggtcggctaattttaaaggngtcagtgtgaggtgaagttgttggagtctggggngccttggttcgggcccgggggtcctgagactctcatgtcgcagcctntggtattcactaattttaaccanaatggacattgagttcggctcgccgagctcgagggaaggtctggaggtggtcgccgtggtagtgggagtggnacaacacattcacgcgggctccggtaggaagggcccgtatttccacaactccgtactaacggtaccttttaccgaacgaactacccggacttaggaacttacgttaaggaaagttacgaaaccgtacgtcgttacggagagttaccgaccggtaacgaaccggttaccccttttagttacgttagtcgtaaccggtaaaggttacgggttaacgttacgtacgggtaccggtacgtaacggttacgttccccggtaccgtttacggtaacccgtaaggttccggggaccgtaaccggggtaacccgttcggggttaacccttaaccccgg

SEQ ID NO: 153640 - DNA, 516 bp, Homo sapiens
  misc_feature: GYAE6OF01D23VF.24.59.F04.1.454.CMB.1.raw
  modified_base (323)..(323): a, c, t, g, unknown or other
  misc_feature (323)..(323): n is a, c, g, or t
  modified_base (402)..(402): a, c, t, g, unknown or other
  misc_feature (402)..(402): n is a, c, g, or t
  modified_base (503)..(503): a, c, t, g, unknown or other
  misc_feature (503)..(503): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggcaagggccctaaactcctggtcaacgatgcatccaatcgggtgccgacggggccccatcaaggttcagcggnagtagatcgtgggactattcttcaccttcaccatcagcggcctgcagcctgaggatgtggcacatattactgtacaaanaatatgaacgattatagttactacgttttgggaccgtaggggacgagggtggagcctacgaaacgtacgtggtggcgtgacctacacttctcgttacttcncgttccttccccg

SEQ ID NO: 153641 - DNA, 591 bp, Homo sapiens
  misc_feature: GYAE6OF01AN9QY.24.59.F04.1.454.CMB.1.raw
  modified_base (153)..(153): a, c, t, g, unknown or other
  misc_feature (153)..(153): n is a, c, g, or t
  modified_base (177)..(177): a, c, t, g, unknown or other
  misc_feature (177)..(177): n is a, c, g, or t
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
  modified_base (230)..(231): a, c, t, g, unknown or other
  misc_feature (230)..(231): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagactactatgtcacgaccggtgctcgatttagtacacacacttagggattgggtctgagagaggagcccagccctgggattttcaggtgttttcatttggtgatcaggactgaacagagagaactcaccatggagtttgggctgagcggngtgttctaggcgctatttaaaggngtcagtgtgagtgagtgtgatntggganctggtcgccggggtcctgagctctnntgtgnagctgtgntcatattacacatgctatgagtcgcctcgacgcgctcgagggaggctggcggtggtcgtcgtcggtaggtggtggtgtcgtacaacgactactcgtacgcggtcgtcgtacgacggcgtactcgacactctacgtacgtacgttaccgtaacgaacgtacgtacgtagtacgtacgtagtaagtacgtaagtagtacgtagagacgtacgacgtaaccgtaccgtacgttacgttacgttagtacgtacgtaacggtacggttagtacgtacggtacggtacgtacgttacgttaccgtcgttacgtacgtacggtacggtacggacggtaaccgtcgtccgtaccg

SEQ ID NO: 153642 - DNA, 672 bp, Homo sapiens
  misc_feature: GYAE6OF01E0017.24.59.F04.1.454.CMB.1.raw
  modified_base (182)..(182): a, c, t, g, unknown or other
  misc_feature (182)..(182): n is a, c, g, or t
  modified_base (441)..(441): a, c, t, g, unknown or other
  misc_feature (441)..(441): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagttttgggctgagcgtgtgtttctaggtggctattttaaaaggngtcagtgtgaggtgaagttgttggagtctgggggagtccgttggttcgggcccgggggtccctgagactctcatgtgcagcctctggattcacatttaacacaatggcatgagttggctccgccgcgcgtcagggaagggcgtggaggtgggtcgccgtcggttaggtggaggtggctacaacacattctacgcggcgtccgtgaacgggccgacttcaccactctaccaacgtactttaccaacgaacacgctagaanatcgtaaggaaagtacgaacgtacgtacgtaggaacgtacgtaccggaaccgtaaccgtaacccggttacccgttttaacgtttaacgtttaggtacggtaacggtaaacgggttaacgggttaaacgaacggttaccgggttaccggtaaccgttaacgtttacccgtacccgttaccgttacgggtaacggtaacgggtaccgggtaccgggtaacccgggtaacccgg

SEQ ID NO: 153643 - DNA, 788 bp, Homo sapiens
  misc_feature: GYAE6OF01DKDFS.24.59.F04.1.454.CMB.1.raw
  modified_base (250)..(250): a, c, t, g, unknown or other
  misc_feature (250)..(250): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtgggagacagagtcacatctcttgccaggcgagtcgagggctattaactactttagtaaattgtatcatacaaaaacnggacaagggaccctaaactcctggtacaacgatgcactaccaagtcgggtcgccgacggggccccagtccgaaggttccaggccggacgagtaagtacgtcgtacggggactacgttttccttacctaacccttttacaaccctaacttccgaaccggccgggtacccttcgggaccctaacggtccccgttagggaagggtaacgtttgggtttacgggaccaaacgttaatttacgtttaaaccgttcggttaaccaaaacttaaacttaacgtaacggtaaaccgttaagtttaacgttaacggttaacccgtttaaacgggttttttaccggggaacccggggttaaacgggggggtaaaccgggttaaaacgggggttcggggtaaaccggttacccgttaaacccggaaaaacccgggttaacggtttacggggtaccgggtacccgtttccggaaccgtaaccccgttagttacccggtttacgttttaacccgtttacccttaaccggtttccccctttacccccccggg

SEQ ID NO: 153644 - DNA, 575 bp, Homo sapiens
  misc_feature: GYAE6OF01AHMS3.24.59.F04.1.454.CMB.1.raw
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (352)..(352): a, c, t, g, unknown or other
  misc_feature (352)..(352): n is a, c, g, or t
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcggcgtggttctaggcgctatttaaggncngtgtgngtnagtgtgagtctggggancgttcggtcggccggggtcctgacgctgcangtgcctagcctgtcggatcactagttacacatggcatgagttggcaccgcgtcggcctcggaacggtaggcgtggtgcgggtcgcccgttcggaggttggagttggctacaancggattcggacgcgggcttccgtgacggccgattcgaacctcnctcacgtacttactacgacaacgacgtntatacgtagtagtagacgagtcgtacgtagacgtacgtacgtacgtacgtacgttacttacgtagtacgtacgtaggtacgtacgtacgtacggtacgtacgtacgtacgtccgtcgttcgtacgtacggtacggacggacggtcgtcgtcg

SEQ ID NO: 153645 - DNA, 507 bp, Homo sapiens
  misc_feature: GYAE6OF01C7BPZ.24.59.F04.1.454.CMB.1.raw
  modified_base (495)..(495): a, c, t, g, unknown or other
  misc_feature (495)..(495): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggacaagggaccctaaactcctggtcaacgatgcatccaatcgggtgccgacggggccccatcgaaggttcaggcggcagtagatcgtgggactatttctcacctttcacctatcagcggctgcagcctgaggatgttggcactatattactgtacaacatatgacgtatatagtactacgttttggaccgagggacgagggtggacgctacgaaacgacgtggtgcgtgaccacatctgtcttcntccgttaccccg

SEQ ID NO: 153646 - DNA, 603 bp, Homo sapiens
  misc_feature: GYAE6OF01B16OZ.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcgtggtcgttttctaggtggctattttaaaaggtgtccagtgtgaggtgaagttgttggagtcgtgggggagccttgggttcggcccggggggtccctgagactctcatgtgcagcctctggattcactatttaactacaatggcatgagttggctccgccaggctccgagggaaggggctggagtgggtcgcctcgggttagtgggagtggctacgaacacgattcgtacggcgggcttcccggtggaaacggggcccgtagtttcccaaccgattccttacccaagggtaccttttaccaaggaaccacgctagaatctaggaaactgaacagtctgagagtcgacgacgacgtccctttattattgtgacgaagaggttactagtcggtccggactagttactcccgtccttgacgtaagtcgggaccgacgggtacccgtggtaccg

SEQ ID NO: 153647 - DNA, 561 bp, Homo sapiens
  misc_feature: GYAE6OF01B9V6C.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggcttttcttgtggctatttaaaaggtgtccagtgtgaggtgaagttgttggagtctgggggagccttggttcggcccgggggtccctgagactctcatgtgcagcctctggattcacatttaacacaatggcatgagttgctccgcaggctccgagggaaggggctggagtgggtcgcctcggttagtgggagtggctacacacattctacgcgggctccggtgaacgggccgattcaccatcctccaaggtactttaccaagaacacgctgaatctaggaaatgaacagtctgagagtcgacgacacggtccttattattgtgacgaagaggttactagtggtaccgtacgagttactcccgtctttacgacgtaagtcgggaccagggaacccgtggtctacccgg

SEQ ID NO: 153648 - DNA, 179 bp, Homo sapiens
  misc_feature: GYAE6OF01BYWV5.24.59.F04.1.454.CMB.1.raw
  modified_base (171)..(179): a, c, t, g, unknown or other
  misc_feature (171)..(179): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgggctggcaaggcgcatagnnnnnnnnn

SEQ ID NO: 153649 - DNA, 507 bp, Homo sapiens
  misc_feature: GYAE6OF01EJJLO.24.59.F04.1.454.CMB.1.raw
  modified_base (495)..(495): a, c, t, g, unknown or other
  misc_feature (495)..(495): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccaggggccccatcgaagttcagcggcagtagatctgggacattcttcaccttcaccatcagcggcctgcagcctgaggatgttggcacgatattactgtacaacaatatagacgatatgtactacgttttaggccgaggggacgagggtggagtactacgaaacgacgtcgtggcgtcgaccaccgattctagtccttctnttccgttccccg

SEQ ID NO: 153650 - DNA, 603 bp, Homo sapiens
  misc_feature: GYAE6OF01CBCHN.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagtccgttgggttccggccccggggggtccctggagactctcatgtgcagcctctggattcactatttaacacaatggcatgagttggcctcgccaggctccgaggggagggctgggagtgggtcgccgtggttaggtgggagtggctacaacactattcacggcggctccggtggaacgggccgtattccaccgtatccgtaccgaacggtaccttttaccgaaacgaacacgactacgaatcgtaggaaatagaactagtctagagagtacgacgacgacgtacctttagttattgtgacgtaagaggttactagtcggtacgacgtacgttactcccgtcgttacgacgtacgtcgggacacgggtaccgtggtccgtacccg

SEQ ID NO: 153651 - DNA, 484 bp, Homo sapiens
  misc_feature: GYAE6OF01AGXZ3.24.59.F04.1.454.CMB.1.raw
tcagactactatgtcacgaccggtgctcgatttagtacacacacttagggattgggcacagcgtggacatgagggtccctgctcagatcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccaggggccccatcaaggttcagcggcagtagatctgggacattcttcacttcaccatcagcggcctgcagcctgaggatgtggcacatattactgtcaacaatatagacgatatagtacacttttggccaggggacgaaggtggagctacaaacgaactggtggctgcacatctgtcttcatcttccccg

SEQ ID NO: 153652 - DNA, 586 bp, Homo sapiens
  misc_feature: GYAE6OF01CG8EU.24.59.F04.1.454.CMB.1.raw
  modified_base (544)..(544): a, c, t, g, unknown or other
  misc_feature (544)..(544): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagccgttgggttccgggcccggggggtccctgagactctcatgtgcagcctctggattcacatttaacacaatggcatgagttggctccgccaggctccgagggaagggctgggagtgggtcgccgtcgggttagtgggagtggctacaacacattcgacggcgggctccggtgaacgggccgtattccgaccatcctaccaaggtaccttttacgaacgaacacgactagaatacgtagaaatgaacagtactagagagtcgacgacgaccgtaccttattacttgtcgtacgaagtaggttacgtagtcggtacgacgtgttacnccgtcttagagtacgtcgggacgaggacccgtggtcctaccg

SEQ ID NO: 153653 - DNA, 685 bp, Homo sapiens
  misc_feature: GYAE6OF01B7W1B.24.59.F04.1.454.CMB.1.raw
  modified_base (217)..(217): a, c, t, g, unknown or other
  misc_feature (217)..(217): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccttccaccctgtctgcatctgtaggagacagagtcaccatcacttgccgggcagtcagagtgtttcngccgtgggtggcctggtatcagcaagaaaccgaagggaaacgccctaaattcctagactctaataacggtcgttacttaattttaacgaaaggttcggggttaccctttacgaagggtttcaacggtcgggacagggttacggattcggtaggggaaccaaggtaaactttccaaccgtactacaactaactcaagcaagccctggccaggcctggacttgttattttacgaccttaactttacgtttactacgacctaaacgtagttactagtaacttcgtacctttaaccgtccccgttaacccgtttccgggacccgtaacgggggaaccctacggtaacccgtagggaaacctttaacgtttaacgtaccggtaaagtcgggtacggtccttaccgggaccctaaccgttaattcccgttacggttacctttacctaaccgtttccccgttaccccggtaaccc

SEQ ID NO: 153654 - DNA, 562 bp, Homo sapiens
  misc_feature: GYAE6OF01DUY7W.24.59.F04.1.454.CMB.1.raw
  modified_base (375)..(375): a, c, t, g, unknown or other
  misc_feature (375)..(375): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctgagactctcatgtgcagcctctggattcactatttaacacaatggcatgagttgctccgcaggctcgaggggagggctggagtgggtcgccgtggttagtgggagtggctacacacattcacggcggctccgnggaacgggccattcaccatctaccaagtactttaccaagacacgctgaatcgtaggaatgaactagtctagagacgtcgacgacgacggtaccctttagttattgtgaggaagtagggttactagtcggtaccgacgtagttactcccgtcttagacgagtcgggaccagggaccctggcctacccg

SEQ ID NO: 153655 - DNA, 659 bp, Homo sapiens
  misc_feature: GYAE6OF01AEOD9.24.59.F04.1.454.CMB.1.raw
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtgtttctaggtggctatttaaaggtgtcagtgtgaggtgagttgtgagtcgtggggancttggttcggcccgggggtcctgagctctcatgtgcagcctntggattcantttaacacagtcgcatgngttggcctcgaccagggcctcgagggaggggctgggaagtgggcgccttgggtaaggtgggctggactacaacgctatcgtcggcggtctaccggnggaagggccacttacnccctatcccgtacaggtactttcaacggacaccggtctaggaaccttcgaggtaaactggaaaacctaggtttcctaggaggaaccgttcgggaacgtaccgaaccgggttcccttttaaaggtttcctttcggtagaccggttaaagtaaccggggttttacgtagttacgggttccccgggaacttaggtttaacgtcccggtcccgtttagaacccgtaagtccgggggtactaaccggggaccctttaggcccgtacccgg

SEQ ID NO: 153656 - DNA, 791 bp, Homo sapiens
  misc_feature: GYAE6OF01EPK1K.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgtcgttttctaggtggctaattttaaaaggtgtccagtgtgaggtgaagttgttggagtcgtgggggagccgttgggttcggcccggggggtccctgagactctcatgtgcagcctctggattcacatttaactacaatggcatgagttggctccgccaggctccgaggggaagggctgggagtgggtcgaccgtcgggttagtgggagtggctacgaacacattcgtacgcgggtctccggtaggaacggggcccgtatttaccgaacctaacttccgtaccgtaaacggtaccctttttaacccaacggtaaaccgtaacccgtacgttacgtaaacgttccgttaaggtaaaacgttacgaaactacggttaccttagggaaggtaacggttacggaacccggaacgtaacccgggttaccccctttttaagtttaacgttttacggttacggtaaccggtaaaagggtaacggggtttaacgttaacggttacggggttaacccgggtaacgtaacgggttttaaccgttacccccgggttcccgttttacgggaaacccggttaaacgggttaccgggggaacccggtaacccggggtaaaccccggtttcggggtccccggttaaccccggg

SEQ ID NO: 153657 - DNA, 498 bp, Homo sapiens
  misc_feature: GYAE6OF01CAFWJ.24.59.F04.1.454.CMB.1.raw
  modified_base (409)..(409): a, c, t, g, unknown or other
  misc_feature (409)..(409): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggctattaactactttgtaaattggtatcatacaaaacaggacaagggcctaaactcctggtcaacgatgcatccaagtcgggtgccgacgggccccatcgaaggttcagcggcagtagatcgtggacattctcaccttcacatcagcgctgcagccgtgagtgtgttcgcactatattactgtacaacatatgactatntagtactagtttggacgagggacgaggtggagtctacgaaacgtacgtggtggacgtcgaccacgtatcttagtctctctccttacccg

SEQ ID NO: 153658 - DNA, 633 bp, Homo sapiens
  misc_feature: GYAE6OF01E1WDW.24.59.F04.1.454.CMB.1.raw
  modified_base (183)..(183): a, c, t, g, unknown or other
  misc_feature (183)..(183): n is a, c, g, or t
  modified_base (283)..(283): a, c, t, g, unknown or other
  misc_feature (283)..(283): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagattgacccagtctccatcctccctgtctgcatctgtgggagacagngtcaccatctcttgccgaggcgagtccagggccagttaactactttgtaaattggtatcatacaaaaaccaggacaagggcctaaactcctggtcaacgntcgcatccaagtcgggtgccgacggggccccagtcaaggttcagcggcagtagatcgtgggactagttcttacacctttcacctatacgacggccggcctgccacgccgtaggacggtattcggttacggactaacgtacttaactttactggtacaaacgtaattacgtacggaacgtaattaacgttaggtaaccttacggtttttacgggacccgtaagggggtaaccggtaaagggttcggaacggtcgtaaaccgaaaaccgtaaccgttggttacgggcgttcgggacctaacccgtagttaccgttacggttacctttcgtaacgttcccgtttaacccccgg

SEQ ID NO: 153659 - DNA, 640 bp, Homo sapiens
  misc_feature: GYAE6OF01CUS14.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagccttgggttcggcccggggggtccctgagactctcatgtgcagcctctggattcactatttaactacaatggcatgagttgctccgcaggctccgagggagggctgggagtggggtcgccgttcgggttaggtggggagtggctaacaacactattccgtaacggcgggtcctccggtaggaacggggccgtagtttcccaaccacttcctacccgtaacggtacctttttacccgaaacgtaaccgaaccgtactacgtaactcgtaggaaatagaacgagtctagagagtacgacgaccgtaccggtccctttattattgtagacgaaagtagggttactagttcggtaccggtactaggttacgtcccgtccttacggacgtaacggtcgggaccgacgggacccgtcggtacccg

SEQ ID NO: 153660 - DNA, 510 bp, Homo sapiens
  misc_feature: GYAE6OF01DMHX9.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaaccaggacaagggccctaaaactcctggtcaacgatgcatccaatcgggtgccgaggggccccatcaaggttcagcggcagtagatcgtgggactattcttcaccttcaccatcagcgcctgcagcctgagatgttgcacatattactgtacaactaatatgaacgtattatagtactacgttttggaccgaggggtaacgaagggtggagtctacgaaacgaacgtgtgcgtgacaccatctgttaccttctatccttaccccg

SEQ ID NO: 153661 - DNA, 756 bp, Homo sapiens
  misc_feature: GYAE6OF01DWKLW.24.59.F04.1.454.CMB.1.raw
  modified_base (177)..(177): a, c, t, g, unknown or other
  misc_feature (177)..(177): n is a, c, g, or t
  modified_base (256)..(256): a, c, t, g, unknown or other
  misc_feature (256)..(256): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtggganacagagtcaccatctcttgccaggcgagtcgagggctaagttaacttactttagtaaattggtatacatacaaaaacgnggacgaacgggaccctaaactccgtaggtacaacggtatgactactaccgaagtccgggtcgacccggaccggggacccctagtaccgtaacgggtttacgacggtccggacgtaggtaacggtacttacggtacgggtacttagtttacccttaccgttaacccttaccctacctacttaccgaacggtcccgggccttcggacgaccgtccgtagggtacgggtagttcggttacggtactaactaactttaacgtttaacgtacggttaaccaaaaccttaagttaagtaacggaaccgttaagttaacgttacggttaacccgtttacggttttacgggaacccgggtaaagggggtaaccggtaaaggggtcgggaacggttaccgtaaaccggtaaaacggtaaccggttgggtaccggtacgtccgggaaccctaacccgtacgtttaccgttaccgtttacctttaccgtaacctttccccgttaacccccg

SEQ ID NO: 153662 - DNA, 496 bp, Homo sapiens
  misc_feature: GYAE6OF01BB6BG.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccaggggccccatcaaggttcagcggcagtagatctgggacattcttcaccttcaccatcagcggcctgcagctgaggatgtgcacatattactgtcaacatatgacatatagtactacgttttggccgtaggggacgaaggtggacgctacgaaacggaactggtagcgtgaccactatctgttacttctctccgttacccg

SEQ ID NO: 153663 - DNA, 561 bp, Homo sapiens
  misc_feature: GYAE6OF01DG6MZ.24.59.F04.1.454.CMB.1.raw
  modified_base (267)..(267): a, c, t, g, unknown or other
  misc_feature (267)..(267): n is a, c, g, or t
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtgttctaggtcggctaatttaaaggtgtcagtgtgaggtgaagttgttggagtcgtgggggagccgttgggttccgggcccggggggtccctgagctctcatgtgcagcctntggattcatatttacacatggcatgagttcggctccgcaggctcgaggggagggcgtggagtgggtcgccgtcggtagtgggagtggctacaancattcaggcggctaccgtgaaggccgattcncatctacagtactttcccaaanacacgactagactacgtagaatagaactagtctgagacgtacgacgtacgtaccgtacttacgttattgtgtagtagtagtacgtagtcgtacgtacgtacgtacgtccgtcgtcgtagacggtcggacgacggtacgtcgtcgtcg

SEQ ID NO: 153664 - DNA, 837 bp, Homo sapiens
  misc_feature: GYAE6OF01CTG33.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtctgggggagccgttggttcgggcccgggggtccctgagactctcatgtgcagcctcgtggattcacatttaactacaatggcatgagttggctccgccaggctccgagggaagggctggagtgggtcgccgtcggttagtgggagtggctacgacacattctacggcgggtctccggtggaacgggcccgtattcccgaacctatccttacccgtaaacgggtacctttttacccgaaacgtaaccgaaccggtaccgttacggaaacgttacccgttaagggtaaaacttaacgggaaaccgtaacggttaccgttagggtaaacggtaacgggtttaaccgggaacccgggtaaacccgaaccccggggtttaccccccttttttaaacgttttaacggttttacggttagggtaacccgggttaaaacgggttaaacgggggttttaaaccgttaacggtttaccgggggttacccgggtaaaccgttaacgggttttaacccggttacccccggttccccggtttttacgggtaaacccgggttaaacggttacccgggggggtaaccccgtaaccggggggttaaaacccccgttcgggggttaaccccgttaaacccccgggg

SEQ ID NO: 153665 - DNA, 484 bp, Homo sapiens
  misc_feature: GYAE6OF01BSEUI.24.59.F04.1.454.CMB.1.raw
  modified_base (178)..(182): a, c, t, g, unknown or other
  misc_feature (178)..(182): n is a, c, g, or t
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (215)..(216): a, c, t, g, unknown or other
  misc_feature (215)..(216): n is a, c, g, or t
  modified_base (218)..(223): a, c, t, g, unknown or other
  misc_feature (218)..(223): n is a, c, g, or t
  modified_base (225)..(225): a, c, t, g, unknown or other
  misc_feature (225)..(225): n is a, c, g, or t
  modified_base (228)..(230): a, c, t, g, unknown or other
  misc_feature (228)..(230): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (242)..(244): a, c, t, g, unknown or other
  misc_feature (242)..(244): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (368)..(368): a, c, t, g, unknown or other
  misc_feature (368)..(368): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagttttgggctgagcggctggttcaggcgctattaaggnnnnngtnatgtgntnggganctgtcgccgggtctganncnnnnnncnctnnntnatatacanannntgngtgcncncngcngngnggngngngngcgcgtgtgtgngngcanacanacncgtcgcgcgtcgacgagcgctcncactctacgtacgtactacaacacactactgagtagagaagtagacgngtagcgagagagcgacgtacgtacgtacttacttatacgtacgtagtagtacgtagtagtacgtacgtagtacgtcgtccgtcgtacgtacgtacgtacgacggtacgtacggtcg

SEQ ID NO: 153666 - DNA, 589 bp, Homo sapiens
  misc_feature: GYAE6OF01DJCWI.24.59.F04.1.454.CMB.1.raw
  modified_base (334)..(334): a, c, t, g, unknown or other
  misc_feature (334)..(334): n is a, c, g, or t
  modified_base (573)..(573): a, c, t, g, unknown or other
  misc_feature (573)..(573): n is a, c, g, or t
tcagactactatgtcacgaccggtgctcgatttagtacacacacttagggattgggcgactagcgtggacatgagggtccctgctctacgctcctgggcctcctgctgctctggcctctcaggtgccatatgtgacatccaggatgacccagtctccatcctccctgtctgcatctgtgggatacgagagtcaccatcgtcttgccaggacgacgtacgagggctaatttaacttacttttgtaaacttggtaattcgaatacgaaaaaaccgaggaccaagggaccctaaacgtccgtaggtacgaacgatggacagtaccaagtcgggtacnccgtacgggccccatacaaggtcaggcgctagacgactcgtagggactagtttcctcaccttacacctactacacgcggtcctcgtactacgtcctaggtagatggttgacactattatactagtacaataagtatgacgtatatgtaactcgtttcggacgagggaacgtacggtgaactcgacgaaacgtacgttagtcgacgtcgaaccacccgtagtccgttagttaccgttacnccgttcccgtaccccg

SEQ ID NO: 153667 - DNA, 739 bp, Homo sapiens
  misc_feature: GYAE6OF01C5XDR.24.59.F04.1.454.CMB.1.raw
  modified_base (183)..(183): a, c, t, g, unknown or other
  misc_feature (183)..(183): n is a, c, g, or t
  modified_base (218)..(218): a, c, t, g, unknown or other
  misc_feature (218)..(218): n is a, c, g, or t
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcgtgtcgtttctaggtggctaatttaaaggngtcagtgtgaggtgaagttgttggagtcgtggggngccttgggttcggcccgggggtcctgagctctcatgtgcagtcctgtggacttcaacttattttaactacaagtggcaattgagttggccttcggccagcgccgagggaagggctgggngtcgggtcgtacccgttgggtttaggggngggtagtcggaccttaacgaactacgttacgttaccggtacgggcccgggtcctaccgggtaagggacggggtccttaacttaccaaccacgtttacctaaccgtaacggttacccgtttaaccgaaacgtaaaccgtacgtacgttacgtaacgttacgtaacggtaaagtaacgaacgtacgtacgtagacggtacgtaccggaacgtaaccgtaccgttacctttaagttacgttagttacggtaacggtaaacggttacgggtttaacgtacggttaccgggtacgtaccgttacggtttaccgttcccggttacggttacgtacggtaacgggtacgggaaccgtaacgggtacccggtcggtacccg

SEQ ID NO: 153668 - DNA, 592 bp, Homo sapiens
  misc_feature: GYAE6OF01BEBEO.24.59.F04.1.454.CMB.1.raw
  modified_base (154)..(154): a, c, t, g, unknown or other
  misc_feature (154)..(154): n is a, c, g, or t
  modified_base (182)..(182): a, c, t, g, unknown or other
  misc_feature (182)..(182): n is a, c, g, or t
  modified_base (189)..(189): a, c, t, g, unknown or other
  misc_feature (189)..(189): n is a, c, g, or t
  modified_base (323)..(323): a, c, t, g, unknown or other
  misc_feature (323)..(323): n is a, c, g, or t
  modified_base (378)..(378): a, c, t, g, unknown or other
  misc_feature (378)..(378): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggngtgtttctaggtggctatttaaaaggtntcagtgngaggtgaagttgttggagtctgggggagccttggttcgggcccggggggtcctgagctctcatgtgcagcctctggattcacatttaacacaatggcatgagttggctccgccaggcaccagggaagggctggngtgggtccgctcgggttagtgggagtcggctacaacactattcacgcggctccgngaagggccgattccacctatctaccacggtacttttaccaaggtaaccacgaccgtgaacttcgtaggaaataggaactagtcgagagagccgaagacctacggtaccgtttacttattgtagtcgtaaaggagggttaactagtaggtacccggacgtagttactacccgtccttgacgagtcgggacgacgggacccgtgggtccgtacccg

SEQ ID NO: 153669 - DNA, 512 bp, Homo sapiens
  misc_feature: GYAE6OF01DDT6U.24.59.F04.1.454.CMB.1.raw
  modified_base (177)..(177): a, c, t, g, unknown or other
  misc_feature (177)..(177): n is a, c, g, or t
  modified_base (471)..(471): a, c, t, g, unknown or other
  misc_feature (471)..(471): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtggganacagagtcaccatctcttgccgggcgagtcagggctattaactactttgtaaattggtatcatacaaaaaccaggcaagggaccctaaactcctggtacaacgatgcatccaatcgggtgccgacggggcccatcaggttcaggcggcagtagatctgggacattctcaccttcacatcagtgcctgcagcctgagatgttggcactatattactgtacaacaatatagactatatagtactacgttttaggcgtaggggacgagggtggagactacgaaacgacgtgtcggtntcgcacctatcgttcgttcttatactccgttcccgtacccg

SEQ ID NO: 153670 - DNA, 496 bp, Homo sapiens
  misc_feature: GYAE6OF01B2E4Y.24.59.F04.1.454.CMB.1.raw
  modified_base (370)..(370): a, c, t, g, unknown or other
  misc_feature (370)..(370): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggcaagggcctaaactcctggtcaacgatgcatccaatcgggtcgccgacggggccccatcgaaggttcaggcggacagtagatcgtgggacattcttcaccttcaccatcagcgcctgcngcctgacggatgttggctactatattactgtacaacatatgacatatatactagtttggacgaggggacgaggtggagctacgaaacgagtggtgctgacacatctcgtacttctctcttaccccg

SEQ ID NO: 153671 - DNA, 601 bp, Homo sapiens
  misc_feature: GYAE6OF01BZL2D.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaacaggacaagggaccctaaactcctggtacaacgatgcactaccaagtcgggtcgcccgacggggccccagtacgaaggttcaggcggacaggtagatcgtgggactatttccttactaccttcaccactcgacggccggcctcgacgacgtccgtaggacggtagttcggttacgacactaattaacttacgtgtaccgaaactaattaatagaacgtaattactacgttacgttacgttttacggaccggtaaggggaacgtagggtggaggtaccttaacggaaacgtacgtcggtacggcgttacgcctaacctattaccgttcgttacctttcgtaccttcccgtttccccg

SEQ ID NO: 153672 - DNA, 608 bp, Homo sapiens
  misc_feature: GYAE6OF01DDTQ6.24.59.F04.1.454.CMB.1.raw
  modified_base (329)..(329): a, c, t, g, unknown or other
  misc_feature (329)..(329): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaattggtatcatacaaaaaccaggacaagggccctaaactcctaggtcaacgatgcatccaagtcgggtcgccgacggggccccatcgaaggttccaggcggnagtagacgtcgtagggactatttcttctaccttcaccatcgagccgctcgcgacgtccgtaggaggtagtggttcggacaacgtattaacttacgtcgtaacaactaattactagaacgtattagttacgtaacgttacgttttacgggaccggtaaggggtaacggtagggtaggaacgtcgtaaaccgtaaacggtaacgttagggtacgggtacgttacggaccctaaccgtacttccgttacgttacccgtttacaccgtttcccgttacccccg

SEQ ID NO: 153673 - DNA, 579 bp, Homo sapiens
  misc_feature: GYAE6OF01CWUR9.24.59.F04.1.454.CMB.1.raw
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (393)..(393): a, c, t, g, unknown or other
  misc_feature (393)..(393): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
tcagactactatgtcacgaccggtgctcgatttagtacacacacttagggattgggggctctgagagaggagcccagccctgggatttcaggttgttttcatttggtgatcaggactgaacagagagaactcaccatgggagtttgggctgagcgtgtgtttctaggtggctaattttaaaggngtcagtgtgagtgagtgtggagngnggggncgttggtcggcccgggggtcctgagctntcatgtgcagcctnaggnttcatatttaacacaatgnatgcgtgctccgcagtcnccggaggagggctggngcgggtcnccgtggtaggngggngtggctacgaanacagttcncggcgggcttcggaggaacgggcctaattcccaactntccctacgaacggtacctttaccaaggacacgtntacggaatacctaggtaaanagagtagtgngagacgacgacgacgtacgttacttattgttacgtaggacgtaaaggtagtagtacggtcggtaccgacgtcgtacctccgtcgttagacggtggtaccgggacggacggtccgtcgtaccc

SEQ ID NO: 153674 - DNA, 598 bp, Homo sapiens
  misc_feature: GYAE6OF01CX4PG.24.59.F04.1.454.CMB.1.raw
  modified_base (354)..(354): a, c, t, g, unknown or other
  misc_feature (354)..(354): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtctttttcttggtggctaattttaaaaggtgtccagtgtgaggtgaagttgttggagtcgtgggggagccgttgggttccgggcccggggggtccctggagactctcatgtgcagcctctggattcactatttaacacaatggcatgagttggctccgcaggctccgagggaagggctggagtgggtcgctcggttagngggagtggctacaacacattcacgcggctcggtgaagggcctattcaccatctcaaggtctttcaagacacgctagaatcgtaggaaatgaaacagtctgagagtacgaacgaccacgggtacccttttaattagttgtagacgtaaaggtacgggtttaactagtcgggtaccggactaagttacgtccccggtctttaggaccgtaagtcgggaccaggggtaacccctggtcccgtacccg

SEQ ID NO: 153675 - DNA, 715 bp, Homo sapiens
  misc_feature: GYAE6OF01B9IRR.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctggggagccgttggttcggcccgggggtccctgagactctcatgtgcagcctcgtgattcactatttaactacaatggcatgagttgctccgcaggctccgagggagggctggaggtggtcgcgtcggtaggtgggagtcggctacgaacacagttcgacggcggtccgtccggaggaacgggccctattccaccgtacttccgtaccgtaacggttaccttttaccgaaacgaaccgtaccgtcgtaacgtaacttaccgtaggaaacgttacgaaactacggtactaggaaggtacgttaccggacggtaaccgtaccgggttacccctttttaagtttacgtttacggttaggtaaccggtaaaggttacggggtttaaccttacggttaccggggtacccgggtaacgttacggtttaacctaccccggttccgtttaacgggacgttaaacgggtcggggtaacccgaacggggtaaccccgttcgggtccctaccccgg

SEQ ID NO: 153676 - DNA, 754 bp, Homo sapiens
  misc_feature: GYAE6OF01C5LX0.24.59.F04.1.454.CMB.1.raw
  modified_base (310)..(310): a, c, t, g, unknown or other
  misc_feature (310)..(310): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagtccgttgggttccgggcccggggggtccctggacgactctcatgtgcagcctctggattcacatttaacacaatgcatgagttgctccgcnggctccgagggaacgggcgtggagtgggtcgccgtcgggtaggtgggagtggactaacacgacacgttcacgcggctccgtggaacgggccgtattcgaacctatcctacctaaacggtaccttttaccgaaacgtaacaaccgtacctagaaacttacgtagggaaaactcggtaaacctaggttacctaggtacgtaacggtaccggaaccgtaaccggtaacccgggttaccccctttttaaagtttacgttttacggtacgggtaaccggtaaaacgggttaacggggttttaaaccttaaggttaccggggttaccccgggtaaacggtttaacggttaaccgtttacccccgggttaccgttttaacgggaaccggtaacgggttcgggggtaaccccgaaccgggggtaaacccctcgggtaccccgttaaccccgg

SEQ ID NO: 153677 - DNA, 573 bp, Homo sapiens
  misc_feature: GYAE6OF01B8W80.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggacaagggccctaaactcctggtcaacgatgcatccaagtcgggtgccgaggggccccagtacaaggttcagcggcagtagatcgtgggactatttcttccaccttccacctatcaggccggcctgcagcccgtgaggatggttgactactatattactgtacaaacaatagtgaacgtatagttacgtaactacgttttggacccggtaagggggaaccggaagggtacgggacgtaccgtacgaaaacggtaacgttggtagggccttacgaccaaccctattccttacgttaccctttacgtaccttcccgttacccccg

SEQ ID NO: 153678 - DNA, 600 bp, Homo sapiens
  misc_feature: GYAE6OF01C45KM.24.59.F04.1.454.CMB.1.raw
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (446)..(446): a, c, t, g, unknown or other
  misc_feature (446)..(446): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagtttgttggagtcgtgggggagccgttgggttcgggccccggggggtccctgagactctcatgtgcagcctctggattcactaattttaacacaaatggcaatgagttggctccgcaggctcgagggagggcnggagtgggtcgcgtcggttagngggagtggctacaacactattcgacgcgggctccggtggaacgggccgtattccacctatcctaccaagtacctttaccaaagtacacgtctnaatctaggaatgaacagtctgagagtacgacacgacggtcctttagtattcgtgacgtaagtaggttactagtcggtaccgaacgtacgttacgtcccgtcctttaggaaccgtaggtaccggggacagggtaaccccgtggtcccgtaacccg

SEQ ID NO: 153679 - DNA, 592 bp, Homo sapiens
  misc_feature: GYAE6OF01DVASQ.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtgggagacagagtcaccatcacttgttgggcaagtgagaccattagcagtcttcgttgagttggcatcaattacaaaccgaggaacgccccctaactcctgatctatactgcgtacctaatttacacgtaggtcgggtccctagtcctaggttcagtggactaagtggatcgtgggacagtacgttcactctcaccatcagctagtctagaccaacgtgtaagtactttagaccttaacttacttattcgtacaacgtagtaacgttaccgtaccgttcccgtactaccgttcggggacggtaacgggaccgtaagggtcggaagtaccgtacgaaccgtacggtaaaccgttcgggtacggcgtacgaccctaaccgtactttccgttacgttcctttacctaccttccccgttccccg

SEQ ID NO: 153680 - DNA, 568 bp, Homo sapiens
  misc_feature: GYAE6OF01CB86K.24.59.F04.1.454.CMB.1.raw
  modified_base (177)..(177): a, c, t, g, unknown or other
  misc_feature (177)..(177): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtggganacagagtcaccatctcttgccaggcgagtcagggcattaactatttgtaattggtatcatacaaaacaggacaagggaccctaaactcctaggtacaacgatgcatccaagtcgggtcgccgtacgggtcccttacgaacgggttcaggtcggacgtaggtggactcgtagggacaagtaattcactctacacaatcgacgcgacgacctgaccgagtcctagtattgtacttttggacttaaactttacttactacgtaacctaaactagtatacgtaatcgtaccgtttactcccctaccgttcggaccgacgggaaccacggactaggactagttaacgacgtacgtgtacggctacgaccacctatcttagtccttgtacttacccg

SEQ ID NO: 153681 - DNA, 610 bp, Homo sapiens
  misc_feature: GYAE6OF01C25FA.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgtggagtcgtgggggagccttggttcgggcccgggggtccctggagactctcatgtgcagcctctggattcactatttaactacaatggcatgagttggctccgcaggctcgagggagggctgggagtgggtcgcgtcggttagtgggagtggctacacacattctacgcggctccggtggaacgggccgtattccaccactcctaccaacggtacttttaccaacgtaacacgactagaatcgtaggaaatagaaacagtacgtagaacgagtcgaacgaccgaccggtacccgtttattagttgtcgtaggaaggtacgggttacttagtacgggtaccggtacgtagttactcccgtccgtttcgacgtacggtacgggacgacgggacccgtggtccgtacccgg

SEQ ID NO: 153682 - DNA, 633 bp, Homo sapiens
  misc_feature: GYAE6OF01BZ6C3.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggcgtttttcttagtggctattttaaaaggtgtccagtgtgaggtgaagttgttggagtctgggggagccttggttcggcccggggggtccctgagactctcatgtgcagcctctggattcacatttaactacaatggcatgagttggctccgccaggctccagggagggctggagtgggtcgccgtcggttagtgggagtggctacgaacactattctacgcgggctcccggaggtttaacggggccgtatttccgaaccatcctaccgaacggtaccttttaccgaagtaaccgacgtactagaactcgtaaggaaatacggaaactagtacgtagagtagtacgacgacgaccggtaccctttattagttgttagacgtaaggtacgggttactagtcggtaccggtacgtacgttacgtcccgtcgttacgaacgtaacgtcggggaccgtagggaacccgttggtccgtacccgg

SEQ ID NO: 153683 - DNA, 810 bp, Homo sapiens
  misc_feature: GYAE6OF01BARTM.24.59.F04.1.454.CMB.1.raw
  modified_base (181)..(181): a, c, t, g, unknown or other
  misc_feature (181)..(181): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcgtgcgttttctagtggctatttaaaggngtcagtgtgaggtgaagttgttggagtcgtggggagccttggttcggcccggggggtccctgagactctcatgtgcagcctctggattcactattttaacacaatggcatgagttggctccgcaggctcgagggaggctggagtgggtcgccgtcggttagtgggagtcggctaacgaacacgtattacgacggcgggtccttccggtagggaaacgggtcccgtagtttacccaacccgtagtacctacccgtaacggtaaccgtttttaccgaaacggtaaaccgaacccggtaccgttacggtaaacgttccgtaacgggtaaaagttacggtaaacgtacgttaccgtaggtaacggtaacggttaccggaaaccggtaacccggtaaccggttacccccgtttttaagtttaacgttttacggttacgggtaacccgggttaaaagggttaacggggtttaaaccgttaacgggttaaccggggtttacccggggtaaacccgtttaacgggtttaacccgttacccccgggtttacccgttttacgggtaaccgggttaaacgggttacgggggtaacccccggtaacgggggtaaacccccggtttccgggttaaccccggg

SEQ ID NO: 153684 - DNA, 575 bp, Homo sapiens
  misc_feature: GYAE6OF01BFR33.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtatgaggtgaagttgttggagtctgggggagccttgggttcggcccggggggtccctgagactctcatgtgcagcctctggattcacatttaactacaatggcatgagttggctccgccaggctcgagggagggctggagtgggtcgcgtcggttagtgggagtggctacgaacacattcgtacgcgggctccggtggaacggggccgtatttcacctatcctaccgaaggtacttttaccaacgaacacgactagaactctaggaatgaacagtctgagagtacgacgacgacgtccttattattgtgacgaagtaggttactagtcggtacgacgtacgttactcccgtcgttcgacgagtcgggcacgggacctggtcgtacccg

SEQ ID NO: 153685 - DNA, 586 bp, Homo sapiens
  misc_feature: GYAE6OF01DISKR.24.59.F04.1.454.CMB.1.raw
  modified_base (184)..(184): a, c, t, g, unknown or other
  misc_feature (184)..(184): n is a, c, g, or t
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
tcagactactatgtcacgaccggtgctcgatttagtacacacacttagggattgggggtctgagagaggagcccagccctgggattttcaggtgttttcatttggtgatcaggactgaacagagagaactcaccatggagtttgggctgagcggtgtgtttctaggtcggctaagtttaaaggngtcagtgtgngtgagttgtggagtgtggggntccgttggtccgggccggggtcctgagactctantggcncncgcctgtgtattcacttatttaacgataagtcggctagtgtagttgccaccgcaggcncggagggacgngtggaggtggcgtcgtggtagtcggagtcgactacaanctacttcgacggcggtctacggtgaacgtccgntcaccatcctacacggtaccttacgaacgaacacgtctacgtaagtctaaggatagaactagtcagagtagacgacgaccgtaccgttccttagttatgagtaccgtaagtacggtatacgtcggtaccgtcgtacttccgtaccgtcgttagtacgaacggtcggacggaacgtccgtcgtaccgtccg

SEQ ID NO: 153686 - DNA, 732 bp, Homo sapiens
  misc_feature: GYAE6OF01B9SDT.24.59.F04.1.454.CMB.1.raw
  modified_base (269)..(269): a, c, t, g, unknown or other
  misc_feature (269)..(269): n is a, c, g, or t
  modified_base (462)..(462): a, c, t, g, unknown or other
  misc_feature (462)..(462): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaggtgtccagtgtgaggtgaagttgttggagtcgtgggggagtccgttgggttccggcccggggggtccctggagactctcatgtgcagcctntggattcactactttaactacaatggcagtgagttgctccgcaggctcgaggggaggctggagtgggtcgccgtgggttaggtcgggagtggctacgacactacttcgtacgcgggtcgtccgtaggacgggacgtacgtcctaccgacttaccgtacccgaaacggttaccttttaacccgaaagaaaaccnccggtcgttaacgaacgttaaccgttagggaaaacttcgtaaaaccgtagttacctaggaaccggtaagggtcccgaacggtaaccggtaacccggttacccgtttttatttaaaggttccggtaggaacgtaaaacgggttaagggtttaccgttacgtacggggttaccccggaactttaggttaccgtccccggtttacccgtttaggtaacggaaacgggttccgggggtccctaaacggggaaccccttcgggtcaacccccggg

SEQ ID NO: 153687 - DNA, 586 bp, Homo sapiens
  misc_feature: GYAE6OF01BTMF7.24.59.F04.1.454.CMB.1.raw
  modified_base (180)..(180): a, c, t, g, unknown or other
  misc_feature (180)..(180): n is a, c, g, or t
  modified_base (399)..(399): a, c, t, g, unknown or other
  misc_feature (399)..(399): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacngagtcaccatctcttgccaggcgagtcgagggctattaactactttagtaaattggtatcatacaaaaaccgaggacaagggaccctaaactcctggtacaacgatgcataccaagtcgggtgaccgacgggccccagtcaaggttcagcggcgagtagatcgtaggactagtttcttacacccttcacctacgtcacgccggcctgcacgcctgaggnttgtggacatattattacttagacaactaatatacgtagaattaagtacgttacgtaacgttttcgggaccggtaaggggaacggtacggtagggtaacgacgtaccgtaaaacggtacgttcgggtaggacgtcgacgtaaccgtacttccttacggttaccttcgtaccgttcccgttacccccg

SEQ ID NO: 153688 - DNA, 595 bp, Homo sapiens
  misc_feature: GYAE6OF01BBG29.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattgtatcatacaaaaccaggacaagggaccctaaactcctggtacaacgatgcataccaagtcgggtcgaccgacggggcccccagtacgtaaggttcaggcggacaggtaagatcgtgggactattcttctaccttcaccatcgacgcgcctgcacgcctaggaggagttggtcggactaacgtattaatttacgtagttaccaaactaattagtaggaactaattagttacgttaaccttagttttacggaccggtaaggggaacggtaagggtggataccgtacgaaaaccggttacgtggtacggcttacggacctaaccgtagttaccgttcgttaccttacgtactttccccgtaccccg

SEQ ID NO: 153689 - DNA, 657 bp, Homo sapiens
  misc_feature: GYAE6OF01CHO7N.24.59.F04.1.454.CMB.1.raw
  modified_base (339)..(339): a, c, t, g, unknown or other
  misc_feature (339)..(339): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcgtggtcttttctgtggctattttaaaaggtgtccagtgtgaggtgaagttgttggagtcgtgggggagccttgggttcggcccggggggtccctgagactctcatgtgcagcctctggattcactatttaactacaatggcatgagttggctccgccaggctccgagggagggctggagtgggtcncgttgggtagtgggagtggctacacactattcgtacgcgggctccgtggacggccgtattccacctatcctaccgtaaggtaccttttaccgaacgtaacaaccgtctacgaattacgtaggaaatacgaacagtactagtagacgtacgacgaaccgtaccggtaccctttagttactttggtacgtacggtaaaggtagggttaacgtacggttacgggtaccggtaccgtaaggtttaccgtccccggttaccgtttacggaacgtaaacgggtcggggtacccgaaccggggtaacccgttcgggtaaccccgg

SEQ ID NO: 153690 - DNA, 692 bp, Homo sapiens
  misc_feature: GYAE6OF01DG27G.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagtttgttggagtcgtgggggagtccgttgggttccgggccccggggggtccctggagactctcatgtgcagcctctggattcactattttaacacaatggctatgtagttggctccgccgaggcctcgaggggaagggcgtgggaggtcgggtcgccgttcgggttaggtggggagtcggactaacaacactacttcgtacggcgggcctccggtggaacggggccgattcacctatccgtaccaacggtacctttaccgaaagtaaccacgtactagaactacgtaggtaaatgaaactgtactaggacgaggtccgaacgaaccgtaccggtacccttttagttacgttgtacggtaacggtaaggttacgggtttaaccgttaacggtccgggttaccggtacgtaacgtttaccgttccccggttaccgtttacggaacgtaacgggttcggggaacccgaccggggtaacccgtggtcccgtacccggg

SEQ ID NO: 153691 - DNA, 558 bp, Homo sapiens
  misc_feature: GYAE6OF01E20Y4.24.59.F04.1.454.CMB.1.raw
  modified_base (246)..(246): a, c, t, g, unknown or other
  misc_feature (246)..(246): n is a, c, g, or t
  modified_base (359)..(359): a, c, t, g, unknown or other
  misc_feature (359)..(359): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattgtatcatacaaaacnggcaagggcctaaactctgtcaacgatgcatcaatcggtgccgacggggccccatcaaggttcagcggcagtagatcgtgggactattcttcaccttcaccatcaggccgccngcagcctgagatgttggcactagtattactgttaccaaactaatagtgaacgattagtagtactacgtttttacgggaccgtagggggtaacgaaggggtggtaaggcttaaaccgaaaacgtaaacggtcggttagggccgttagaccgaaccctaagttcgtacgtttcctttaccgttcttcccgtttacccccgg

SEQ ID NO: 153692 - DNA, 601 bp, Homo sapiens
  misc_feature: GYAE6OF01BXMAN.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctggggagccgttggttcggcccggggggtccctgagactctcatgtgcagcctctggattcacatttaactacaatggcatgagttggctccgccaggctccaggggaagggctgggagtgggtcgcgtcggttagtgggagtggctacgaacacattcgtacgcgggctcggtgaacgggccgatcaccatctaccaaggtacttttaccaagaacacgctagaactactaggaatgaacagtctgagacgtcgacgacgacggtccctttaattacgttgtgtacgaaggtaggttacgttagtcgggtacccggtacgtacgttacgtccccggtcgtttacgacgttaacggtcggggacccaacgggtacccgtggtcgtaccccg

SEQ ID NO: 153693 - DNA, 580 bp, Homo sapiens
  misc_feature: GYAE6OF01DR68P.24.59.F04.1.454.CMB.1.raw
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (235)..(236): a, c, t, g, unknown or other
  misc_feature (235)..(236): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
tcagactactatgtcacgaccggtgctcgatttagtacacacacttagggattggggtctgagagaggagcccagccctgggatttcaggtgtttcatttggtgatcaggactgaacagagagaactcacatggagtttgggctgagcggtcgtgttctaggtcggctaatttaaaggntcagtgtgagtgtagtgtggctgtggggntcgtggtcggccggggtctganctctnntgcncncgctctgtntctactatactatagtgntgtgtgtcgcgcgcgcgcgtcggaggaggcgtggtggtcggtcgtcgtcggtaggtggtgtgtactacacactacgtcgtcgtcgtcgtcgtacgtacgcgtctactactactacgtacgtacgtactactaacgacgtacgtacgtagtacgtacgtagtaagtacgtacgtagtacgtagacgtacgacgtacgtacgtacgtacgttagttagtagtagtacgtacggtaggtacgtacgtacgtacgtacgtcgtacgtacgtcgtacgtacggacggtacggtacggtacggtacgtcgtcgtccg

SEQ ID NO: 153694 - DNA, 661 bp, Homo sapiens
  misc_feature: GYAE6OF01ENH76.24.59.F04.1.454.CMB.1.raw
tcagactactatgtcacgaccggtgctcgatttagtacacacacttagggattggggtctgagagaggagcccagccctgggattttcaggtgtttcatttggtgatcaggactgaacagagagaactcaccatggagtttgggctgagctggtctttttcttgtggcttattttaaaaggtgtccagtgtgaggtgaagttgttggagtctgggggagccgttggttcggcccggggggtcctgagactctcatgtgcagcctcgtggattcactatttaactacaatggcatgagttgctccgccaggctccgaaggggacgggcgtagggaggtgggtcgccgttcgggttaggtgggagtcggctaacaacacattcgacgcgggcctccggtaggaacggggtcccgatttccaaccacgttcctaccgaacggtaccttttacccgaaacgaacctaacggtactacgtaacgtcgtaaggtaaagtagtaacagtacgtaggtacgtacgtacgaacgtacgtaccggtaccgtttattagttgtacgacggtaaggtacgggttagtacgttcggtaccggtacgtacgttacttcccggtccttacggtacgtaaggtcggggaccgaacgggacccgtggtccgtacccgg

SEQ ID NO: 153695 - DNA, 650 bp, Homo sapiens
  misc_feature: GYAE6OF01BZF6V.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccgttgggttccgggcccggggggtccctggagactctcatgtgcagcctctggattcactatttaactacatggcatgagttggcctccgcaggctccgaggggagggcgtggaggtgggtcgccgtcggttaggtgggagtggctaacactactattcgacggcgggctccggtaggaacgggccgtattcacctatcctaccaacggtaccttttaccaacgaacacgtctagtaactcgtaggtaagtagaactagtcgtagagacgtaccgacgaccgaccggttaccctttactttagttggtacgtacggtaaggtaaggttacgtagttcgggtaccggacgttacgttacgttcccgttccgtttacggaacggtacggtacggggtaccgaaccggggtaacccgtcgggtcccgtacccgg

SEQ ID NO: 153696 - DNA, 842 bp, Homo sapiens
  misc_feature: GYAE6OF01A2BDS.24.59.F04.1.454.CMB.1.raw
  modified_base (274)..(274): a, c, t, g, unknown or other
  misc_feature (274)..(274): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggtagtttgggctggagcgtggtctttttcttggtggcttaattttaaaaggtgtccagtgtgaggtgtagttgtggagtcgtggggatcgttggtcgggcccgggggtcctgagactctcatgtgcagcctcgtggtnttcactaatttaactaacaagtggactagtagtggttcggcctccgccgaggtccgtacccggaaggggtaacggggtccgtaggggtacggttcggggtcctccggtttagggttacgggtggggtacggttcgggtacctaaccgaaacgacgttaatttacccggacgggtccgggtccctacgggtacggaaaccggggcccgttagtaccccgtacccgtacgttacccgtaaccgtaacggttaacccgttttaaccgaaacgtaacccgtaccgtacttaacggaacgttacgtaaacggtaacgtaacggtaaaccgtacgtaacgttaccggaaggtaccggtaaccggtaaccgacccggttaacccgttttacccgtttacttttaacggttcggttaacggtaaccggtaaacgggttaacgggtttaacgttacgggtaccgggttacccggtaacgttacgggttacccgttaccccggttacgtttaacggaccggtaaggttaccggggtacccgggaagggtttaacccccggtcggttacccgtacccgg

SEQ ID NO: 153697 - DNA, 859 bp, Homo sapiens
  misc_feature: GYAE6OF01EOYQM.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcgtgtcgttttctaggtgctaattttaaaggtgtcagtgtgaggtgaagttgtggagtcgtggggagtccgttgggttccgggcccggggggtccctggacgtactctctagtggtgcacgcctcgtaggtactttccaactaattttaaacctacaaagtggctagttggagtttcggcctacccgccgacggccttaccggaaggggaacgggggtccgtaggggagggtcgggtaccgtccgtttacggggttaggtcggggtagtcggtactaacgaacgactagtttccgacggtcgggtcctaccggtgggaacgggtccgtaacttcgaacccgtagttaccctaccgtaaacggttacccgttttaaccaaacgtaaccgaccgtacgtaacgtaacgttaccgtaggtaaacgtacggtaaacgtacggttacgttacggtaacggtacggttacggaaaccggtaacccggttaaacccgggtttacccccgtttttaagttttacggtttacggttaacgggtaacgggttaaaaacgggttacgggtttaaacgttaccgggttacgggtacccgggttaaccgtttaacggtttaccgttacccccggtttaccggtttaaccggaaccgggttaacgggtaccgggggtaaccccgggtaacccggggtaacccggttccgggtaacccccgg

SEQ ID NO: 153698 - DNA, 968 bp, Homo sapiens
  misc_feature: GYAE6OF01DI17F.24.59.F04.1.454.CMB.1.raw
tcagactactatgtcacgaccggtgctcgatttagtacacacacttagggattggggtctgagagaggagcccagccctgggtattttcaggttgttttcatttggtgatcaggactgaacagagagaactcaccatggagtttgggctgagctggtctttttcttgtggcttaagttttaaaaggtgtccagtgtgaggtgtaagttgtggagtcgtgggggagtccgtttgggttccgggccccggggggtcctggacgactctcatggtgcacgccttcgtggtactttccaacttaatttttaaaccaacgtaaaagttcgggacctaagttacgggtaaggtttcgggacccttcccggaccccgaacgggtccgttaacccgggaagggggaaacgggggtccttagggggtacgggtttcgggggtcccgtaccggtttaccggggtttaagggtgggggtaacggtccgggtaacctaaaacccgtaaactaaccgttaacgttttaccggaacccggggtccggggttcccgttacccgggtaagggaaacccggggtcccttaaaccgtttacccgaacccctagtttaccccgtaaccggtaaacggtttaacccttttaaccgaaaacgtaaacccgacgtacgttaacgtaacgttacgtaaaggaaacttacggaaacgtacgttacgtacgaacggtaacgtaccgggaacgtaacccggtaaccggtttacccctttttaagttttaacgttacggttacggtaaaccgggttaaaagggtaaccgggttttaaaccgtaacgggttaccgggttaacccgggtaaccgtttaaacgttacccgttacccccggtttaccgtttaacgggtaaccgggttaaaccgggtaccggggggtaaccccgtaacccggggtaaccccggtttacgggtccccggttaacccccggg

SEQ ID NO: 153699 - DNA, 670 bp, Homo sapiens
  misc_feature: GYAE6OF01CDUN1.24.59.F04.1.454.CMB.1.raw
  modified_base (218)..(218): a, c, t, g, unknown or other
  misc_feature (218)..(218): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtcgtggggganccgttggttcggcccggggggtccctgagactctcatgtgcagcctctggattcactatttaacacaatggcatgagttggctccgcaggctcgagggaggggctggaggtgggcgcgtcgggttaggtgggagtgggctaacgaacactattcgacggcgggctccggtaggaacgggcattcaccatcctaccaaggtaccttttaccgaagaaccacgactagtaactcgtaggaaatgaaactagtacgagaggtacgtaccggaacgtaccgaccggttaccctttaagttacgttggtaggtaacggtaaagggtaggggtttaaccttagggttcgggttacccgggtaacgtacggtttacctacccccggttcgtttacggaaccggttaacggttcgggggacccgtaacggggtaaccccgttcgggtaccgtaaccccgg

SEQ ID NO: 153700 - DNA, 807 bp, Homo sapiens
  misc_feature: GYAE6OF01CL8MW.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctaattttaaaaggtgtccagtgtgaggtgaagttgttggagtcgtggggagtccgttgggttccgggcccgggggtccctgagactctcatgtgcagcctctggattcactatttaacacaatggcatgagttcggctccgccgaggctccgaggggaacggggctgggaggtcgggtcgtccgttcgggttaggtggggaggtcggactaaccgaacacgtacttccgtacggcgggtcctccggtaggaacgggtccgtattccgaccacgtcctacccgtaaggttaccttttaaccgaacggaaccgtaccgtaccgtaagtaaacgttaccgttaaaggtaaacttacggaaaccgttaggttaccgtagggtaacggtaacggttaccggaacccggtaaccgttaacccgggttacccccttttttaaagtttacggtttacggttacgggtaaaccgggtaaaagggttaaacgggttttaaccgttaagggttaccggggttacccgggtaaacgttaaccggttttaccgttacccccggttaccggttttacgggaaacggttaacgggttaccgggggtaacccgtaaccggggtaaaccccgttggggtaccccgttaaccccgg

SEQ ID NO: 153701 - DNA, 621 bp, Homo sapiens
  misc_feature: GYAE6OF01ETWXR.24.59.F04.1.454.CMB.1.raw
tcagactactatgtcacgaccggtgctcgatttagtacacacacttagggattgggggctctgagagaggagcccagcccctgggatttttcaggtgttttcatttggtgatcaggactgaacagagagaactcaccatggagtttgggctgagctggctttttcttgtggctattttaaaaggtgtccagtgtgaggtgaagttgttggagtcgtggggggagtccttgggttccggcccgggggggtccctggagactctcatgtgcagcctctggattcactatttaacacaatggcatgagtgctccgcaggctccgaggggagggctggaggtgggtcgcgtcgggttagtgggagtggctacgaacacgattcgacgcgggtcctccggtgaaacggggcctattccacctatcctacctaaggtaccttttaccaagaacacgctagaactctaggaaatgaaacagtctagagtagtacgaacgacgaccggtacccttttaagttacgttgtgaacgtaaaggtacggttacgtagtacgggtcggaacctaggttactcccggtactttagaacgtaggtcggggaccgacgggaacccgttggtaccccg

SEQ ID NO: 153702 - DNA, 751 bp, Homo sapiens
  misc_feature: GYAE6OF01DUI4X.24.59.F04.1.454.CMB.1.raw
  modified_base (192)..(192): a, c, t, g, unknown or other
  misc_feature (192)..(192): n is a, c, g, or t
  modified_base (308)..(308): a, c, t, g, unknown or other
  misc_feature (308)..(308): n is a, c, g, or t
tcagactactatgtcacgaccggtgctcgatttagtacacacacttagggattggggtctgagagaggagcccagccctgggattttcaggttgttttcatttggtgatcaggactgaacagagagaactcaccatggtagtttgggctgagcgtggttctttttcttggtggtcttaatttttaaaaggtntcagtgtgaggtgagttgtggagtgtggggatccgggggggttgttccgggccccgggggtcctgagactctcatgtgcagcctcgtgacttcactaatttaaccaactaagtcgntagtgtagttcgccgtccgcgaggccgtacggaggggaagggtcgtgggagttcgggtccgtccgttagggttaggtgggaagtcggactaacgaacacgtaacgttacgtaccggccgggtcgtaccgggtaaggaacggggccctaaatttcccgaaactacttacccgtaaccgtaaacggttaaccttttaccgaaaagtaaccgaacgtactagtaaattacgtaacggaaagtacgtaaactagtacgtaggtaacgtacgtaaccggaacgtaaaccgtaccggtttacccttttaagtttagtttacggtaacgtaacggtaaggtaaggtttaaacctaggtacggtaccggtaacgtacgttacgttcccgtacgttacgtaacggtaacggttcgggaacccgacgggttaacccgtcgtaccgtaaccccg

SEQ ID NO: 153703 - DNA, 704 bp, Homo sapiens
  misc_feature: GYAE6OF01CEZYF.24.59.F04.1.454.CMB.1.raw
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagactactatgtcacgaccggtgctcgatttagtacacacacttagggattgggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagccgttgggttccgggcccggggggtccctggagactctcatgtcgcagcctctggattcactatttaacacaatggctagtgtagttggcctccgccaggcctcgagggacgggcgtggagtgggtcgccgtggttaggngggngtggctacaacactattcgtacggcggtctcggtaggaacgggccgtattccgaacctagttcctaccgtaacggttaccttttaaccgaaacgtaacgtaaccgacttacggtaatccgtaggtaaactacgtaaacgagtcctaggacggtaacgtaccgggacgtaaccgtaaccgggttccccttttaagtttaacgtttggtacggtaacggtaaaggttaacgggtttaacgtacgttcggggtaccggacttacggttaccgtccccgttcgtttacggaccggtaacggtcggggacccgaacgggttaacccgtgggttcccgtaacccgg

SEQ ID NO: 153704 - DNA, 767 bp, Homo sapiens
  misc_feature: GYAE6OF01AVWI8.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatccctccctgtctgcatctggtgggagacagacgtcaccatcttcttcgccgaggcgagtcgagggctaatttaacttactttagttaaagttggtatacaataaccaaaaaccgaggacgaacgggtacccttaactccgtaggtacaacgatacgactactaccgtaaggtccgggtcgacccggacgggaccccagtacgtaacggtcgacggcgacgaggtagtacgtacgtacgggtacttactttccgttacctaaccttaccgtaaccctacgtaccggtaaccggtcccgggtaccgttaccggaccgtaccggtccggttaagggacgggttacgtttacgggttaacggttaacttaatttaacgtttacctacggttaaacaaccgtaagttacgtaaggtaactaattacggttacgttaacccgtttacggtttacggggaaccggtaaacgggggtaacgggttaaggggtaccggtacggaacccttaaacgggtaaaaccgtacggttacgggtaccggtctaacccgggaccttaacccgttaggtttccgttaccggtttcccttaacctttccccgttcccgttcccccgtaacgg

SEQ ID NO: 153705 - DNA, 673 bp, Homo sapiens
  misc_feature: GYAE6OF01AWWSQ.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgtcgttttcttaggtggctaattttaaaaggtgtcagtgtgaggtgaagttgtggagtcgtgggggagccgttggttcggcccgggggtccctgacgactcgtcatgtgcagcctcgtggacttcactactttaactacaatggactaagtggagttggcctccgccgaggctaccggaggggacgggtcgtgggaggtgggtccggaccgttcgggttaagggtgggtaggtgggactacgaaacacctattttccgaacgggccgggtcctcgggtcggaacggggtcccgtattccgactacgtcctacaggtacctttaccaagtaacacgcgtaagtactacgtacggaatagaactagtacgtagtagacggtaccggtaacgaccgtaccggtaccttttattagtttacgtaggtacgtaaacggtaggttaactaggtcggtaccggtagtacgttaccgtcgtcttagaacggtacggtcgggaccgtacggacccgttcgtcgtacccg

SEQ ID NO: 153706 - DNA, 610 bp, Homo sapiens
  misc_feature: GYAE6OF01BVEVJ.24.59.F04.1.454.CMB.1.raw
  modified_base (371)..(371): a, c, t, g, unknown or other
  misc_feature (371)..(371): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtctttttctggtggcttaattttaaaaggtgtccagtgtgaggtgaagttgttggagtcgtgggggatccgttgggttccgggcccgggggtcctgagactctcatgtgcagcctcgtggattcactatttaactacaatggcatgagttgctccgcaggctcgaggggagggctggagtgggtcgccgttcggttaggtgggagtggctacgaanctattccgacggcggctcggtgagggccattcaccntctacagtactttacagacncgctgatgtagaatgaacagtctgagacgtaccgcgaaccgtaccggtaccctttaattcgtttaggtgacggtaaggtaggtttaacgtacgtcgggtaccggtacgtacggtttaccgtcccgttcgtttacgacggtacggtacggggacccgtaacgggtaccctgggtccgtacccgg

SEQ ID NO: 153707 - DNA, 643 bp, Homo sapiens
  misc_feature: GYAE6OF01CULPV.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtgggagacagagtcaccatctcttgccaggcgagtcagggcattaactactttagtaattggtatcatacaaaaccaggacaacgggaccctaaactcctaggtcaacgatgcatccaagtcggtgccgacggggccccagtaccgtaaggttcaggccggacaggtagatcgtggggacctagttcttccaccttcacctatccgagtcggaccttgaccgacgtccgtaggaggtacgttggttggacctaacgtagttaatttacctagttaccaaaccgtaattaacgtacgaaccgtagttaacgttagttacgttaacgttttcgggaaccggtaagggggtaaccggtaagggtagggaacgtaccgtaaccgtaaacggtacgttagggttacggtcgtacggaccctaaccgtacgttcgttaccgtttaccgtttacctaaccgtttcccgttaccccccg

SEQ ID NO: 153708 - DNA, 665 bp, Homo sapiens
  misc_feature: GYAE6OF01ACF2M.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttggggctgagctggctttttcttgtggctattttaaaaggtgtccagtgtgaggtgaagttgttggagtcgtgggggagccgttgggttccgggcccggggggtccctggagactctcatgtgcagcctctggattcactatttaacacatggcatgagttggctccgcgaggcctccgaggggacgggcgtgggaggtcgggtcgtcccgtcgggtttaggtggggagtgggcctaacaacacacttccgtacggcgggtcctcggtggaacggggccgtacttccacctacttccgtaccgtaacggtacctttaccaacgtaaccacgctagaatcgtagtaatagaactagtctagagacgtcggacgaaccgtaccggtaccttttaattacgttgtagtacggtaaaggtacgggttacgttaggtcggtaccgggtacgtacggtttaccgtccccgttaccgtttaggaaccggtaacggtcggggacccgacggggtacccgtcggtacccgg

SEQ ID NO: 153709 - DNA, 778 bp, Homo sapiens
  misc_feature: GYAE6OF01B2JP8.24.59.F04.1.454.CMB.1.raw
  modified_base (277)..(277): a, c, t, g, unknown or other
  misc_feature (277)..(277): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagtccgtttgggttccgggcccgggggggttccctggagtactcgtcactgtgcagcctntggattcactatttaacacaatggcatgagttgctccgcaggctcgagggacggcgtggagtgggtcgccgttcgggttagtggggtagtgggactacaacactagttcgacggcgggcctccggtaggaacgggccgtaattccaacctctacctaccgtaaacggttaccttttacccgaaaggtaacctaccggtactacggtaaattaccggtaaggaaaacgttacgtaaaccgtacggttacgtaggaaggtacggttacccggaaccggtaaccgtaacccgggttaacccctttttaagttaacgtttcgggtacggtaacgggtaaaagggttacgggtttaaccgtaacggtttacggggtaccccggtaaacggtacgttttaacccgtacccccggtttacccgttttaacggaaacccggttaacgggtaccgggggtaacccgtaaaccgggggtaaccccgttccggggtacccgttaaccccggg

SEQ ID NO: 153710 - DNA, 760 bp, Homo sapiens
  misc_feature: GYAE6OF01EVVXR.24.59.F04.1.454.CMB.1.raw
  modified_base (616)..(616): a, c, t, g, unknown or other
  misc_feature (616)..(616): n is a, c, g, or t
  modified_base (730)..(730): a, c, t, g, unknown or other
  misc_feature (730)..(730): n is a, c, g, or t
  modified_base (750)..(750): a, c, t, g, unknown or other
  misc_feature (750)..(750): n is a, c, g, or t
tcagactactatgtcacgaccggtgctcgatttagtacacacacttagggattggggtctgagagaggagcccagccctgggattttcaggttgttttcatttggtgatcaggactgaacagagagaactcaccatggagtttgggctgagcgtgtcgttttctaggtcgtctaagttttaaaggtgtcagtgtgagtgagttgttggagtcgtggggatccgttggtccggcccgggggtcctggacgctctctatgtgcacgtcctcgtaggtactttacaactttaatttaaaccgaacgtaagttccggactagtggtagttcggcctcccggacgaacggcctaccgggaacggggggtaacggccggtttagggacggttccggggtcctccggtttagggttaacggtcggggaggttccggacctaacggaaccacgttacgttccgtaccgggtcgggtcccgttacggtaagggtaaccggtacccgtatttaaccccggacctaaccgtttcccgtaacccgggtaaactttaccccgttttaaccgaaaaccggtaccgtaacggttacacgttaacgtaccgttaagaacgtacgtaaaccgngttacgaggtcgaacgtcgaaccgtcgtaaccgttcctttagtagtacgtagaacgttaagggtcttaaggtacgtccggtactagttacggtaacctcggttactagaacggnggtccggagtaacccgtcgngccctacccg

SEQ ID NO: 153711 - DNA, 646 bp, Homo sapiens
  misc_feature: GYAE6OF01C8QO0.24.59.F04.1.454.CMB.1.raw
  modified_base (304)..(304): a, c, t, g, unknown or other
  misc_feature (304)..(304): n is a, c, g, or t
tcagactactatgtcacgaccggtgctcgatttagtacacacacttagggattgggcaaagcgtggacatgagggtccctgctcagctcctgggcctcctgctgctctggctctcaggtgcatatgtgacatccagatcgacccagtcctccatccctccctgtctgcatctggtgggagacagagtcaccatctctcgccaggcgagtcgagggactaattaacttactttagtaaagttggtatacataaccgaaaaaccgaggacgaacgggtaccctaaactccgtacggtacaaccggntcgacactaccaaggtccgggtcgaccgaccggggcccatacgtaaggtacgacgaccggcagtagtgtacgtacgggactactttaccttccgtaccttacgaccctagttccgacggtccggtcctcgcgacgccgttagggaaggtatcggtggacaactaattacgttaccttagtacctaactaagttatacgtaacgaattacttagtaccgttacgtttcgggacggaacggggaggtaaggaggtacgtacgtaaccgaaacgtagtacggtcggtacgtacgacccgtaacgtcttacgttacgtacttaccctacctcccgttacccgtacc

SEQ ID NO: 153712 - DNA, 954 bp, Homo sapiens
  misc_feature: GYAE6OF01ARGHJ.24.59.F04.1.454.CMB.1.raw
  modified_base (177)..(177): a, c, t, g, unknown or other
  misc_feature (177)..(177): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtggganacagagtcaccattcctcgttcggcccgggccagtcagtagttgtttctgccgtggggtcggccgtggtatcgacgacaacggaaaaccgaacggggaaaccgtaccccttaaacttcccgtagtaacttaccgttaagttaacgggtccgtttacctttaacgtttttaaaccggaaaacgggtttccgggggtttacccctttacggtaacgggtttaccgaagggtccgggtacgtagggttacgggtaacgttaccggtacgggggaaactaacgggttaaaccttttaccaacctttaccctaaccgaaacctaaacgtttacccgaacggtacccgtaaccggtccccgttacggaccgtaacggttccccgtttaggttaactttacggggttttaaacttttttaccgggtaaacctttaaaacccgttttttaacgtttaaccccgttaccggtaaaccccgttaaaacgtttaagggtttaaccgtttaagggttaactttacccgggtttaaccctttttaaaccccgtttaacccccccggtttaaccccgggttttacccccggggggaaaccccgggtaaaccggggggtaacccctaacccggggttaaccggttaccggggttaaaacccttaaacgtttaaaccggttaacccgggtttaaacgttcgggttaaccggtccgttaaccggtacccctaaccgtttcgtttacccgttacgtttacccctttaccttaaccccgtttccccgttacccccg

SEQ ID NO: 153713 - DNA, 830 bp, Homo sapiens
  misc_feature: GYAE6OF01C9DHC.24.59.F04.1.454.CMB.1.raw
  modified_base (217)..(217): a, c, t, g, unknown or other
  misc_feature (217)..(217): n is a, c, g, or t
  modified_base (256)..(256): a, c, t, g, unknown or other
  misc_feature (256)..(256): n is a, c, g, or t
  modified_base (383)..(383): a, c, t, g, unknown or other
  misc_feature (383)..(383): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttggctgagctggtctttttcttgtggcttaattttaaaggtgtccagtgtgaggtgagttgtgagtcgtggggngccttggtcggcccgggggtcctgagactctcatgtgcngcctctggtattcactaactttaaactaactaagtggcagtggtagttcggccttccgccgacggccgtaccggaaggggaacggggcgtgggtagggtcggggtccgtcccggttacgggttaggnggggtaggtggacctaacaaactctaacgttcgaaccggcgggcgtccggtaggacgggtccgtaagtttcccaaccgtacttccgtaacccgtaaacggttacccttttaacccgaaacggtaacccgtaaaccgccgttaaacgtaaacgttaccggttaagggtaaaacgtacggtaaaccgtacgggttaccgttagggaacggtaacgggttaaccggaaaccgggtaacccgtaaccccggggtttacccctttttaagttttaaccggttggtttaaccggaacggtaaaacgggttaacgggtttaaacgttacgggttcgggtaccgggtaaaccgttaacgttttacccggtcccccgttacccgttttaacggaaaccggtaacgggtacccgggggtacccgtaaaccggggtaccccggttcgggtaaccccgg

SEQ ID NO: 153714 - DNA, 707 bp, Homo sapiens
  misc_feature: GYAE6OF01C9KF8.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtgggagacagagtcaccatctctgccaggcgagtcgagggactattaactatttagtaaattggtatcaataacaaaaacagaacgaacggacctaaacgtcctaggtacaaacggatacgactactaccgaaacgtccgggtacggacccggaaccggggaccccctaagtaccgtaaacgggttaccgaagggaccggacgtaacggtaacgacgtacgtacgggtaactactttaccttacctacctttaccaactactacgacggtcggtacctcgacgaacgtccggtaggtaacggtagtttacggttacggactaaccttaagttaacgtttaacggtacttaaaccaaaactaagttagtaacgtaagtaattacggttaacgttacggttaccgttttacgggaacccgggtaagggggaacgtaacggggtcggtaacgtaccgtaaccggaaaaacggtaccgtgggttacgacttacggacctacgttactccggttataccttactacgtcccgttaacccg

SEQ ID NO: 153715 - DNA, 561 bp, Homo sapiens
  misc_feature: GYAE6OF01A3Z0Y.24.59.F04.1.454.CMB.1.raw
  modified_base (155)..(155): a, c, t, g, unknown or other
  misc_feature (155)..(155): n is a, c, g, or t
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (183)..(184): a, c, t, g, unknown or other
  misc_feature (183)..(184): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (195)..(197): a, c, t, g, unknown or other
  misc_feature (195)..(197): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (229)..(230): a, c, t, g, unknown or other
  misc_feature (229)..(230): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (402)..(402): a, c, t, g, unknown or other
  misc_feature (402)..(402): n is a, c, g, or t
  modified_base (486)..(486): a, c, t, g, unknown or other
  misc_feature (486)..(486): n is a, c, g, or t
tcagactactatgtcacgaccggtgctcgatttagtacacacacttagggattgggggtctgagagaggagcccagccctgggattttcaggtgttttcatttggtgatcaggactgaacagagagaactcaccatggagtttgggctgagcggngtgttctaggcgctatttaaagntcngnngagtnatntgnnngggnctgtgccgggcngantcnatntncagcnngntnacattaacanatgcatgagtgctccncagctcgaggaggctggnggtggctcgtggttagaggancggcacaacacatttacacggcgggccttacggagaacgggccctattaccacctatctacccgaaggttacctttacaaacggaacaacgcgttacgaactnttacggaaatcggaacctagtcgtagagagtacgacgacgtaccgtaccttttatacggttgacgtaaggaaagtacggtttanacggtcgtacgacttcggtacctccgtcttagaacgtacggtaccgggacggaacggtacccgttgaccctcccg

SEQ ID NO: 153716 - DNA, 630 bp, Homo sapiens
  misc_feature: GYAE6OF01C5CVO.24.59.F04.1.454.CMB.1.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (381)..(381): a, c, t, g, unknown or other
  misc_feature (381)..(381): n is a, c, g, or t
  modified_base (422)..(422): a, c, t, g, unknown or other
  misc_feature (422)..(422): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (551)..(551): a, c, t, g, unknown or other
  misc_feature (551)..(551): n is a, c, g, or t
  modified_base (580)..(580): a, c, t, g, unknown or other
  misc_feature (580)..(580): n is a, c, g, or t
tcagactactatgtcacgaccggtgctcgatttagtacacacacttagggattggggtctgagagaggagcccagccctgggattttcaggttgttttctatttggtgatcaggactgaacagagagaactcaccagtggaggtttgggctgagcgtcggttcgttttctggtcggacttaagttttaaaaggtgtcagtgtgaggtgtaagttgtggngtgtggggngtcgttggtccgggtcccggggtcctgagactctcagtgtcgcncgcctgtggacttaccaatatttaacaacgaatggntatgtcgtgcctcgccaggctacggagggaggtctgggagtcggtcgcgtggtaggtggagtgactacaactntattcgacggcggtctcgggtagacgggtctataccgactntacgactacggtacctttacgaacgaacncgtntaagatcgtaaggaaactagaacacgttgagtaagtcgacgaccgaacgtaccggttcctttaaagttgttacaggaacggtaaggttacggttanacgttaccgggacgttacgtacgttaccnccgtcgttaggacgtaggtcggggacaacgggttcctgggtccctaccgg

SEQ ID NO: 153717 - DNA, 642 bp, Homo sapiens
  misc_feature: GYAE6OF01BUCH6.24.59.F04.1.454.CMB.1.raw
  modified_base (180)..(180): a, c, t, g, unknown or other
  misc_feature (180)..(180): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtgttctaggtggctaatttaaaggntcagtgtgaggtgagttgtggagtgtggggatcgttggtcggccgggggtcctgagctctnatgngcagcctgngtattcactaatttaacacgtaatggtcagtgtagttcggctaccgccaggcctaccggagggggaagggcgtagggtagggttcggggtccgtacccgttaggggttaggtcggggaagttcgggaccttaaacgacgactattacggtaccggcggggtccttaccggaggacgggccgtattccaccatacctacgaacgtactttaacccgaagaacaacgctagaactcgtagaagtcgaaactgtactaggagacggtccgaacgaccgacgttaccctttagttagtgttccgaagtaaggtacggttaactgtcggtaccggtatggttacctcgtcgttagaaccgttaggtcgggtacgaggaccgtcgtacgtcccg

SEQ ID NO: 153718 - DNA, 841 bp, Homo sapiens
  misc_feature: GYAE6OF01DZ4MG.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggtcttaattttaaaaggtcgtaccagtgtgaggtgtaagttggtggagtcggtggggacgtccgttgggttccgggcccgggggtccctgacgctctcatgtgcacgcctctggtacttacaactaactttaaactactaatggacatcggagtttcggcctcccgacgacggtccgtacgggacggggaaggggtcgtagggtacgggttcgggtcccgtcggtttacgggttaggtaggggacgttaggacctaaccgaactaaccgttacgttcggtaccggtccgggtccgttccgggtaaggtaaccggggacccgttacttacccgtaacccgtaacttacccgtaccgtaaaaccggtttacccttttaaacccgaaacggtaaacccgtaaccggtaccttaacgggtaaacttaacccggtaaggtaaaaccgttacggaaaaccgtcggttacctaagggtaaccggtaacggtaacccggtaacgtaacccgggttaacccgttacccgtttttaaagttacgttacgggtaaggttacggtaaaacggtacgggtttaactacggttcgggtaaccgtacgttacgtttacctcccggtcgttaacggaccgtaacgggtccggggaaccctaaggggttaccccgtcggtacccgtacccg

SEQ ID NO: 153719 - DNA, 754 bp, Homo sapiens
  misc_feature: GYAE6OF01DYMDF.24.59.F04.1.454.CMB.1.raw
  modified_base (178)..(178): a, c, t, g, unknown or other
  misc_feature (178)..(178): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtggganacagagtcaccatctcttgccaggcgagtcgagggactaattaacttactttagtaaagtttggtatcaataacaaaaacgaggacgaacgggtaccctaaacttccgtcggtacaacgtatgacaactaccaacggtccggggtcggaccggaccggggacccctaagtaccgtaacggttcgacggcggacgtaaggtaagacgtacggtacggggtaacttactttaccgtttacctaacccttaccctaaccgtactacggaccggtccgggtccgtacggaccgacggtaccgtacgggtaggttacggttaggttccggtaacgtacttaacgtttaacttaccgttacgtaaactaaactaaacgtttaatacgggtaactaagttaacgttacgttaaccgttacgttttacggggaccgggtaagggggaacggtacgggtaggtaccgtacgtaaaccggtaaaaccggtacggttacggtacgggttacgtacgtaccccgtaacttacccgtttacggtttacgtttacccgtttacgttcccgttccccggtttaaccccccg

SEQ ID NO: 153720 - DNA, 737 bp, Homo sapiens
  misc_feature: GYAE6OF01BOO4M.24.59.F04.1.454.CMB.1.raw
  modified_base (185)..(185): a, c, t, g, unknown or other
  misc_feature (185)..(185): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtctttttctgtggcttaattttaaaaggtntccagtgtgaggtgaagttgtggagtcgtggggatccgttgggttccggcccgggggtcctgacgactctcatgtgcngcctcgtgnttcactatttaactacaatggacagtgagttcgcgtccgccaggccgtaccggaggggacgggtcgtgggaggtgggtccgccgttgggttaggtggggtaagtcggtactaaccgaactactacgttacccgtacggccgggtccgtaccggtaggaaccggggtcctactttacccgacccgttacttcccgtaacccgtaaacgttacccgttttaaccgaacgtaaccgtacgtaccgtaagtaacgtacgtaacggtaatacgtaacgtagtacgtagtaacggtacgtaccgacgtaaccgtacccggttaccttttaacgttagtttacggtacgtaacgtaacggttacggttaacgttacggtacggttaccggtacgtaccggttaccgtcccgttcgttacgtaacggtacggtcgggtaccgtaacgggtacccgttcgggtcccgtacccgg

SEQ ID NO: 153721 - DNA, 854 bp, Homo sapiens
  misc_feature: GYAE6OF01ECZTI.24.59.F04.1.454.CMB.1.raw
tcagactactatgtcacgaccggtgctcgatttagtacacacacttagggattggggtctgagagaggagcccagccctgggattttcaggttgttttcatttggtgatcaggactgaacagagagaactcaccagtggtagtttgggctgagctggttcttttcttgtggtacttaagttttaaaaggtgtcctagtgtgaggtgtaagttgtggtagtcggtggggagtccggttcgggttccggggccccgggggtcctggacgtactctcagttgtcgctcggtcctgtggtacttactaacttaacttaactaacgtagtgactagtcggtacgttcggccgtcccggaccgtacggtccggtaccgggaagggggtacggggtcgtacggggtcggttcgggttcccggttacggttacgggttagggtacgggtacggtaccggtaaccgtaaccgtaaccgtacgttaccgttaccgggtaccgggtccgggtacccggttaccgggtaacggtaaccgggtaccgtacgttaacccaccgtaccgttacccgtaaccgtaaccgtttaacccgttaaccgaacgtaaccgtaccgtacgtaacgtaacgtaacggtaaaggtaacgtaacggtaacgtacgtacgtaacggaacggtaacggtacccggtaaccgtaccgttaacccggtttactttaagttacggttacggttaggaacggtaaggttacggttaacgtcggttaccggtaccggtaccgttaccggttacccgttacccgttacgttacggtacggtaccgggtacgggtaccggtaaccggtacccgtccgtcccgtacccg

SEQ ID NO: 153722 - DNA, 930 bp, Homo sapiens
  misc_feature: GYAE6OF01BA4RS.24.59.F04.1.454.CMB.1.raw
  modified_base (229)..(229): a, c, t, g, unknown or other
  misc_feature (229)..(229): n is a, c, g, or t
tcagactactatgtcacgaccggtgctcgatttagtacacacacttagggagttggggtctgagagaggagcccagccctgggattttcaggtgtttcatttggtgatcaggactgaacagagagaactcaccagtggagtttggctgagcgtggtctttttcgtgtggtacttaattttaaaaggtgtcctagtgtgaggtgtaagtttgtggagtcgtgggggtacnccgttgggtcccgggcccgggggttaccctggagtactctacgattcggtacgcgacgtccttcgtaggtacttacaacttaaacttttaaacaacctaagtgggacctaagtcggtaacgttccgggcccttacccggaccgtaggccgttaccggaagggggtaacggggtacctaggggtaacggttcggggtccccgttaccgggtttaggggtttaacgggtcgggtaaggttccgggtaacctaaaccgtaaaccaccgttaaagtttccggaacccggggtccgggtacccgtaccgggtacgggaaaccgggttcccactttaacccgaccgtactttacccgaaccggtaagtttaaccctttacccgaaacggttaaccacccggttaacgttaacgacttaacgtaaacggtaaaccttaaggaacccgtagtttacccgaagggtaacggtaccggttaacccggaacgtttaacccgttaaccccggtttaaccgtttttagttaaacggttacggtaaccggttaaacgggtaaacggttaaaccggtttaaccgtaggttacccccgggggttaacgtaacgttaacccggtttttaaccccgccccggttttaaaggttacggaaacccgggtaacgggtacccggggtacgtaacccgggtacccccgtgtaccccgttacccg

SEQ ID NO: 153723 - DNA, 797 bp, Homo sapiens
  misc_feature: GYAE6OF01EXWTU.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggtagtttgggctgagctggtctttttcttgtggcttatttaaaaggtgtccagtgtgaggtgaagttgttggagtcgtggggagtccgttggttccgggcccgggggtcctgacgactctcatgtgcagcctctggtattcactatttaactacaatggcagtgtagttggcctccgccaggtccgtccgaggggaacgggcgtgggaggtcgggttaccgccgttagggtttacgggtaggggtacggtggtaccgtaaccgaaacgtacgtacgtttacccgtaacgggcccggggtccgttaccgggtagggtaaaccggggtcccggtaacctttacccgaacccgtacgttacccgtaacccgtaaacggttacccgtttttaacccgaaacgtaaaccctaaccggtactaacgtaacgttacgtaaggtaaacgtacgaaacgtacgtacgtaggacgtaacggtacgaacgtaaccgtaacggttaccctttaagttacgttacggtacgtaacggtaaacggttaacgggttaaccgttaggtaccgggtaacccggtaacgtacggtttaccgtacccggttaccgtttacggtaacggtaacggttaccggggaaccgtaaccgggtaccggtccgttacccgtacccgg

SEQ ID NO: 153724 - DNA, 614 bp, Homo sapiens
  misc_feature: GYAE6OF01B2C67.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagccgtttgggttccgggcccggggggtccctggacgactctcatgtgcagcctctggtattcactatttaactacaatggctatggagttggcctccgccgaggcctccgaggggaacggggcgtgggaggtcgggtcgccgttcgggttaggtgggagtggctacaacactattcgacggcgggtctccggtgacgggccgtattcaccatctaccgacgtactttaccaagacacgctagatcgtaggaatacgaacgagtcgtagagtagcgacgacgaccgtacctttattacttgtagacgtaagtaggttacgtagtcggtaccggtacgtacgttactcccgtcgttacgacgaagtcgggaccgtacgggacccgtggtccgtacccg

SEQ ID NO: 153725 - DNA, 621 bp, Homo sapiens
  misc_feature: GYAE6OF01DHFUC.24.59.F04.1.454.CMB.1.raw
  modified_base (260)..(260): a, c, t, g, unknown or other
  misc_feature (260)..(260): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtggggacaacagagtccacctatcctcttacgccaggcgagtcgagggtctattaactactttgtaattggtactcatacaaaaaccnggaccgaacgggaccctaaactccgtggtacaacgatgcatccaagtcggtagccgacggggccccatcgtaaacggttcaggcggccaagtacagtcgtagggtactacgtttacttccaccctttacgacctatccgagccggctgctacgcctagaggacgttggttcgcaatattacttctacgtacaactaatcgtagaactacgtattacgttaacttacgttttacggacggtaggggtaacggtagggtagggtaacgtaaccggtaaccgtaaaccgggtaacgttggtcggtacgttacgacctaacctacgttcggttaacttcccgttactcctttcccgttacccccg

SEQ ID NO: 153726 - DNA, 878 bp, Homo sapiens
  misc_feature: GYAE6OF01DSVBY.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggcttaattttaaaaggtgtccagtgtgaggtgaagttgttggagtcgtgggggagtccgttgggttccgggccccgggggtccctggagactctcatgtgcagcctcgtggacttcactaatttaacctaacaagtggctagtgaggttcggcctcccgcgacggtcctaccggaagggggacgggtcgtgggtaggtcgggtccgtccgttcggttttaagggcgggtaggtcggtactaaccgaacaccgtagtttaccgtaccgggccgggtccgttacccgggtagggaaccggggtcccggtaatttaccccgaacccttaacgttaccccgttaacccgtaaaacgggtttaacccctttttaaccccgaaaacggtaaacccgtaaccgtaccgttacggtaaaaccgtttacggttaacgggtaaaacgtacggtaaaaccgtacggttaaccgttacgggaacggttaacgggttacccggaaccggtaaaccccggttacccgggtttaacccccgttttttaagtttaccgtttagggttaacggtaaccggtaaagggttaccgggttaacgttaggtaccggggttacccggtaacgttaaccggtttacccgttccccgttacccggttacggtaaccggtaaccgggtcggggaacccggtaaccggggtaaccccgttgggtcccttaaccccgg

SEQ ID NO: 153727 - DNA, 969 bp, Homo sapiens
  misc_feature: GYAE6OF01D0BL1.24.59.F04.1.454.CMB.1.raw
  modified_base (262)..(262): a, c, t, g, unknown or other
  misc_feature (262)..(262): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttctgtggcttaattttaaaaggtgtccagtgtgaggtgaagttgtggagtcgtgggggagtccgttgggttccgggcccgggggtcctgagactctcatgtncagcctgtggattcactatttaactacaatggactagtgtacggttcggcccgtccgcgacggtccgtacgggagggggacgggtcggtagggagggttcgggtacgtccgggttagggttagggtgggtacggtcgtaacgtaaccgtaacgtacgttacgtttaccggaccgggtccgggtcccgttacgggtaacgggaaccgggtacccgttaacgttaccccgaaccgttacttaccccgtaaccggttaaaccgggttttaacccttttaaacccggaaacgtaacccgtaaccggtaacgttaaacggttaacgttaacgggtaaaggtaaacgtaaacggtaaaccggttacggttacgttaacgggtaacggtaacgggtaacccgggtaaaccggtaacccggttaaccccgggtttttaaccgtttttaaaggtttacggtttacccgggtaaacgggttaaacgggttaaacgggggttttaaccgggttaaaccgttttacgggggttaacccggggtttaaccgggttaaaaccggtttaacccgggtttttaaccccggtaccccgggtttttaccgtttaaaccccgggggtaaacggttaaacccggggggttccccggggtaaaacccgggggttaacccccgggttaaaccggggtttccccgggttaaacccgttaacccccccggg

SEQ ID NO: 153728 - DNA, 599 bp, Homo sapiens
  misc_feature: GYAE6OF01BCGOF.24.59.F04.1.454.CMB.1.raw
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (547)..(547): a, c, t, g, unknown or other
  misc_feature (547)..(547): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgtcgttttctagtggctattttaaaaggtgtcagtgtgaggtgaagttgttggagtntggggganccttggttcggcccggggggtcctgagactctcatgtgcagcctcgtggattcactaatttaaactacaatggacatgagttggctccgcaggctaccgagggaagggctggagtgggtcgccgtgggttagtgggagtggctaacaancattcgacgcggctcgngagggcctagtcacatcctcgaagtactttacaacgtaacacgtactagtaatcgtaggtaaatagtaacagtacgtagaagacggtcgaacgaacgtaccggtaccctttaagttattgttagacggtaaagaggttactagtggtaccgacgtacgttacncccgttcttacgacgtaagtcggggacctaacgggaaccctggtctacccgg

SEQ ID NO: 153729 - DNA, 748 bp, Homo sapiens
  misc_feature: GYAE6OF01CDEY1.24.59.F04.1.454.CMB.1.raw
  modified_base (177)..(177): a, c, t, g, unknown or other
  misc_feature (177)..(177): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtggganacagagtcaccatctcttgccaggcgagtcagggcattaactactttgtaaatggtatcatacaaaaaccaggacaacgggaccctaaacgtcctggtacaacgatcggacactccaaagtccgggtacgaccgtacggggccccctagtacgaaggttccaggtcggactagtagactcggtgggaacctagtttccttacctaccctttaccgacctaacgttcgaacgggcccgtacccgttcggaccgtacggtcccgtaggtaacggtagttcgggttacgggactaactaagttttaacgttaccgttagttaaccgaaacttaacgttaaacgtacggtaacccgtaagttaaccgtttaaggttaacccgtttaaccgggttttttacggggaaaccccgggttaaggggggtaaacccgggtaacggggttacgggtaaacccggtaaccgttaccggtaaaaaacccggtaacggttacgggttacggggtaccttcgggaacctaaccccgtaacgtttccgtacgttttcccttacgttaccttaccccgtttcccccg

SEQ ID NO: 153730 - DNA, 848 bp, Homo sapiens
  misc_feature: GYAE6OF01EH1FT.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctattttaaaaggtgtccagtgtgaggtgaagttgttggagtcgtggggagtccgttggttccgggcccgggggtccctggagactctcagtgtgcagcctcgtggattcaactaattttaaacctacaattggctagtgtagttgctccgccaggcctccgagggaaggggctgggagttcgggtcgccgttcggttaggtggtagtcggctaacgaactactagttacgacggccgggtcgtacggtaggaacggggcccgtatttaccgacccgtattcccgtaccgtaacgttaccttttacccgaaacgtaaccgaacgtaccgtaagtaacttccgtaaggtaaacgtacggtaaactacggtaccgttaggacggtaacggttaaccggaacccgggtaaacccgttacccgggttaaccccgtttttaaacggtttacgttttacgggttacgggtaaaccgggttaaaagggttaacggggttttaaacccgttaacgggttacccggggttaacccgggtaaacccgtttaaccgggttttaaccccgttaccccccgggtttacccggttttaaccgggtaaaccgggttaaccgggttacccgggggtaaccccggtaaacccccgggggttaaccccggttacccggtaccccggttaaacccccgg

SEQ ID NO: 153731 - DNA, 737 bp, Homo sapiens
  misc_feature: GYAE6OF01AH8A4.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctattttaaaaggtgtccagtgtgaggtgaagttggtggagtcgtgggggagccgttgggttcgggcccgggggtccctgagacgtctcatgtgcacgcctcgtggtacttcaactatttaaactaacaaagtggactatggtagttcggctccgccaggctccggagggagggcgtgggaggtgggtccgccgttcgggttaggtgggtaggtcggacgtaacaaacacctagtttaccgacggccggccgtccggtaggaacggggccctagttccaccgtactccgtaaccgtaacggttacctttaccgaagtaaccgtacgtacgtagaactcgtaaggtaagtacgaaacgtagtcgtaggacgtaacggtacggaccgtaaccgtaccggttacccttttaagtttacgttacggtcgtaacgggtaaggtacgggtttaacgtaggttaccgggtacccggtaacgttaccggttacccgttaccccggttccgtttacgggaaccggttacggtcggggacccgaaccggggttaccccgtcgggtacccgttacccccg

SEQ ID NO: 153732 - DNA, 789 bp, Homo sapiens
  misc_feature: GYAE6OF01AIRZX.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggcttaattttaaaaggtgtccagtgtgaggtgaagtttgtggagtcgtggggagcgttgggttccggggcccgggggtccctggacgtactctcatgtgcagcctctggtacttccaactaacttttaactaactaagtggcagtgtaggttcggcctcccgcgacggccgtccggaggggagggcgtagggtacggtcgggtccggtccggttcgggttaggtcggggtaggtgtacctaacaacctacgtacgtttcgaccggtccgggtccgttccgggtacggaacggggcccgtaacgtttacccaaccgtactacccgttaacccgtaaacgggtttacccttttaacccgaaacgtaaacccgtaccgtaacgtacgtaaactaccggtaaagtaaacgtaacgaaacgtacgtcgagaacggtgaccggaccgaacccgtaccggttaccttttaagtttacgtaggttacgtaacgtaaagggtacgggtttaaccgtaggttccggggtaaccgtacgttaacggtttaccccgttacccgttccggtttacggaaccggtaacgggtcccggggaacccgtacccggggaacccgttgtccccgtacccgg

SEQ ID NO: 153733 - DNA, 968 bp, Homo sapiens
  misc_feature: GYAE6OF01CZDDG.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtgcttaattttaaaaggtgtccagtgtgaggtgtaagttgttggagtcgtgggggagtccgttgggttccgggcccgggggtccctgacgactctcatgtgcagcctcgtgattcactatttaactacaagtgacagtgtagttcgcctccgaccgacggcctaccggaaggggaacggggtcgtagggtagggttcgggtccggtccgttacggggtttagggtacggggtaggtcggtaccgttaaccgaaacctaacgttaacgtttcccgtaaccgggccggggtaccgtttacccgggtagggtaaacccggggtcccgttaacgttaccccgtaacccgtaaccgttacccgttaacccggtaaaacgggtttaccctttttaaaccccgaaaacggtaaacccgtaaccggtaccgttaacggtaacttaaccggtaaaggtaaaacgttaacggaaaaccgttaacggttaaccgttaacgggaaaccggttaaccgggtaacccgggtaaacccggtaaccccgttaaacccgggttttaccccctttttaagttttaaccggtttacggttaaccgggttaaaccggtaaaaggggtttaaccgggttttaaaccggttacgggttaaacccggggttacccgggttaaaccggtttaacccggtttaaccccggtttaccccggtttacccggtttaaccgggttaaaccggtaaacggggttaccccgggggtaacccggtaaacccggggttaaacccccgggttacggttacccccggttaacccccgg

SEQ ID NO: 153734 - DNA, 841 bp, Homo sapiens
  misc_feature: GYAE6OF01E4IKT.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggtctttttcttgtggcttattttaaaaggtgtccagtgtgaggtgagttgttggagtcgtggggagtccgttggttccgggcccgggggtcctggagactctcatgtgcacgtcctcgttggtacttacctaactaactttttaaaacctaaccgtaaagttcgggactaaagttagggtaacgggtttcgggtccccgttccccggaccccggtaacgggtcccgtaaccggggtaaggggggaaaccgggggggtccggttagggggtacggggtttacgggggtccggtcccgggtttaacgggggttttagggtcggggtacggtcgggtaccttaaaccgaaaccgtaacgtacgtttaccggtaccggccggggtccgttccggtagggtaaccgggccgtaacttcccgaaccgtacgttccgtaacccgtaaaccggttaccttttaccgaaacgtaaccgtacgtacgtagtaactacgtaaggaaagtacgaactacggttacgtagacgtacggacgacggaaccgtaccggttacctttaacgttacgttcgtacggtacggtaaagggttacgggttacgttacgtacgggtaccggtaacgtacgttaccgtcccgttaccgttacgtaccggtaacggtccgggaacggaccgggtaaccgtcggtacccg

SEQ ID NO: 153735 - DNA, 943 bp, Homo sapiens
  misc_feature: GYAE6OF01EZJ3Y.24.59.F04.1.454.CMB.1.raw
tcagactactatgtcacgaccggtgctcgatttagtacacacacttagggattggggtctgagagaggagcccagccctgggattttcaggttgttttcatttggtgatcaggactgaacagagagaactcacagtggtagtttgggctgagctggttctttttcgttggtggtactttaaagtttttaaaagggtcgttaccgtaggttggtggtaagggtttagtaaggttttggttagggaggttcggtgggggacgttccggtttgggttcccgggggtccccggggggtcctaggacgtacctcgtctagtgtcgacgtcgtccgttgtaggtactttacaactttaacttttaaacctagaagttcggtactagttcggtaggtttcggccccgtcccggaccgtacggtccggtacccggggaaggggggtacggggtcgtacgggggtacgggttccggggtcccgttacccgggtttagggggtttacggggttaggggtaggttaccggggtaacccttaaaaccgtaaaccgtaaccgttaaccgtttacccgggtacccggggtacccggtttccgggtaaccccggtaagggggtaaacccgggttacccgtaaaccttttccccgaaacccgttaccgttaccccgtaaccggtaaaccgtttacccgttttaacgaaacgtaaccgtaccggtaaccgttagtaaacgtcgtaaaggtaataacgacgttagtacgtaggacgttacggaccgtaacgtccgtaaccgtttacgttttagttacgttaaggtacggtaagggtaaacgttacggttaacttacgggtaccggttaaccgtacgttaaccgtttacccggtaccggttcgttaacggacgtaacgggtccgggtaacccgaaggtttaccccgtcggaccttaccccgg

SEQ ID NO: 153736 - DNA, 761 bp, Homo sapiens
  misc_feature: GYAE6OF01C9SYZ.24.59.F04.1.454.CMB.1.raw
  modified_base (184)..(184): a, c, t, g, unknown or other
  misc_feature (184)..(184): n is a, c, g, or t
  modified_base (722)..(722): a, c, t, g, unknown or other
  misc_feature (722)..(722): n is a, c, g, or t
  modified_base (737)..(737): a, c, t, g, unknown or other
  misc_feature (737)..(737): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatcgacccagtcctccactcctccctgtctgcattcgtggtaggganacaggtactcacctatctcgttcgaccgaggcgagtcgagggactaagttaacttagtttagtaagttggtactctaacgtaacaaaaccgaggaaccgaacgggtaccctaaacgtccgtaggtaccaacggtactacgactaacgtaccgtaacggtccgggtacggacccgggtacccggggtacccctaacgtaccggtaacggttaccgaaccgggaccggtactaagtacggtacgttcgggtaacgggttaccttaacgtttccttaccctaccctttaaccaccgtacgtacccggacggtacccggtccgtacgaccgtaccggtaccgtagggtacggtgttacggtcgtaacgtaattaacgtttacttacgtaacgtaaccaaactaagttacgtagaccgttaattacgtttacgtaacgtttaccggttacggaccgggtacgggtaaacgggtggtaacggtacgtaacccaaaccggtaacggtacggttacgggtgttaccgtaaccgaccttaaaccgtnttaccttaccgtttnttaccctaccgttcccgtaacccg

SEQ ID NO: 153737 - DNA, 679 bp, Homo sapiens
  misc_feature: GYAE6OF01APZAM.24.59.F04.1.454.CMB.1.raw
  modified_base (658)..(658): a, c, t, g, unknown or other
  misc_feature (658)..(658): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccgaggcgagtcgagggactattaacttactttagtaaattggtatacactaacaaaaaccgaggaccgaacgggtaccctaaactccgtacggtacaacgatgactactaccgtaagtccggggtacgccggtaccggggcccctagtaccgtaacgggttacgacggacggcgtaagtacgtaacgtcggtacgggtactactttccttaccctacccttacgaaccacgttaccgacggcccggtctacgccgtacggtcgtacgggaggttacgttggttacggactaagtaacttacgttacgtacgtaactaaacgttatagtacgtaagtaagtacgttaacggttaccgttacgggtttacgggaaccgggtaaggggtaaccggtaagggtacggacgtaacgtaacgaaacggtacgtcggtcggactcgacctactacttcgttaccgttnttaccctcttcccgtaccccg

SEQ ID NO: 153738 - DNA, 928 bp, Homo sapiens
  misc_feature: GYAE6OF01ENJAQ.24.59.F04.1.454.CMB.1.raw
tcagactactatgtcacgaccggtgctcgatttagtacacacacttagggattggggtctgagagaggagcccagccctgggtattttcaggtgttttcatttggtgatcgaggactgaacagagagactcaccagtggtagtttgggctgagtcgtggttctttttgttggtggtactttaaagttttaaaagggtcgttccgtaggttgtggtagggttggtaagtttggttgggaggttcggtagggggtacgtccgtttcgggttccgggggtccccggggggttccctggaacgtccttctgtacgtgtgccacgtcctcgtaggtacttaccaactaacttttaaacgtaactaagtcggactagttggtaaggttcggccgttacccggcccgacgggtcccggtaaccgggaacggggggtaacgggtcggttaggggcgggttccgggttcggtccggtttacgggttaggggttacgggtaggtaccggtacctaaactaaccggtactacgttacggaaccgggtcgggtcgtacccggtagggaaccgggtcaacgttccaacgtactaccgtaccgaacgtttaccctttaaccgaacgtaactaccgtaccgtaacgtaacgtacgttaacggaaagtaacggtaactacggtttacgacggtaaacggtacggtaacccgaaccggtaacccggttaaccccggtttacccgtttaagttttaacgtcggggttaaacgggttaacgggtaaaggttaaacgggtttaacggtaacggtttacccgggtaaaccggttaaccgtaacggtttaacccgtttacccggtcgttttaaaccgggaaacgggttaccgggtaacgggtacccgggtaaaaccggggttcccgttaaccggtcccggttaaccccgg

SEQ ID NO: 153739 - DNA, 850 bp, Homo sapiens
  misc_feature: GYAE6OF01ASGDL.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtcgtttttcttaggtggcttaattttaaaagggtgtccagtgtgaggtgaagttgttggagtcgtgggggagtccttgggttccgggcccgggggtccctggagactcgtcatgtgcagtcctgtggattcactatttaacacaagtggctatgagttggacctccgccgaggtcctaccggtaggggaacggggtcgtgggaaggttcgggtacggtccgttcgggttaggtggggtacggtcggacctaaccgaaacctacgtaacgtttccggtaaccgggtccggggtttacccggtacgggtaacgggggtacccgtaacgtttacccgaacccgttacgttacccgttacccggtaaaacgggtttaccgtttttaaccccgaaaacggtaaacccgtaaccggtaccgttaacggtaaacgttaccggtaaggtaaaaacgttaggaaaccggtaacgtccgttaggtaacggtacgggtaaccggaaccggtaaccggtaacccgggtttaccccttttaagtttaacgtttaggtacggtaacgggttaaagggtacgggtttaacgtaggttcgggttacccggtacgttaacggttaccgttacccccgttcgtttacggaaccggtaggtaccggggtacccggtaacgggtaaccccggtcggtacccgtaaccggttcccg

SEQ ID NO: 153740 - DNA, 657 bp, Homo sapiens
  misc_feature: GYAE6OF01CLXZU.24.59.F04.1.454.CMB.1.raw
  modified_base (388)..(388): a, c, t, g, unknown or other
  misc_feature (388)..(388): n is a, c, g, or t
  modified_base (463)..(463): a, c, t, g, unknown or other
  misc_feature (463)..(463): n is a, c, g, or t
tcagactactatgtcacgaccggtgctcgatttagtacacacacttagggattggggtctgaggagaggagcccagccctgggatttttcaggttgttttcatttggtgatcaggactgaacagagagaactcacatggagtttgggctgagctggtcttttttctgtggtcttattttaaaaggtgtccagtgtgaggtgaagtttgttggagtcgtgggggagccgtttgggttccgggccccgggggggtccctggacgtacgtctcagtgtgcagcctctggattcactattttaacgacaatggacatggagttcggcctccgccgaggcctccgaggggaagggctggagtggttcgccgttcggtagtgggagtggactanaacactattcgtacgcggctccggtaggaacgggcctattcgaccatctaccgaagttacctttaccaagtaacncgtactagtaatcgtaagaatacgaactagtcagagagtacgacgaccgtaccggttcctttagttgttagtgtaacgtaaggtacggttactaggtcgggtaccgtaacgttcgttaacggttccccgttacgtttacggaacggttaacgggtcggggacccgtaacggggtacccgtggtcccgtacccgg

SEQ ID NO: 153741 - DNA, 811 bp, Homo sapiens
  misc_feature: GYAE6OF01DLPIK.24.59.F04.1.454.CMB.1.raw
  modified_base (219)..(219): a, c, t, g, unknown or other
  misc_feature (219)..(219): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcacatggagtttgggctgagctggtctttttcttgtggtacttattttaaaaggtgtccagtgtgaggtgtaagttgttggagttcgnggggagtccgttgggttccgggcccgggggtcctggacgactctcatgtcgcacgccttcgtgtacttcacttagtttaacactaagttggcatgtaggttcgcctccgccgacggccgtaccggaaggggaaggggtccgtaggggtagggttcggggtccgtcccgtttacgggttggggacgggtcggtcggtactaaccgaaacgtacctacgttaccgtacgggccgggtccgttaccggtgggaacgggtccgtacttaccgacctacgttcctacccggtaaagttacctttaccgaaacgtaccgacgtcgtaagtacttacggtagtaaagtacgtaacgtattacggtagtaacggtagtacccggaaccgaaccgtaccccggtttaccttttacgtttaagttagggttaacgtaacgggtaaacgggttacgggtttaaccgtaacggttaccgggtaacccggtaacgttttaacgggttaccctttccccgggttaccggttttaacggaaccgggtaaacgggtttaccgggggaaccccgtaacgggggtacccccgtttaagggtaccccccgg

SEQ ID NO: 153742 - DNA, 761 bp, Homo sapiens
  misc_feature: GYAE6OF01C2RDF.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctaattttaaaaggtgtccagtgtgaggtgtaagttgttggagtcgtgggggagtccgttgggttccgggcccgggggtccctggagactctcatgtgcagcctctggattcactaatttaactacaatggcagtgtagttggcctccgccgacggcctaccggagggggaacggggtcgtggggaggttcgggtccggtccggttcgggttaagggtggggaggtcggacctaacgaactactacgtttcgtaccggcgggtcctccggtaggaacggggtcccgtacttaccgaacctacgttccctaccgtaaacggtttaacccttttaccgaaaacggtaaccaccggtacgtaagtaacttacgtaacggtaaatacggaaactaggtaccgttaggaacggtaacggtaccgaaccgtaaccgtaccggttaccctttttaagttacgttggtacgtaacggtaaggtaggtttaaccgtaggtccgggtaccggtacgttacggttaccgtcccggttcgtttaggaaccggtacggttaccgggggaaccgtaaccgggtaacccgtgggtcccgtaaccccgg

SEQ ID NO: 153743 - DNA, 901 bp, Homo sapiens
  misc_feature: GYAE6OF01B7L97.24.59.F04.1.454.CMB.1.raw
tcagactactatgtcacgaccggtgctcgatttagtacacacacttagggagttgggggctctgagagaggagcccagccctgggattttcaggtgttttcatttggtgatcaggactgaacagagagaactcaccatcggagttgggctggagctggtctttttcgttgtggcttattttaaaaggtgtccagtgtgaggtgaagttgtggagtcgtggggatccgttgggttccgggacccggggggttccctaggacgactccgtcgatcgtgcacgtcctgtaggtacttccgaactaacgtttttaaaccaactaagtcggtacctaagttcggttaacggttcggacccttcccggaccgtaagggtcccgttaccgggagggggtaaacgggggtcgttacgggggaacgggttcgggggttccgtacccggggttcgggtttaacggaggggtacggttcggaccgtaaacgaaccgtacgtacgttaccggtacgggccgggtacctaccggttagggaacgggtaccgttacttccgaaccgtacgttaccgtacccgtaacggttaccctttaccgaacgtaaccgtaccgtacgttacgtaaacgtacgttaaggtaaacttacgtaaacgtacgttacgtaacggtaacggtacgtaaccggaaccgtaacccgtaacccggtttacctttttaacgttaacggtttacggtaacgggtaacgggtaaaacggttacggggtttaaccgttagggttaccgggttaacccggtaaccggttaggtttaacccggtccccgtttaaccggtttacgggtaaacccgggttacgggttaccgggggaaccccgttaaaccggggttccccggttacgggttaacccccgg

SEQ ID NO: 153744 - DNA, 569 bp, Homo sapiens
  misc_feature: GYAE6OF01CZPQX.24.59.F04.1.454.CMB.1.raw
  modified_base (179)..(179): a, c, t, g, unknown or other
  misc_feature (179)..(179): n is a, c, g, or t
  modified_base (209)..(209): a, c, t, g, unknown or other
  misc_feature (209)..(209): n is a, c, g, or t
  modified_base (250)..(250): a, c, t, g, unknown or other
  misc_feature (250)..(250): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
  modified_base (506)..(506): a, c, t, g, unknown or other
  misc_feature (506)..(506): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcggtgtgttctaggcgctaatttaagncagtgtgagtgagttgtgagtcgtggggancgttggtacggacccgggggtcctggagactctacatgtgntacgtcagtgaacttcaagtactttaaacaacaagtagcatagacgtggacnccggaccagcgtcgaggagggctggaggtgcgtaccgtggtaggtaggancggttacacgaacactnttaccgacggtcggcctgagaacggtcctaatcgacacttcacctaatccttaccagaaacncgtatagaatcagaatcgatagtacagtagngacaagacttaccgttattagtgtagagacgtaaggtaacgttnacggtagaccgtagtactccgtaccttagtaccgagtacggacggagtacccgtcgtcggtac

SEQ ID NO: 153745 - DNA, 882 bp, Homo sapiens
  misc_feature: GYAE6OF01C8XUV.24.59.F04.1.454.CMB.1.raw
  modified_base (330)..(330): a, c, t, g, unknown or other
  misc_feature (330)..(330): n is a, c, g, or t
tcagactactatgtcacgaccggtgctcgatttagtacacacacttagggattggggtctgagagaggagcccagccctgggatttttcaggtgttttcatttggtgatcaggactgaacagagagaactcacatggaggtttgggctgagctggtctttttttcgttgtggtacttaattttttaaaaaggtgttacctaagttggtggtagggttaggtaaggttttggttaggtaggttcggtggggggtacgtcccgtttcggggtttcccggggcccccgggggggttacccctaggacggtacctcctcgtatggtgccgtacnccttcgtaggtactttaccaacttaattttaaaccaactaaagtggactagtggtagttcggccttccgccgacggtccgtaccggagggggaagggcgtagggaggtcgggtcccggtccgtttcgggttaggtgggtacgtggaacctaacaaactaccgtaacgtttcgtaaccgggcccgggttaccgtacccgggtaggaaacccggggtccgttaacgttacccgaaccctaacgttcccctaacggtaaaccgtttaacccgttttacccgaaaccgtaaacgacccgtacgttaacggtaacttaccgtaaggtaaacgtacgaaacgtacgtacgttacggtaagaaccggtaccgggaaccaaccggttaaccggtttaccccttttaagttagttacggttaacgtaaccggtaaaggttaacggggtttaacttacggggttaccgtccgggtaaacgtacgtttaacccgttcccggttacgttaccgaacggtacgtacggggacccgacgggtaaccccgtgggtaccctaccccgg

SEQ ID NO: 153746 - DNA, 758 bp, Homo sapiens
  misc_feature: GYAE6OF01C07X0.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatcgacccagtctccatcctccctgtctgcatctggtgggagacagtacgtccacctatcctcttcgccgaggcgacgtacgacgggactaatttaactactttagtaaattggtatacaataccaaaacgacggacgaacgggtaccctaaactccgtacgtacgaagtactgactactccgtaaggtccgggtcgacccggaccgggccccaagtaccgaacggttcgaggtccggacgtaagtacggtacgttcggtacggtaccttacgttttccttaccctacccgtttaccacctactcgaccggtccggtccgtcgcgtaccgaccggtaggtacggtgttcggtacgtacgtacgtattacgttacgttacgtaaccgtaaacgtaagttacgtaacgtacgtaattaccgttacgttaccgttacgggttttacgggaaccgggttaacgggggtaacggtaacgggtacgggtaaccggtaccgtaaaccggtaaaccggtaaccggttacgggtacggtaccggtccgtaacccgttaaccgttaaccgtttacccgtttacccggtttacctttaccccgttaacccgtttcccccgtttaacccccgg

SEQ ID NO: 153747 - DNA, 653 bp, Homo sapiens
  misc_feature: GYAE6OF01DCGRS.24.59.F04.1.454.CMB.1.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
  modified_base (410)..(410): a, c, t, g, unknown or other
  misc_feature (410)..(410): n is a, c, g, or t
  modified_base (464)..(464): a, c, t, g, unknown or other
  misc_feature (464)..(464): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcacatggagtttgggctgagcgtgtcgttttctaggtggacttaagttttaaaaggtgtccagtgtgaggtgtaagttgtaggngtgtgggggacgtcgttgggttccgggcccggggggtcctaggacgactctcatgngaccagtcctcgaggtacttcatactttaacagaatgnagtgagttcggctccgcacgctacgaggaggtcgaggcgtggcgccgtggttagnggtacgtggactaacgaacactagttcgaacgggtccggctaccgnggggaaacgcccgtaatccgacctagtacccacgtaacggtactttaccgaaanaacgtacgacgtagtaacttacgaaggtaaagtgaaaacgtgtcgtaggaaggtacgacggaaccgtacgtaccgtacccgtttattaagttcgttaggaacgtaacggtaggtagtacgtcgtacggtactagttacctcccggttctagtaccgtagggtacggaaccgcgggtaacctggtacccg

SEQ ID NO: 153748 - DNA, 787 bp, Homo sapiens
  misc_feature: GYAE6OF01BVX4K.24.59.F04.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggtaggtttggctgagcgtgtcgttttcgtggtcgacttaagtttaaaggtntccgagtgtgaggtgtaagttgtggngtcgtggggagtccgttggttccgggcccgggggtcctaggcgactctcngtgtgcacgtcctgtggtacttctaactaattttaactaccaagtggatataggtaggttcggaccccgtccgaccgacggaccgtccgggtaagggggaaccgggtgtcggggtacggttcgggtaccgtccggtttacgggttagggtgggtacggttacgggtaccctaaacgaacctaccgttacgtttacccggaccgggcccgggtcccgtttacccggggtaggaaacggggtcccgttacttacccgaacccttaccgttacccgaaccggttaacggtttaaccctttaccccgaaaagttaacccgacgtcccgtaagaacgttcgaaacggtaatacggaaatcgtagtacgaggtacgaccgaacggtccgtaaccgttccttttaagttcgtacgtacggaagtaacgggtacgttacgtagtaccgggtactagttacgttcccgttccggtccttaggtaccggacggttccggggaaccgtaaccggtcccgtcgtacccgtaccccg

SEQ ID NO: 153749 - DNA, 724 bp, Homo sapiens
  misc_feature: GYAE6OF01DF84X.24.59.F04.1.454.CMB.1.raw
  modified_base (128)..(128): a, c, t, g, unknown or other
  misc_feature (128)..(128): n is a, c, g, or t
  modified_base (481)..(481): a, c, t, g, unknown or other
  misc_feature (481)..(481): n is a, c, g, or t
  modified_base (518)..(518): a, c, t, g, unknown or other
  misc_feature (518)..(518): n is a, c, g, or t
  modified_base (665)..(665): a, c, t, g, unknown or other
  misc_feature (665)..(665): n is a, c, g, or t
tcagactactatgtcacgaccggtgctcgatttagtacacacacttagggattgggcacagcgtggacatgagggtccctgctcagctcctggcctcctgctgctctggctctcgaggtgcatatgtnacatccagatcgacccagtcctccactccctcctcgtctgacctacttcgtaggtacgggaacgacagtacgtaccaaccctagttccgttcgttacggaccgtaaggccggtagtaccgaagggtaccttaaacgtttaaccgttaacgttttaaaggttaaacgtttaggtacttacgtaaactaaacgaaaaaccgaggtaacgtaaaccggtacctaacgtcgtacggtaactaacgtatacgtacgtactacgaacgtcggtacggaccgaccggtaccctagtaccgtaagtccgagcgtacgagttacgagtacgtacgtactacgtttactcctacgtactaccncgacgtaccgccgtacgtacacgtaccgacgttaggnggtacttaggttcaacgttataagttacctagtacttaaacgaacgttacgtagaagtacgtaaactttcgaacgtttacgttacgtacgggtaacgacgggtaacggtacgacggtacgtacgttaaaccgaaaagtccgttaggngtaccgttccgaaccgtcttacgttaacctgtttaccaccgtttccgtacggttacccc

SEQ ID NO: 153750 - DNA, 913 bp, Homo sapiens
  misc_feature: GYAE6OF01BMWWX.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggtctttttcttgtggcttatttaaaaggtgtccagtgtgaggtgtaagttgttggagtcgtggggagtccgttgggttccgggcccgggggtccctgacgactctcagtgtcgcgacgcctcgtggtattccaactaacttttaaacctaactaaagtcggactagtgtaggttcggcctcccgccgaggtcctaccggaagggggaagggggtcgtaggggtacgggtcggggtccggtcccggttacggggtttagggtacggggtaggttcgggtaccgtaaacgaaaccacctaacgttccgaaccgggtccgggtaccgtccgggtacgggaaacggggtcccgtaacgttacccgaaccgtactaccgttacccgtaaaccgggtttaccctttttaaccccgaaaacgggtaacccaaccggtaccgttaacggtaaacgttaaccggttaaacgggtaaaacgttaacggtaaaccgttaacggttacgtaacgggtaaggtaacgtaaccgggaacccggtaacccgtaaccccgggtttacccctttttaagtttaacgtttacggtacggtaaaccggtaaaacgggttaaacgggtttaacgttaacgggttaccggggtaccgggtaaccgtttaacgtttacccggttcccccggtttacgttaccgggtaaacccgggtacgggttacccgggggtaacccggtaaacccggggttaaacccggttccggggttaaacccccg

SEQ ID NO: 153751 - DNA, 796 bp, Homo sapiens
  misc_feature: GYAE6OF01EPNGV.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagtctggtctttttcgttgtggtcttaattttaaaaggtgtccagtgtgaggtgtaagttgttggagtcgtggggatccgttggtccgggcccgggggtcctgagtactctcagtgtgcacgtcctcgtggtacttcaacttaacttttaaccaactaagttggactagttggtacggttcggacccgttcccggaccgtaacgggcctaccggggaagggggtaacggggtccgtaggggtacggttcgggtaccgtccggtttacgggttaggtggggacggttcggtaccgttaacgaaacgtacgtacgtttaccgtacgggtcccgggtccgtaccggtaacggggaacccggggtacccttaacggtttacccaacccgttacgttacccgttaacccggtaaacggtttacccgttttaaccgaaacgtaaccgtaacccgtacgtaacgtaacgttacgtaacggtaaagtacgaactagtaccgtaggacgtacgtaccgacgtaccgtaccgttaccgtttaagttacgtcggtagtacggtaaaggtaggttaacgtaggtaccgtacggtacgtacgttaccttcccgtacgttagaccgtacggcgggtaccgaccggtaccgtcggtacccg

SEQ ID NO: 153752 - DNA, 698 bp, Homo sapiens
  misc_feature: GYAE6OF01BVJE6.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggtctttttcttggtggtcttattttaaaaggtgtccagtgtgaggtgaagttgttggagtcgtggggagccgttgggttccggcccgggggtccgtgacgactctcatggtcgcagcctcgtggtattccaactaatttaaaccaacaatggctatggagtttcggcctccgccgaggtcctaccggaggggacggcgtagggagtcggggtcgccgttacgggttaggtgggagtcggacctaacgaactactatttccgaccggcgggtccttccggagggaccgggtaccgacgtttaccgaaccctacgttcccgtaccgtaaaccggtttaccgttttaacccaaacggaaaccctacgacgtacggtaactacgtaccgggaaaattcgaaccgtagttacgaggtaagtaccgacgtaacgaccgtcggtacccttttaatacgttgtagacgtaaagtcgggttatacgtcggtacgacgtatttaccgccctacgtttcgacgtacgtcggggacacgggtacccgtcggtacg

SEQ ID NO: 153753 - DNA, 766 bp, Homo sapiens
  misc_feature: GYAE6OF01ALD0Q.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggtcttttcttgtggtcttaattttaaaggtgtccagtgtgaggtgaagttgttggagtcgtggggatccgttggttccgggcccgggggtcctggacgtacctctcattggtcgcacggcctgtcggtatcgaacttaactttaactaacgagtgctagtcgtaggtcggcctccggacctcggtctaccggagggggacggggcgtagggtcgggtcgggtccggtccggttagggttaggtcgggtaggtcggacttaaccgaactactacgttaccggtaccggtccggggtaccttccggtagggaaaccgggtccgtaacttaccgaccctacttcccgtaaccgtaaacggtttaccctttaaccggaaacgtacccgtacgtacgttaagtaaaccgtcgtaagggtaaactagggtaacctaggtacgttacggaacggtacgtacccggtaaccggtaaccgttcccggttacctttttaagtacgttggtaccgaagttaaaggtacgggtttactacggtcgggtaccgttaccgtagtttaccgtccccgttgttaggaaccgtgggtaccggaacggtaccggttaccctgggtaccc

SEQ ID NO: 153754 - DNA, 686 bp, Homo sapiens
  misc_feature: GYAE6OF01AO61D.24.59.F04.1.454.CMB.1.raw
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
tcagactactatgtcacgaccggtgctcgatttagtacacacacttagggattggggtctgaaagaggagcccagccctgggattttcaggtgttttcatttggtgatcaggactgaacagagagaactcaccatggagtttgggctgagcgtggtcgttttcttgtggctattttaaaaggtgtccagtgtgaggtgaagttgttggagtctgggggagccttgggttcgggcccggggggtccctgagactctcatgtgcagcctctggattcactatttaactacaatggcatgagttggctccgcngctcgaggaggcgtggagtggtcgccgtggtaggngggtagtggtactacgaacactnttaccgtacgcgggtacctcccggtaggaacgggtcccgtagtttacccaaccgtattacccgttaccgaaacgggttacccttttaccgaaacggtaacctacggacctaggtaactaccgtaggtaaatagaacgacggtctagacggtacgacggtaaccgaaccgtaccggttaccctttaagttacgttaggtacgtacgggtaaacgtagggttaactagtcgggtaccggactaacggttcgtaccccgtcgttacggacgtaacggtcgggtaccgaacgggtaacccgtcggtaccctccggttacccg

SEQ ID NO: 153755 - DNA, 762 bp, Homo sapiens
  misc_feature: GYAE6OF01A9D6L.24.59.F04.1.454.CMB.1.raw
  modified_base (164)..(164): a, c, t, g, unknown or other
  misc_feature (164)..(164): n is a, c, g, or t
  modified_base (449)..(449): a, c, t, g, unknown or other
  misc_feature (449)..(449): n is a, c, g, or t
  modified_base (650)..(650): a, c, t, g, unknown or other
  misc_feature (650)..(650): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgtcttttctgnggctatttaaaggtgtccagtgtgaggtgtaagttgttggagtcgtgggggcgtccgttgggtccgggccccgggggtcctgagactctcatgtcgcagcctcgtggtattccactatttaaactaacaagtcggctaagtgtaggttcggtcctccccggccgaacggtcctaccggaaggggggacgggtcggtgggaggttcggggtcgccccgtttgggttaggtggggaagtcggtactaacgaaccacgtactttaccgccggcgggtccgttaccggngaaacggggtccgtaattccacccgtacttaaccgtaccaaggttaccctttaaccgaacgaaacgtcggtactacgtaatcgtaagaatacggactagtcgtggtaaggacgttcccggaacgtaaccgtaccccgtttaccgttttaagttacgtttacgggttataacggggttaaacgggttacgggttttaaaccngggtttacccggtacggtaacttaccggtttaccgtccccgttacggtttacggaaccgggttaacgggtcccgggaaccgtaacccggggtaccgtcccgggtccgtcccg

SEQ ID NO: 153756 - DNA, 714 bp, Homo sapiens
  misc_feature: GYAE6OF01ANYAJ.24.59.F04.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (392)..(392): a, c, t, g, unknown or other
  misc_feature (392)..(392): n is a, c, g, or t
  modified_base (440)..(440): a, c, t, g, unknown or other
  misc_feature (440)..(440): n is a, c, g, or t
  modified_base (508)..(508): a, c, t, g, unknown or other
  misc_feature (508)..(508): n is a, c, g, or t
  modified_base (711)..(711): a, c, t, g, unknown or other
  misc_feature (711)..(711): n is a, c, g, or t
tcagactactatgtcacgaccggtgctcgatttagtacacacacttagggattggggtctgagagaggagcccagccctgggatttttcaggttgtttttctatttggtgatcaggactgaacagagagaactcaccatggagtttgggctggaggcggtcgtcgtttcgtaggcggtctaagtttaaaggtgtcngtgtggagtagtagttgtggagtcggtggggtagtccggttgggttccggggtcccgggggtccctggtacgactctagacgtgtgcgacnccgttgcgtacttcactaactttacaataagtggtacagtgtgttcggctcgcccaggtcgacgagggagggcgtgggagtggtcgtaccgttggtggtaggtgnggtaccaacaacgactagtcacggccggtactggtacggacggccgtntaccactacgttccaacgtacgtttacctacgaacgtaccgacgtacgtagtacgtcgtaaaacggtntaaacgactaacggtcgtagaaacgttcggaccgaaccggttcctaacccgggtttactttaaggttaccgttagggttacaaaccgggttaagtacggttttacgaggtttacccgggtcccgtaagttaccgttacccgtacccgttacgttccggaaagggtttccgaccgggaccggtaacgtcccggtggttaccccnccg

SEQ ID NO: 153757 - DNA, 782 bp, Homo sapiens
  misc_feature: GYAE6OF01DE6GY.24.59.F04.1.454.CMB.1.raw
  modified_base (120)..(120): a, c, t, g, unknown or other
  misc_feature (120)..(120): n is a, c, g, or t
  modified_base (179)..(179): a, c, t, g, unknown or other
  misc_feature (179)..(179): n is a, c, g, or t
tcagactactatgtcacgaccggtgctcgatttagtacacacacttagggattgggcacagcgtggacatgagggtccctgctcagctcctgggcctcctgctgctctggctctcaggtnccatatgtgacatccagatgacccagtctccatcctccctgtctgcatcgtggtggganacagagtccacctatctcgtagccgtaggcgagtccgagggtccttaaatttaaccttacgttttaaggtaaattggttaactactaacttaaccgaaaaaaccgtagggaacccgtaaaccggggtaacccttaaaaccgttcccgttacggtaaccgaaacggtacgttacggacctaacgtacccgtaacggttcgggggtaccgaccccgggtacggggtaccccctaagtaccggttaaacgggttacgtacggtaccggtacgtaacggtacgtacgtaccggttacggggaccttaacgttttccttacccgtaaccctttacccacctacgtaccgacggccggtacccttcggaccgtacgtacccgtaggtacggtaattcgggtagtccaacgttaacttacttacgtacgtaaccgtaaataacgtaatacggtaacgtacttaagtacttaacgttacgtttcgggaccggtaggggtaacggtaggtaacggaacgtacccgttaacgaaacggttacgtacgggtgtacgttccgaacccttactacgttacgttacgttacttacccttaccgttcccgtaaccccg

SEQ ID NO: 153758 - DNA, 694 bp, Homo sapiens
  misc_feature: GYAE6OF01D4DCI.24.59.F04.1.454.CMB.1.raw
  modified_base (215)..(215): a, c, t, g, unknown or other
  misc_feature (215)..(215): n is a, c, g, or t
  modified_base (274)..(274): a, c, t, g, unknown or other
  misc_feature (274)..(274): n is a, c, g, or t
  modified_base (553)..(553): a, c, t, g, unknown or other
  misc_feature (553)..(553): n is a, c, g, or t
  modified_base (571)..(571): a, c, t, g, unknown or other
  misc_feature (571)..(571): n is a, c, g, or t
  modified_base (626)..(626): a, c, t, g, unknown or other
  misc_feature (626)..(626): n is a, c, g, or t
  modified_base (644)..(644): a, c, t, g, unknown or other
  misc_feature (644)..(644): n is a, c, g, or t
tcagactactatgtcacgaccggtgctcgatttagtacacacacttagggattgggggctctgagagaggagcccagccctgggtattttcaggttgttttcatttggtgatcgaggactgaacagagagaactcaccagtggtagtttgggctgagcgtgtcttttctgtgtcttagttaaagtgtctagtgtgagtgtaggtgttggacgtgnggggacgtccgttgggttccgggcccgggggtccctagagtcttctactgtcgtcgacncgtccgttgtagtacctactactatttaacacaagttggctgtagggtacgttcggccgttcccgacgtacggtcccggtacgggaagggggtacggggtacgtgggtcgggttcgggtaccggtccggttacgggttaggtacgggggaaggttcggtaacctaacgaacgtacctagttaccgtcgggcggccttacgggaggtacggtcctactccgactacggtcctaccgtaacgttacccttacaacgtacgagtacctagactagagtaacncgtactaggtacaggtancggtaacgaacgaccgtacgttaccttgttacgttgacgtaggaagtacggttanacggttcggactacgtanaccgttcgtaccgtgaacgtacggacgggtaccgtacggccgtggtaccc

SEQ ID NO: 153759 - DNA, 859 bp, Homo sapiens
  misc_feature: GYAE6OF01D3F96.24.59.F04.1.454.CMB.1.raw
tcagactactatgtcacgaccggtgctcgatttagtacacacacttagggattgggcacagcgtggacattagggtccctgctcagctcctgggcctcctgctgctctggctctcaggtgccatatgtgacatccagatcgacccagtctccactccctccctgtctgcacttcgtggtagggacgacgagacgtaccaacctattccgttccgttcgaccgtacgggcgtacggtaccgacgggtacttaaactttaaaccgtttaacgttttaggttaaatttcggttaactacctaaactaaaaccgtaaaaaaccggacgggtaaccgtaaaccgggtaaccccttaaaaccgttcccggtaccggttaacaaaccggtacgtacgaccgtaaccgtaccggtaaacggtccgggggtaccggacccgggtaacccgggtaccccgtaacgttaccggtaaacgggttaccgacgggtaccggaacgtaaggtacggtacgttaccggtacggtaacttacctttaccgtttaccctacccgttacaaccctacgtacccgacggtcccgtaccgtacgacgaccggtccgtaggtacgttagttcgtacgactaactacgtttacttaccgtagtaacctaaacgtacgtaacgtacggaacttataccgtttacggttaaccgtttacggtttacccggggaaccggtaaagggggtacggtaacggggtacgaacgtttaaccggaaacccggtaaacggttaacggtcggttaacggtccttaaccgacccgttacttacggttccgtttccggttacttacccttacccgtttccctaccccggttaacc

SEQ ID NO: 153760 - DNA, 799 bp, Homo sapiens
  misc_feature: GYAE6OF01BVVYD.24.59.F04.1.454.CMB.1.raw
tcagactactatgtcacgaccggtgctcgatttagtacacacacttagggattggggtctgagagaggagcccagccctgggtattttcaggttgttttcatttggtgatcaggactgaacagagagaactcaccagtggtagtttgggctgagtctggttctttttcgtggtggtacttaagtttttaaaagggtcgttaccgaggttggtggtagggttggtaaggtttggttagggaggttcgggtagggggggtacgtcccgggtttcgggggttcccgggggcccccgggggggttcctaggacggtaccttctcgtagtggtcgcgacgtccgttgtggtacttcaacttaactttaacgtaacgaagttcggactaggttcggtaggttcggaccgtcccggccgacggcgtaccgggaagggggacgggtcgtggggaaggttcgggtccgtccggttcgggttaggtggggtacgtcggtacgtacgaacgtacacgtttaccgtacggccggtaccgtcggtacggtaacgggtcgtactaccgtaacctactaccgtacgtaacgggttaccctttaacgaacgaaaccggtacgacgttaagaaccgtgttaacggaagtacggaacctaggtaccgtaaggcgtacggtaacgaccggaccttacggtccttttaagtcgtaggtacgaacggttaaggtaggttcgttaacggcggttaaccgacgttgttaccgtcccgtacgtggtaacgacggtcgggccgaaccgggtctcgtccggtacc

SEQ ID NO: 153761 - DNA, 865 bp, Homo sapiens
  misc_feature: GYAE6OF01E3G17.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggtcttattttaaaaggtgtccagtgtgaggtgtaagttgttggagtcgtgggggagtccgtttgggttccggggccccggggggtccctggagtaccgtctctagtgtgccgagtcctcgtggtacttaccaacttaacttttaaactaacctaaagtcggacctaagttggtacggtttcgggccttccccgaccgtaaggccgtacccgaaggggaacggggcgttcggggagggttcggggtccgtacccgttacggggttaagggtcggggtaggtcggaccttaaccgaaacctaccgtaacgtttccgtaaccggggtcggggtccccgttaccgggtacggaaaccggggtcccgtaacctttcccgaaaccccgtattacccgttaacccgtaaacgggttaacccctttttaacccgaaacgtaaacccgtaacccggtaccgttaacggtaaacgttacgttaaacgggaaaacgttacggaaaccgttacgtaccggttaggtacggaacggttaccggaacccgtaacccgtaaccgggttaccccttttaagtttacgttacggttacggtaacgaaggttaacggttacgtacgttacgggaccgtaacgtacgttaccgtcccgttcgtttaggaaccgtaaggtacgggaccgaaccgggtacccgtcggtcccgtaccccg

SEQ ID NO: 153762 - DNA, 779 bp, Homo sapiens
  misc_feature: GYAE6OF01AV7NV.24.59.F04.1.454.CMB.1.raw
tcagactactatgtcacgaccggtgctcgatttagtacacacacttagggattgggcacagcgtggacatgagggtccctgctcagttcctgggcctcctgctgctctggctctcaggtgccatatgtgacatccagatgacccagtctccatcctccctgtctgcatctgtgggagacagagtcaccatctctgccaggcagtcgagggcattactactttgtaattggtatcatacaaaaccaggacaacgggaccctaaactcctacggtacaacggatgcactccaagtcgggtcgaccgaccggggccccactacgtaacggttcaggccggacaggtagaactcgtagggtactacgtttccttccgtaccctttccaaccctactccgaacggtccgggtccctacggaccgacggcccgttacgggtagggtaacgtttcggggtttacggaccttaacgtaacgtttaacctttaaccgtttacggttaaaccctaaaaaccgtaatttaacgttaacggtaaacccggttaagtttaacgttacggtttaacccggtttaacccggttttttaaccggggaacccgggttaaacgggggggtaaccggggtaaacggggttacgggtaaccggtaccgggtaaaccggtaaaacccgggtaaaccgttacggggttcgggttacccggttaccgacgtaaacccgttacctttcgtttaccgggtttccttaaccggttaccctttaccccgttcccccggttaacccc

SEQ ID NO: 153763 - DNA, 802 bp, Homo sapiens
  misc_feature: GYAE6OF01ETN39.24.59.F04.1.454.CMB.1.raw
  modified_base (135)..(135): a, c, t, g, unknown or other
  misc_feature (135)..(135): n is a, c, g, or t
  modified_base (187)..(187): a, c, t, g, unknown or other
  misc_feature (187)..(187): n is a, c, g, or t
  modified_base (634)..(634): a, c, t, g, unknown or other
  misc_feature (634)..(634): n is a, c, g, or t
  modified_base (708)..(708): a, c, t, g, unknown or other
  misc_feature (708)..(708): n is a, c, g, or t
  modified_base (739)..(739): a, c, t, g, unknown or other
  misc_feature (739)..(739): n is a, c, g, or t
tcagactactatgtcacgaccggtgctcgatttagtacacacacttagggattgggcacagcgtggacatggagggtccctgctcagctccgtgggcctcctgctgctctggcttctcgaggtgctatagtggtntacataccgaagtagtccgaccctagtccttaccacttccctcccgttgtcncgactacgttcggttggtagggacgagtacggtacgtaccacgtacttccgttccgttacgaccgagggtacggtacgacggtaccggtaactaagtttttaaccgttagtttacgttaagttagtacctaagaaccttaaacaaaaacgggcggtaacccggtaacccggtaaccttaaccgtccggtaacgactaaacggtactccggaatacccggtacgtaacgggttccggccgaaccggtcccggaaccgttagaccgtacggtagacccgggagaacggttaacggacgtttaccggtggttaaccggtactttccttacgttacccgtactaaaccacggtccacggtcggtcctacgcgttacggaccagttcgggaacgttggtacgacggtaactaagttacttaacgtacggtataaacgtaaatcgtaaggtanacttagtttacggtacgtttaaccgtagggttaccgggaacgttacggggaaccgtaagggtccgaaccgttanaaacccgggtaacgtcggttacgtacccggnttacccgaaccgttcgttacccttcggtttaactaccgtttacccctacggttcccgtacccc

SEQ ID NO: 153764 - DNA, 913 bp, Homo sapiens
  misc_feature: GYAE6OF01BE2NZ.24.59.F04.1.454.CMB.1.raw
tcagactactatgtcacgaccggtgctcgatttagtacacacacttagggattggggtctgagagaggagcccagccctgggattttcaggttgttttcatttggtgatcaggactgaacagagagaactcaaccatggtaggtttgggctggagcgttggttcttttttcttggtgggtacttaagtttttaaaaagggtcgtcctaggtggtggtagggtggtaaggtttggttagggagttcggtggggggacgtccggtttggggttccggggtccccgggggggttccctggacgacgttccgtctagttggtacggtcacgtcccgttcgtagggtactttacaacttaacttttaaacctacgtaaagtcggtacctaagttgggtaacggttcgggtcccttccccggaccgtacggggtcccggtacccgggaaaggggggggtaaccgggggtccggtagggggtacgggttcgggggtccgtcccgggtttagggtttacgggtgggggttacggtcgggaccttaacgaaacgtactacgtttccgaccgggcgggtccgtacccggtagggaaccggggtccgtaacgttcccgaaccgttacgttacccgttaacccgtaaacggtttaccctttttaacccggaaaacggaccgtaacccgtagttaaacgtaaccgttaacggtaagggtaaacttcggaaacgtagttaccggtaggaacgtaacggaccggtaaccgaccgttacccggttaccttttaagttacgttaggtacggtaaggtaacgggttacggttagtcggttaccgggtacgttacggtcgtttaccgtcccgttacgttacggaaacgttacgggcggggtacccgaaccggttaccgtccggtctacccgg

SEQ ID NO: 153765 - DNA, 761 bp, Homo sapiens
  misc_feature: GYAE6OF01ET4AG.24.59.F04.1.454.CMB.1.raw
  modified_base (120)..(120): a, c, t, g, unknown or other
  misc_feature (120)..(120): n is a, c, g, or t
  modified_base (170)..(170): a, c, t, g, unknown or other
  misc_feature (170)..(170): n is a, c, g, or t
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
tcagactactatgtcacgaccggtgctcgatttagtacacacacttagggattgggcacagcgtggacatgagggtccctgctcagctcctgggcctcctgctgctctggctctcaggtnccatatgtgacatccagatcgacccagtcctccactccctccctgtctcnctntcgtggagggganacaggtactccaacctnttccgttcttcggcccgtagggcgtacgtccgacggacttaacttaacgtttacttttaggtaaagttgtactaccaactaaccgaaaaaccggcggaaccgtaaccggtaacccttaaacctccggtacgtaaccgaacgtagacgaccttacgtaccgtaacggtccgggtaccgacccggtccggggaaccctaaggtacgtaaccggtaccgacgggtacccggagtaaggtacgtacgtcgtacgggtacttacctttccttaaccgacccttacacccgtacgtacgacggtcccggccgtcggaccgtcgtacgtacggacgttagtcgtacggcctaacttaagttaccgttagtcgtaactaaacgtaccgtagaacgttacgtaagttagttaacgttccgttaacggtttcggaaaccgggtacgggtaaggtacgggtacggtaaaccggtactaaacggaaacggttacggtccggtacgtcggtacccgtacaaccgtttcctcctttaccggtcctttaaccgtcccgtcccggtttaacccc

SEQ ID NO: 153766 - DNA, 666 bp, Homo sapiens
  misc_feature: GYAE6OF01DMJI1.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctcctgtcctgcatcgtgtgggagacagacgtcaccatctcttcgccaggcgagtcagggctaattaactactttagtaaattggtactcaataaccaaaaaccgagacgaacggacctaaactccgtaggtacaacgagtcgacactaccaaggtccgggtagccgacggggaccccagttacgaaggtcacggcggacgagtagtacgtcggtacgggacttactttacgttacctaccttacaccgtactaccgaggtccggtccgtgacgtacgccgtacgggtagggtacttgggtaccgacgtaacgtaacttacgttaacgttcgtaactaagaaacttgaacggtaactataagttacgttacgtttacggtttcggacgggtaaacggggtaacgtagggtacgggaactaccgtaaaccgtaaacggtaaccgttggtaccggtactcggacctaaccgtctttaccggttcttaccgttcctcgtttccccgttaaccccg

SEQ ID NO: 153767 - DNA, 609 bp, Homo sapiens
  misc_feature: GYAE6OF01B1ZJD.24.59.F04.1.454.CMB.1.raw
  modified_base (215)..(215): a, c, t, g, unknown or other
  misc_feature (215)..(215): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggcttttctgtggctattttaaaaggtgtccagtgtaaggtgaagttgttggagtctgggganccttgggttccggcccgggggtcctgagactctcactgtgcagcctctggattcactatttaacacaatggcatgagttggctccgcaggctccgagggaaggctggagtggtcgcctcggttaggtgggagtggctacgaacactattctacggcggctaccggtggaacggccgaattcaccgattccgtaccgaaggtacctttaccgaaacgaacacgtctagtaactcgtaggtaaatgaactagtctagagtagtacgacgacaccgtaccttattattgtagacgaaggtacgggttactagtcggtccgtaataggttacctcccgtactttggacgtaagtcggggtacccacggggtaacccctggtcccgtaccggttacccg

SEQ ID NO: 153768 - DNA, 786 bp, Homo sapiens
  misc_feature: GYAE6OF01AD0V4.24.59.F04.1.454.CMB.1.raw
  modified_base (548)..(548): a, c, t, g, unknown or other
  misc_feature (548)..(548): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatcgacccagtcctccactccctccctgtctgcatcgtggtgggacgacagacgtccacctactcttcttcggcccgagggacgaggtacgaggggacctaacgttttaacctttacgttttagttaaagtttggtaactaccaacttaaaccgaaaaaacccggagggaacccggaaaccggggtaaccccttaaaccgttaccgttacgggtaaccaaaccggtagtaccggacctaactacccggtaaccgggttccggggtaccgggaccccgggaccggggtaccccctacgtaccggtaacgggttacgacgggaccggacgtaaggttacgtacgttacgggtacgggtaccttacgtttaccttacccttaccttacccactacgtaccgacggtcccggccncgtccgacgtccgtgggtagtgttgtacgactaacttattacgttacgtactaactaactaagttacgaagtaacgtaatttacgttacgttaaccgtttacgggttaccggggaccgggtaacggggtaacgggtagggtacgaccgtaccgaaacgtaacggacggttacggtacgtacgtaccgaccgtacttacgttaccgttacttaccttccgttccgttccccgtaccccg

SEQ ID NO: 153769 - DNA, 791 bp, Homo sapiens
  misc_feature: GYAE6OF01BM12O.24.59.F04.1.454.CMB.1.raw
  modified_base (392)..(392): a, c, t, g, unknown or other
  misc_feature (392)..(392): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggtagtttgggctgagctggtctttttcttgtggcttaattttaaaaggtgtccagtgtgaggtgaagttgtggagtcgtggggatccgttggttccgggcccgggggtcctggagtactctcagtgtcgcgacgcctcgtggtacttccaacttaattttaaaccaacaatcggactatgtacggttggcctccgcgacggccgtaccggaaggggacgggcgtagggacgtcgggtcggccgtttcgggttaggngggtacgtcggtactaacgaacgactagttaccgtaccggcgggtccgtacggtaacggtaacgggcctagttaccaccgtacgttacctaccgtaacgttaccgtttaaccaacgtaaccacgtacgtaagtaactacgtaacggtaagtacgtaaacgtacgttacgtacgtaacggtacgtaccgaaccggtaacccgtaccggttacccgtttaagtttacggtttacgtaacgtaacggtaacggttaacgggttaacgttaacggttaccgggtaaccggttaacgtaaccggtttaccgtaccccggtttaccggttacggtaaccggttaacgggtaccggggtacccgggtaacccgggtaacccggttaccgggtcccgttaaccccgg

SEQ ID NO: 153770 - DNA, 864 bp, Homo sapiens
  misc_feature: GYAE6OF01AFL7O.24.59.F04.1.454.CMB.1.raw
  modified_base (136)..(136): a, c, t, g, unknown or other
  misc_feature (136)..(136): n is a, c, g, or t
  modified_base (182)..(182): a, c, t, g, unknown or other
  misc_feature (182)..(182): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccntggatttgggctgagctgtcttttctggtgtcttagttttaaaggngtccagtgtgagggtgtaagttggttggacgtcgtgggggatccgtttggggttccgggcccggggggtcctggacgtactctctagtcgtcgcacgtccctgtaggtattccacttaacgttttaaccacaagttcggcctaggttagtaacggttcggacccttcccggaccttacgggccctacccgggaaagggtaacgggggtccgttaagggtccggttcggggtacccgaccccggtttagggggttaggtcggggtaaggttcccggtacctaaaccggaaacttaccgtagtttcccgtaacggggccgtccgtttcggacggggaacggtcccgtattccgaccctagtccctaccgtaacgggttacctttaaccgaactaaccggtactcggtaacgtacgttaacggacggtaaacgtaacgggtaacgtaacggttcgtacgtaacggtacggacgtaacccgggtacctaccccggggttaactttttaccgttaagtttcggtacgggttaacggtaaaacgggttcgggtttaaacttaccggggttacgggtaccccgggttaacgttaacggttttccccgtaccccggtttaccggttaccggtttaaccgggaccggtttacggggacccggtaaccggggtacccgttcggttaaccccg

SEQ ID NO: 153771 - DNA, 819 bp, Homo sapiens
  misc_feature: GYAE6OF01DUUR0.24.59.F04.1.454.CMB.1.raw
  modified_base (186)..(186): a, c, t, g, unknown or other
  misc_feature (186)..(186): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagactcgacccagtctaccactcccttccctgtctgcatcgtggtaggganacagacgtccacctattcctcgttcgcccgagggacgtacgtcggacgggtactaaacttttaacttaacgttttaagttaaagtttcggtactacgtaacgtaaaccgtaaaaaccgacggtaaccgtaaaccgggtaacccttaaaccgttccgtacgtaacaaccgtagtacgacctacgtaccgtaacggtccgggtaccgcccggaccgggtaccctacgtacgtaacggtcgacggacgtacgtaggtacgtacgtacgtacggtaccttacctttccgttacctaccctttacccgaaccttaccgtcggtaacggtcccggtacctacgggaccgtaacccggtccgtagggtaggttacgttcggttaaccgaaccttacgttaacgttactttaaccggtactaaacgtaaacgtaagtactaagtaacgtagttacgtacttacgtttacgggttaccgggaacgggtacggggtaaccgtagggtaaccggtacgtaacccgttaaaccggaaacgttacgggttaccgggtagttaccggtacctacccgttaacggtaccgttttacccgtttacgtttacccgttttaacccgttaccccgtacccggtttacccccg

SEQ ID NO: 153772 - DNA, 879 bp, Homo sapiens
  misc_feature: GYAE6OF01DKI1P.24.59.F04.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
tcagactactatgtcacgaccggtgctcgatttagtacacacactttagggagttggggtctgagagaggagcccagccctgggattttcaggtgttttcatttggtgatcaggactgaacagagagaactcaccatggagtttgggcctagagcgtggtcttttctagtggtctattttaaaaggntcagtgtgagtgaattgtagngtacgtgggagccgttcggtcggtcccggggtcccggtntacggactacttcagtagttcgtacgactacctaccgtggtattacactaaactttaaacgttaaaccaaaagtcggtaccgtaagtacggtacgtttaggtcccgttccccgtaccgacggtaccgttaccgacgggaaagggtcggtacggaggttcgggtaccgtccgtacggtttacggagggtaacgtcggtaccgttaacgaacgtaaccgtaagtttacgtacccggtacggggtcgtacccggtaggtaacggggaccggtaacctttacgaaccgtaactacccgttaaccgtaaacggttaaacccttttaccgaaacgaacgtaaacgtacccgttaggtaaactacgtacggttaaaagtacgttaaacgaagttcccgtaaggtaacgaaccgtttacggacccgtaaaacggtccgttaaaccccgttttaagtttacgttacggttacggtaacgttaaacgggaacggttttaaccgtaaaggttcccgggtaaccgggtaacgtaaaaccggttttaccggtaccccgtttacgtttaacccggttaggaaaaaccggttcgggggttaaacccgaaaccggggtaaaccccgttgggtaccccgttaaacccgg

SEQ ID NO: 153773 - DNA, 874 bp, Homo sapiens
  misc_feature: GYAE6OF01A8PUP.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggtcttaagttttaaaggtgtccagtgtgaggtgaagttgttggagtcgtggggagtccgttggtccgggcccgggggtccctgagactctctatgtgacgacgtccttcgtggtacttcaactaattttaaacacaacgtcggactagttgtaggttcggtcctcccggaccgtacgggtccgtaccggaagggggaacggggtcgtaggggtacggttcgggggtaccgtcccgggttagggttaagggtcggggtaagttcggaccgttaaccaaccgtactagtttacccgacggtccgggtccgtaccgggtaggtaaccgggtccgtacttaccgacctactaccgtacgtaacgttacctttaccgaacgtaaccgtacgtctaacgtaacgtaccgtaggtaaacgtacgtaacgtacgtacggtacgtaaggtaaccggtacccggtaacggtaaccgtaacccggtttacccgttttaagtttaacggttacggttaacggtaaccgggttaaaggttaacggggtttaaccgtaaacggtttcccgggtaacccgggttaaacccgttaaccggttttaacccgggttacccggtttacccggtttaaccgggtaaaccggtaaacggggttaccggggtaaaccccgggtaaacccgggtaaccccgggttaccgggttacccccgttaaccccgg

SEQ ID NO: 153774 - DNA, 706 bp, Homo sapiens
  misc_feature: GYAE6OF01BXOL9.24.59.F04.1.454.CMB.1.raw
  modified_base (540)..(540): a, c, t, g, unknown or other
  misc_feature (540)..(540): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtctttttcttggtggacttattttaaaaggtgtccagtgtgaggtgtaagttgtggagtcgtggggatccgttggttccgggcccgggggtccctggacgactcgtcagtgtcgcgacgtcctcgtaggtacttcaactaatttaacaacctaagtcggctaagtggtaggttcggccctccggccgaggccgtaccggaggggaagggtccgtgggagggtcggtccgccgttgggttaggtgggtagtcggactaacgactacgtacttccgacggtccggaccttcggacggacggtccgtattccaccgtattccgtaccgtaacgttactttaccgaacgtaccgacgtcgtagaacgttgtaacggtaactagtaacgngtacgtaggacgtacggaccgtacgtaaccgtaccggttacctttagttagtggtacggtaacggtaaggttacggttagtacgtcggtaccgtacgttacggttacgtcccggttaccgttacgtaacggtacggcgggtacggaacggaccgtcgtcgtacccg

SEQ ID NO: 153775 - DNA, 1141 bp, Homo sapiens
  misc_feature: GYAE6OF01BUYLS.24.59.F04.1.454.CMB.1.raw
  modified_base (1007)..(1007): a, c, t, g, unknown or other
  misc_feature (1007)..(1007): n is a, c, g, or t
tcagactactatgtcacgaccggtgctcgatttagtacacacacttagggattgggcacagcgtggacatggagggtccctgctcagcctcctgggcctcctgctgctctggcctctcgaggtcgccattagtgacgacactaccagacgtcgaccctagtcctacctacgtccctcccgtgtcctgacacttgtcggtagggagacgagacgtccaccgtatccttcgtcgaccgagccgtagtcgaggactaacttaaccgttactttaagttaagtttcgaacttacaaacgttaaaccgaaaaaccggtacggaaccggtaaacccgggtaaccccttaaaccggttccccggtaacggtaacctaaaccgggtgttaccggtaactaacccggttaaacccgtaacgggtttcccgggggtacccgaaacccggggtaacccggggtacccgtaaacgtaccggggtttaaaccgggttccgggaaccgggtaccccgggttaaagttaaaccgggggtaacgtttaccgggtaacggtaaaccgggttaacgttttaaccctttacccgtttaaccccttaaccgttaacccgaaaccccgttaccgttacccgggtaacccgggtacccggttacccggtacccgggtaaacccggtaccgggtaacccgggttaagggggtaaaccgtttcggggtttaacgggttaaccgggaaaccctttaaaccggtttaaaactttttaacccgggttaaacccgtttaaaccggtttaaaacccgtaaaacggttttaaacgggtttacccgggtttaaaccgttaaaccgggtttaaacgttttaaccgggtttaacccgtttttaaagggggttttttaacccccgggttttaaacgggggggaccggggggtttaaaaaaccgggggttcggggttaaccgggttaacgggttaaaaccccggtaaaccggggttaaaaccccggttttaaaacccggggnggggttttaaaaccgggtcccggggtttaaaccgaccccggtttaaaacccggtaccctaccccgggtttttaaccgggttaccctttaacccggtttacccgttttcccccggtttaaacccccggaccccgg

SEQ ID NO: 153776 - DNA, 627 bp, Homo sapiens
  misc_feature: GYAE6OF01AJWKI.24.59.F04.1.454.CMB.1.raw
  modified_base (120)..(120): a, c, t, g, unknown or other
  misc_feature (120)..(120): n is a, c, g, or t
  modified_base (308)..(308): a, c, t, g, unknown or other
  misc_feature (308)..(308): n is a, c, g, or t
tcagactactatgtcacgaccggtgctcgatttagtacacacacttagggattgggcacagcgtggacatgagggtccctgctcagctcctgggcctcctgctgctctggctctcaggtnccatatgtgacatcagatgacccagtctccatccctcctgtctgcatcgtggtagggagacagacgtcaccatctcgttcgccgaggcgagtacgagggactaacttaacttaacgttttagtaagtttaggtactacaataacaaaaccgaggacgaaccggtacctaactaccgtaggacaacgtntacacgactacgaagtcggcgaccggaccggtacccagtacgtaacggtacgacggcggagaggtagtacgtacgtacggtactactttctaccgtaccttacacctacgtacgacgtaccggacttcgacgtacgtccgtaggacgttagtacgtcgtacattaacgttactagtacgtactaatatacgtagacgtattacgtacgttacgtacgttacggacggtaagggacggtaggtacgtacgacgtacgaaaccggtagcggtacgacgacgacctacctagtcgtactttactacttccggtccctacccg

SEQ ID NO: 153777 - DNA, 726 bp, Homo sapiens
  misc_feature: GYAE6OF01AS7UN.24.59.F04.1.454.CMB.1.raw
  modified_base (351)..(351): a, c, t, g, unknown or other
  misc_feature (351)..(351): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggtagtttgggctgagcgtcgtcgtttctaggtcggactaagttttaaaggtgtcagtgtgagtggagttgtggacgtcgtggggagccgttgggttccgggcccgggggttcctgacgactctcagtgtgcacgctcgtggtacttcaactatttaacagaatggtacatgaggtcgtcctccgcacggtcctacggaggggacggtcgtagggnggtcggtccgtcgtggtacggtggtagtcgactaacgactactactcgtaccgggcgtacgtcgtacggaacgggtcctattacccgactactcccgtaaccgtaacgttaacccgtttacgaacgaaccgtactacgtacgtaacgttacgtagtaaacgtacgtaacgtacggtacgttaacggacgtaggtaccgacgaaccgttacccgttaccgttttagttacggttacggtacgtaacggtaacggttacggttacgttaaggtaccggtaccggtacttacggttaccctacccggttccgttaaggtaacccggtagggtacccggggtaccgaaccgggttaccccggtacggttcccgtcccgg

SEQ ID NO: 153778 - DNA, 800 bp, Homo sapiens
  misc_feature: GYAE6OF01EKIM1.24.59.F04.1.454.CMB.1.raw
  modified_base (438)..(438): a, c, t, g, unknown or other
  misc_feature (438)..(438): n is a, c, g, or t
  modified_base (679)..(679): a, c, t, g, unknown or other
  misc_feature (679)..(679): n is a, c, g, or t
tcagactactatgtcacgaccggtgctcgatttagtacacacacttagggattggggtctgagagaggagcccagccctgggtattttcgaggttgttttcatttggtgatcgaggactgaacagagagaactcacatggtaggtttgggctggacgtcgttcggttcttttttcgttggtcggtacttttaaagtttttaaaaagggtcgttaccgtagtggttaggaggttaggtaagtttggttggaggttcgggtgggggtacgtccggtttcggggttcccggggtccccggggggtcctggtacgtactctacgtgtgtcgacgtcgtcctcgtggtacttacctaacttaacttttaacaacgtagtggactagttggtacggtcgtacccgcccgcggaggccgtaaccggggaggggggtacggtcggngggtagggttccgggtccgttccgggttacgggtttagggtcgggtaggttaccggtaacttaaaccgaaagtacccttacggtttaccggaaccggaccgggttcccggttaacgggtacgggaacccggttacggtacgttcccaaaccgttcttaccggtaaccgtaacgttacccgtttaaccgaaacgtaacgtacgtacgttaacgtaagtacgtaagaacgtactaacgtcgtnacggtagcgtacgacgtactaccgttcttagttagtcgtagtaacggtagtacgtacgtgtacgacgtacgtcgtactccggtgtacgcggtacggtcggaaccgtagtccgtgtctcccg

SEQ ID NO: 153779 - DNA, 656 bp, Homo sapiens
  misc_feature: GYAE6OF01AMTG4.24.59.F04.1.454.CMB.1.raw
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (190)..(190): a, c, t, g, unknown or other
  misc_feature (190)..(190): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
tcagactactatgtcacgaccggtgctcgatttagtacacacacttagggattggggtctgagagaggagcccagcccctgggattttcaggtgtttcatttggtgatcaggactgaacagagagaactcaaccatgggagtttgggctggagcgtgtgttcaggcgtctaattaaggncngngtgagtntatgtcgngtcgngggctcgtaggtccgggccggtcngcgtcncgtacngtgtcgcacgctacgtgtanctagtattacganagcgtatgtagtgtcgtcccgtacgtcgacggtcgacggtacgggcgtaggacgcggtcgggttcgtccggtaaggtggtagggtaccggtntaccgtanaacctagtcgtacggccgacgtacgacggtagacggtcctataccgtacncggtactcgtaagtacctaacacatcgtactgtaactagtaacgagtacgtacgtatacgagtaccgtacgtaaccgacgttccgttaaccgtgtttaagttacgtcgtaagtaccgggtagttaacgtaacgtttccgagggttaccgaacggtttcgtacccgtttacccgttcgggtaccggtcggaaccgggttacggtaccggaccggtttaaacgccgtccgtacccg

SEQ ID NO: 153780 - DNA, 894 bp, Homo sapiens
  misc_feature: GYAE6OF01E5GGN.24.59.F04.1.454.CMB.1.raw
  modified_base (649)..(649): a, c, t, g, unknown or other
  misc_feature (649)..(649): n is a, c, g, or t
tcagactactatgtcacgaccggtgctcgatttagtacacacacttagggattgggggtctgagagaggagcccagccctgggatttttcaggtgtttttcatttggtgatcaggactagaacagagagaactcaccagtggtagtttgggctgagcgttggttctttttcgtggtggtacttaaagttttaaaaggtctaccgtagtggtaggaggttagtaaggtttggttggaggttcggtcggggggacgtcccggtttcggggtcccggggtcccccggggggttcctaggacggtacttccgtacgtagttcggtgaccgacggtccgttcgtacggttacttaccaacttaactttaaacctaacgaagtcgacgttagtacggtacgggtcgtcccgtaccggacccggtacggtccggtacccgggaaaggggggacgggtccggttaggggtacgggttacgggttcccggtacccggtttaggggttagggtagggtacgggtaggtaacctaacgaaacctacgtacgttcccggacgggtccggtacccgtacgggtcggaaccgggtcctaacgttcccaacgttctaccgtaaccggtaacggttaccctttaaccgaaaggtccaacggttanaacggtaacttaagggtaaagtaacgtacgaacgttacggtacgacggtaaggttccgaaccgggttacacccggttaccggttaccttttaggttacgttggaccgtaaggggaagtttaaccggcgttaccgggtaccgggtaaccgtcgttacgttaccccgttcccggttaggttaaccggaacgggttacggacccgggtacccggttaaccggtacccggttcgtccccccggttaccg

SEQ ID NO: 153781 - DNA, 866 bp, Homo sapiens
  misc_feature: GYAE6OF01BDNZS.24.59.F04.1.454.CMB.1.raw
tcagactactatgtcacgaccggtgctcgatttagtacacacactttagggattggggtctgagagaggagcccagccctgggtattttcaggttgttttcatttggtgatcaggactgaacagagagaactcaccatggtagtttgggctgagcttggttctttttcttgtggtacttaagttttaaaaggtcgtccagttgtggtagggtgtaagtttggttggagttcggtgggggtactccggttttcgggttccccgggggtccccgggggggttcccctggaaccgtccttctctagttggtcgaccgtcgccttcgtaggttactttacctaacttaacttttaaaccgtaactaagttcgggtactaagttacgggtacggttcggtcccgtccccggaccggtacggggtcccgtacccgggaaagggggtaacggggtcctgggggacgggttcgggtaccggtcccgttaggggttacggtggggtaaggtccgggtacctaaaccgtaaaccctacttacggttttccgacccgggtcgggtccgttacccggtaggaacccgggtctacgttaccgaccctacgttacccgtaccgttaacgtaccttttaccgaacgtaaccgtacgtacgtacgtaactacgtaagtaactacgtaagacgtagtacgtacggtaacgtacgtaaccgtaaccggtaaccgttacctttacgtttagtacgttacggtaacggtaacggtaacggttaggttaccgttcgggtaccggtacgttaaccgttaccttccccgttaccttacggaagtacccgggtcgggtaccggaccggttacccgtcggtacccgtaccg

SEQ ID NO: 153782 - DNA, 646 bp, Homo sapiens
  misc_feature: GYAE6OF01B8XD6.24.59.F04.1.454.CMB.1.raw
tcagactactatgtcacgaccggtgctcgatttagtacacacacttagggattggggtctgagagaggagcccagccctgggattttcaggtgttttcattttggtgatcaggactgaacagagagaactcaccatggagtttgggctgagctggtctttttcttgtggctattttaaaaggtgtccagtgtgaggtgaagttgtggagtcgtggggagtccgttgggttccgggcccggggggtccctggacgacgtctcgatgtgcagcctcgtggtattcaactatttaactaacaagtggacatgagttcggctccgccaggcctccggaggggaagggcgttttgggaggtcgggtcgtccgtcgggttaggtggggagtggctacaactacattacacggcggctccggtgaacgggccgtaattccactatcctaccgaacgtaccttttaccgaaacgtaaccaacgcgtagaacttacgtaggaaactaggaacacgtctaggagaggtaccgacgacctaaccggtcctttagttagttgtagtacggaagtacggttactagtacggtaccggtagtcgttactcccgtcgttacgaacgtaggtcgggaccgacggacccgtggtccgtacccg

SEQ ID NO: 153783 - DNA, 972 bp, Homo sapiens
  misc_feature: GYAE6OF01CEQ94.24.59.F04.1.454.CMB.1.raw
  modified_base (202)..(202): a, c, t, g, unknown or other
  misc_feature (202)..(202): n is a, c, g, or t
  modified_base (484)..(484): a, c, t, g, unknown or other
  misc_feature (484)..(484): n is a, c, g, or t
tcagactactatgtcacgaccggtgctcgatttagtacacacacttaggagttggggtctgagagaggagcccagccctgggattttcaggttgttttcatttggtgatcgaggactagaacagagagaactcaaccatagggagtttgggctagagtcgtggttctttttcgtgtaggtacttaaagttttaaaacgggtnttaccgagtggtaggtaggtaggtaaggtttggtcgggtagtcggtaggggggtacgtccggttcggggttccggggcccgggggttaccgtagacggtaactcctaatacgttgacggtctacggtccttacgtcggttaacttaccgtaaactaacttttaaacgagtaacgtgtaaccgtaaagttggtaacggttcggacccgtaccgtaccgcggacgttccgaaggggtacggtcgtagggtacgtccgggtacgtaccccggttgggttaagggngggaaggtccggtaactaacttaacggacttaacgttccggacggtaacccggtcggttaccggtaagggtaacccgggtaaccctacggtaactaaccccgtaactacccgttaaccgggtaaaccttaaccggtttaaccgtaaaccggtaaacccggtaccgtaaccttaagtaaccgggttaaaccgtaaaggtaacgtttaagggaaaccccttaaaggttacgtaacgggtttaggaaccggttaaccggaaccggtaacgttaacccgggtttaaactttaaccgttacggttagttaacggtaaacgggtaacgggttaggttaaaccttacgggttacccggtacccgggttaaaacggtccttttaacccgggtcccggttacccgtttaaacggggtaaacccggtttaggggtaaacccgggggttaccggtaaacccggggttaacccggtccgggttccccggttaacccccgg

SEQ ID NO: 153784 - DNA, 860 bp, Homo sapiens
  misc_feature: GYAE6OF01D8S8O.24.59.F04.1.454.CMB.1.raw
  modified_base (217)..(217): a, c, t, g, unknown or other
  misc_feature (217)..(217): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctaattttaaaaggtgtccagtgtgaggtgagttgtggagtcgtggggntccgttgggttccgggcccgggggtccctgagactcgtcatgtgcagtcctcgtggtattcactaatttaacacaagtgctatgagttcgccgtcccgcgacggtccgtaccggtaagggggaacggggtcgtgggtacgggtcggggttaccgtcccggtttgggttaaggttggggtaggtcgggtacctaaaccgaaacctaccgttaacgttcccgtaaccggggcccgggtcgttacccgggtaagggaaacgggtcccgtacctttaccgaaacccgttacgttcccgtaaccgtaaacggttaccctttttaaacccggaaacgtaaaccgtacccggtacgtaacggtaaacgttacccgtaaagggtaaactaaggtaaacccgtacggtttaaccgtagggtaaccggtacgttaaccgggaaccgtaaaccccggttaacccggtttaacccgttttaacggttttaggttaccggttaaggtaaccgggtaaaagggttacgggttaacgttacgggtttaccggtaaccccggttacgtaacggtttacccgtccccggttacgttaccggtaaacggtaccgggtacggggacccggtaaccgggacccgttcggtacccgtaccccgg

SEQ ID NO: 153785 - DNA, 785 bp, Homo sapiens
  misc_feature: GYAE6OF01D24OD.24.59.F04.1.454.CMB.1.raw
  modified_base (191)..(191): a, c, t, g, unknown or other
  misc_feature (191)..(191): n is a, c, g, or t
tcagactactatgtcacgaccggtgctcgatttagtacacacacttagggattggggtctgagagaggagcccagccctgggattttcaggttgttttcatttggtgatcaggactgaacagagagaactcaccatggtagtttgggctgagcgtggtctttttcgtgtggtacttaagttttaaaaggtntacctagtgtgaggtagtaagttggtggacgtcggtagggggacgtccgtttgggttccggggccccggggggttaccctggtaacgacctcttacgattggtcgacagtcctgtgtacttacaacttaatttaacaacaattggactagtagtggttcggcctccccggacacgggtccgtacgggaagggggtaacgggtcgtaggggtacggttcgggtacccgtaccggtttggggttaaaggtcgggggtaacgtccgggtactaaaccgaacgtaaccgttagtttacccggaccgggcgggtttccctaacggggtcggaacggggtcctaacgttacccaaccgtacgtaccgtaccgtaacggtttaacctttaccgaaacgtacacgtacgtactagtacgtaaggaatacgtactagtacgtaggagtacgtaccgacgaaccgtccgttacctttattacggtttgtagtaacgtaggtaacggttacgtagttaccggacgtacgtacggtttaccctcccggttagttacgacggtaagggtcccgggaaccgtaccgggtacccgttgcccgttacccg

SEQ ID NO: 153786 - DNA, 931 bp, Homo sapiens
  misc_feature: GYAE6OF01D92CY.24.59.F04.1.454.CMB.1.raw
  modified_base (198)..(198): a, c, t, g, unknown or other
  misc_feature (198)..(198): n is a, c, g, or t
tcagactactatgtcacgaccggtgctcgatttagtacacacacttagggattggggtctgagagaggagcccagccctgggattttcaggttgttttcatttggtgatcaggactgaacagagagaactcaccagtgggtagtttgggcttgacgcgttggttcttttttcttgtcggtacttaagttttaaaaggngttccagtgttggaggttagtaaggtttgttgggtagttacgtagggggggtacttaccggtttcgggttccggggtccccggggggtccctggacgtactcctatagttgtcacgtaacgtccttcgtaggtactttacaacttaaatttaaacccgttaagaaacgttaggaccttaaagttaggaaggtttacggtaccccgtaccggtaccgtacgggtacccgttaaccgggtaacggggggtaacggggtaccggttacgggtaacgggttccgggggttacctaccgggtttacggggtttaagggttcggggtaacggttggtaaaccccttacggtaaaacctaacgtttccgttaaccgggttaacccggggccgggtaccccggtttaacgggtaacggggtaaccgggggtacccttaacggtttacccaaaccgtttacccgttaaacggttaaccccggttaaacggtttaaacccgtttaaccgtaaacggtaaaccgtaaccgtaacgttaacgttaaacttcggtaaacgggaaactaacgtaaacggtacgttacgtaacgtaacgggtacggtacgaccgtaacccgtacgtttacccgttttaattacgtggtacgtaacgtaacgggtacgttagtacgtacggtacggtacttcgtaacgtcccgtagtaccgagtaacgtcgggaacgtaccggaacgtcggtctacccg

SEQ ID NO: 153787 - DNA, 705 bp, Homo sapiens
  misc_feature: GYAE6OF01CQL7J.24.59.F04.1.454.CMB.1.raw
  modified_base (184)..(184): a, c, t, g, unknown or other
  misc_feature (184)..(184): n is a, c, g, or t
  modified_base (390)..(390): a, c, t, g, unknown or other
  misc_feature (390)..(390): n is a, c, g, or t
  modified_base (545)..(545): a, c, t, g, unknown or other
  misc_feature (545)..(545): n is a, c, g, or t
  modified_base (666)..(666): a, c, t, g, unknown or other
  misc_feature (666)..(666): n is a, c, g, or t
  modified_base (675)..(675): a, c, t, g, unknown or other
  misc_feature (675)..(675): n is a, c, g, or t
tcagactactatgtcacgaccggtgctcgatttagtacacacacttagggattgggcacagcgtggacatggagggtccctgctcagctccgtgggcctcctgctgctcgtggctctcgaggtcgcctatagtgtcgacactaccgagactcgacccacgtcctccactcctcctgtctgactntcgtggaggacgacgacgtacgtaccactactctcgtcgacgacggcgtacgtacgacggtaacttacttaacgttagttagtaagttcgtatacaactaacgaaacgagaaccgaaccgtacctacgtcgtacgacaagtacgtacgactacgtacgtacggtcgggtccgaccggtaaccggaccgagtaccggtacgtacggnggaccgtagtacggtagacgtacggtagtaccttcttacctaccgttaccctacgtactacgtcgcggtaccgcgtcgtacgtcccggtgtaacgggtacgtcggttcgtacggtaactacgttaacgttaccttgtaaccgtaaagacgttaanacggtaacgtaatacgtttaaccgttacgttaccgggtttacgggtcgggaaagggttacggaacgggtacggtacggtactaaccggacggttaagtgggtcgtacggctacccgacgtnttacccgtnttaaccctccgtacctacccggttccgtac

SEQ ID NO: 153788 - DNA, 833 bp, Homo sapiens
  misc_feature: GYAE6OF01ATGR1.24.59.F04.1.454.CMB.1.raw
  modified_base (239)..(239): a, c, t, g, unknown or other
  misc_feature (239)..(239): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
tcagactactatgtcacgaccggtgctcgatttagtacacacacttagggagttggggtctgagagaggacgcccacgcccgtgggtattttcgaggttgttttctagtttggtgatcgaggactagaacagagacgaactccaccagtggtaggttggctgacgtcgttggttctttttcgttggtagtactttaaagttttaaaggtcgtcgagtgtggtaggtagtagttggtggngtggtgggcgtcgttcgggtccgggccgggtcngagctctngtgcgcgcgtcctgtcgtactactaacttaacttaaacgatagtcggactagtacggtcgttccggccgtccgccggtaccggtccggtacggggaacgggggtacgggtcggtgggtacggggtcggttccggtccgggtttacggggttaggtacggggtacgtacggtaacctaaccgaaccgtacgtaccggtaccggtaccgggtaccggtcccggtaccgggtaacggtaaccgggtaccgtaacctacccgtacttacgtacccgttaaacgttaaccgtttaccctaaaccgaacgtaaccgtcggtactaaacgtaacgtagtaaacggtaaactcgaaacgttcgtgaacggtacgtaacgacccgaaccggttaaccgttaccgtttactttagtacggtacggaacgtaaggtttaaggttaccgtagttacgggtaccggtaaccggttacgttacccgttacccgtcggttaaccggttaacgggaacgtccggggtaaccgggtacccggaacccggttccggttacccgtcccggcc

SEQ ID NO: 153789 - DNA, 799 bp, Homo sapiens
  misc_feature: GYAE6OF01AWKQM.24.59.F04.1.454.CMB.1.raw
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccactccctccctgtactgcatcgtggtgggagacagtagtcacctatctctcgccgaggcgagtcgagggactattaacgttactttagtaaattggtatcataacaaaaaccagacgaacggacctaaacctctaggtacaacgntcgacactaccaacgtcggngcccgacgggccccancgtaggtcaggcggcagtagacgtcgtaggactacttcgttaccaccttacacctactcgaccggtaccgtccgtacgaccgaccgtacccgtagggaacggttacgttacgggttacgggtaccttaaacgtaattttaaccgtttaaccgtttacggtaacccgttaaaaccgttaaacgttaacggttaaccggtaaacgtaacggttttaaacgtaaccggttttaacccggtttaaccgggtttttacccgggggaacccgggttaaagggggggtaaacccggttaagggggtaaccgggttaaccgggttaaccgttaaacccggtaaaaacccgggttaacggttacccggggttaccgggttaacccgttaccggaaccccgttaaccgtaccgtttacccggtttacgtttaacccgtttacccgttaaccccgttttccccggtttaaccccccgg

SEQ ID NO: 153790 - DNA, 788 bp, Homo sapiens
  misc_feature: GYAE6OF01BVRBB.24.59.F04.1.454.CMB.1.raw
tcagactactatgtcacgaccggtgctcgatttagtacacacacttagggattgggcacagcgtggacatggagggtccctgctcagctccgtgggcctcctgctgctcgtgctctcgaggtcgctatagtgtgactactccagataccgacccacgtcctacctacttcccttcccgtcgtctcgctacttcggttgggtacggggaagaacgaggacgtaccaacctactaccgttaccggttaccggcccggggaccttaacgggtaccgtagggttacggtttcgtttccgtcggtccggttcgggggtcgtccggttagtcacgacgaaccggaaacgaaaccggaacggtaaacccgtaacccttaacgttacgtagtacttacgtaaggtacggttaccgtttactttaacgtttaacggtaccgggttcggttacccgttaacggttaacgtcggacggtacggtcgtaggtgacggttacggaggtaactaacgtacttcgtaccgtactacgaactactacgactacgtcgtacgtacgactacgtacgtagttactttggttaactttcgttaactttaacgtactaacgttacaaccgttacgtagttacgtacttacgttacgttacccgttacccctacccgggttccggttaacccggggaggtacccggtaacgaccgttagaaccgttaacgttaactagggtaccttacggggtcttaccgcgacctccttacgtatttacgttcttaccttacttccgttaccctcccg

SEQ ID NO: 153791 - DNA, 505 bp, Homo sapiens
  misc_feature: GYAE6OF02H8AQI.24.59.F04.1.454.CMB.1.raw
  modified_base (154)..(154): a, c, t, g, unknown or other
  misc_feature (154)..(154): n is a, c, g, or t
  modified_base (174)..(174): a, c, t, g, unknown or other
  misc_feature (174)..(174): n is a, c, g, or t
  modified_base (178)..(180): a, c, t, g, unknown or other
  misc_feature (178)..(180): n is a, c, g, or t
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (189)..(191): a, c, t, g, unknown or other
  misc_feature (189)..(191): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (212)..(213): a, c, t, g, unknown or other
  misc_feature (212)..(213): n is a, c, g, or t
  modified_base (217)..(217): a, c, t, g, unknown or other
  misc_feature (217)..(217): n is a, c, g, or t
  modified_base (222)..(223): a, c, t, g, unknown or other
  misc_feature (222)..(223): n is a, c, g, or t
  modified_base (228)..(229): a, c, t, g, unknown or other
  misc_feature (228)..(229): n is a, c, g, or t
  modified_base (233)..(233): a, c, t, g, unknown or other
  misc_feature (233)..(233): n is a, c, g, or t
  modified_base (238)..(241): a, c, t, g, unknown or other
  misc_feature (238)..(241): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggngtgttctaggcgcattaagncagnnngtnatntgnnngggnctgtgcgggtcngancnnatgncagcnngatcnnttancatgnnnntgntcncngncngaggctgngngtgcngtgtggngngnanacacatctcgcgcgtcgtgacggcgactcacactctactacgtacttactaacgaacacgctagatacgtagtaagtagaacatacgtagagagtacgacgacgacgtaccttacttattgtagtacgaagtaaggtacgtagtacggtacgtacgtacgtacgtccgtccgttacgtacggtacggtacgggtaccggtacggtaccggtacggtacgtaccg

SEQ ID NO: 153792 - DNA, 610 bp, Homo sapiens
  misc_feature: GYAE6OF02H1V13.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtcgtttctaggtcggctattttaaaaggtgtccagtgtgaggtgaagttgttggagtctgggggagccttggttcggcccgggggtcctgagactctcagtgtgcagcctctggattcacatttaactacaatggcatgagttggctccgccaggctccaggggaaggggctgggagtgggtcgcctcggttagtgggagtggctacgaacacattctacgcgggctccgtgaagggccgattcaccatctccaaggacttttccaagaacacgctgaatctgaaatgaacagtactgagagtacgacgaaccgacggccccttttattaagttgtagccgtaaaagagggtttaactagtacgggtccggtaacgagtttacgtccccggtcctttttacgacggtaaacgttcggggacccgtacggggtaaacccgtggttccgtaacccgg

SEQ ID NO: 153793 - DNA, 553 bp, Homo sapiens
  misc_feature: GYAE6OF02FTF33.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaggtgtccagtgtgaggtgaagttgttggagtctgggggagccttggttcggcccgggggtccctgagactctcatgtgcagcctctggattcacatttaactacaatggcatgagttggctccgccaggctccgagggagggctggagtgggtcgcctcggttagtgggagtggctacaacacattctacgcgggctccggtgaagggccgattcaccatctccaaggtactttccaagaacacgctgaatctaggaaatgaacagtctgagagtcgacgacacggcccttttattattgtgcgaaagtgggttactagtggtccggatgttatcccgtctttagacgagtcggggccagggaccctggtcaccgg

SEQ ID NO: 153794 - DNA, 483 bp, Homo sapiens
  misc_feature: GYAE6OF02IY2NR.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccaggggccccatcaaggttcagcggcagtagatctgggacattcttcaccttcaccatcagcggctgcagcctgagatgttgcacatattactgtcaacaatatgacgatatgtacacttttggccgaggggacgaaggtggagctacgaaacgacgtgtggctgcaccatctgtcttctactctcccg

SEQ ID NO: 153795 - DNA, 172 bp, Homo sapiens
  misc_feature: GYAE6OF02I98Q0.24.59.F04.1.454.CMB.1.raw
  modified_base (165)..(172): a, c, t, g, unknown or other
  misc_feature (165)..(172): n is a, c, g, or t
tcagactactatgtcacgaccggtgctcgattagtacacacacttaggattgggtctgagagaggagcccagccctgggatttcaggtgtttcatttggtgatcaggactgaacagagagaactcaccatggagtttggctgagcgggctggcaaggcgcatagnnnnnnnn

SEQ ID NO: 153796 - DNA, 569 bp, Homo sapiens
  misc_feature: GYAE6OF02ILER9.24.59.F04.1.454.CMB.1.raw
  modified_base (400)..(400): a, c, t, g, unknown or other
  misc_feature (400)..(400): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttgggttcggccggggggtccctgagctctcatgtgcagcctctggattcacatttaactacaatggcatgagttggctccgccaggctccgagggagggctggagtgggtcgctcgggttagtgggagtggctacaacacattctacgcgggctccggtgaagggccgattccaccntcctccaacggtacttttaccaagaacacgctgaatcgtaggaaatgaacagtctgagagtcgacgacacgtcctttatattgtgacgaagtaggttatagtacggtccggactacgttactcccgtactttggacgtaagtcggggaccgacgggacccgtggtaccg

SEQ ID NO: 153797 - DNA, 557 bp, Homo sapiens
  misc_feature: GYAE6OF02HB92K.24.59.F04.1.454.CMB.1.raw
  modified_base (217)..(217): a, c, t, g, unknown or other
  misc_feature (217)..(217): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggacgttttcttgtggctattttaaaggtgtccagtgtgaggtgaagttgtggagtctggggancttggttcggcccgggggtcctgagactctcatgtgcagcctctggattcacatttaacacaatggcatgagttggctccgcaggctccgagggaagggctggagtgggtccgcgtcggttagtgggagtggctacaacgacattctacgcgggctccgtggaacggccgattcaccatctccaaggtctttaccaagaacacgactgaatctaggaaatgaaacagtcagagagtcgacgacacggtcctttatatgtgcgaaagtggtactagttggccgagtagttactcccgtcttcgacgtacgtcgggaccgagggtacccgtggtcgtacccg

SEQ ID NO: 153798 - DNA, 566 bp, Homo sapiens
  misc_feature: GYAE6OF02I663L.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggcgttttctaggtggctattttaaaaggtgtccagtgtgaggtgaagttgttggagtctgggggagccttggttcggcccgggggtccctgagactctcatgtgcagcctctggattcacatttaactacaatggcatgagttggctcgccaggctccagggaagggctggagtgggtcgccgtcggttagtgggagtggctacgacacattctacgcgggctccgtgaagggccattcaccatctccaaggactttccaagaacacgctgaatctaggaaatgaacagtctgagagtcgacgacgacggtacctttattattcgtagcgaaagagggttactagtggtcggtacgacgttatcccgtcctttgacgtaacgtgggaccgagggacccgtggtcctacccgg

SEQ ID NO: 153799 - DNA, 533 bp, Homo sapiens
  misc_feature: GYAE6OF02F22SS.24.59.F04.1.454.CMB.1.raw
  modified_base (153)..(153): a, c, t, g, unknown or other
  misc_feature (153)..(153): n is a, c, g, or t
  modified_base (174)..(174): a, c, t, g, unknown or other
  misc_feature (174)..(174): n is a, c, g, or t
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (214)..(215): a, c, t, g, unknown or other
  misc_feature (214)..(215): n is a, c, g, or t
  modified_base (227)..(227): a, c, t, g, unknown or other
  misc_feature (227)..(227): n is a, c, g, or t
  modified_base (229)..(229): a, c, t, g, unknown or other
  misc_feature (229)..(229): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (245)..(246): a, c, t, g, unknown or other
  misc_feature (245)..(246): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
tcagactactatgtcacgaccggtgctcgatttagtacacacacttagggattgggtctgagagaggagcccagccctgggattttcaggtgttttcatttggtgatcaggactgaacagagagaactcaccatggagtttgggctgagcggngtgttctaggcgcattaaggntcagtntgagtgagtgtgatnggnctgtgccgggcngagnntcatgtgcagcncngntncntactacatgnntgtgtgtcncgcgcgcgcgaggaggngtgngtgtcgcgtcgtgtggtgtgcacacactactcgtacgcgtcgtcgtcgacgacgtactcactactcgtacgtacgtacttactaacgacgacgactagtatacgtagaagtagacgagtcgtagagacgtacgacgacgtacgtacgttacgttagtgtagtacgtaagtacgtacgtagtacgtacgtacgtacgtacgtccgtcgttacgtacgtacggtacggtaccggtaccggtaccgtacgtaccgtaccg

SEQ ID NO: 153800 - DNA, 525 bp, Homo sapiens
  misc_feature: GYAE6OF02IY25K.24.59.F04.1.454.CMB.1.raw
  modified_base (249)..(249): a, c, t, g, unknown or other
  misc_feature (249)..(249): n is a, c, g, or t
  modified_base (296)..(296): a, c, t, g, unknown or other
  misc_feature (296)..(296): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagactactatgtcacgaccggtgctcgatttagtacacacacttagggattgggcacagcgtggacatgagggtccctgctcagctcctgggcctcctgctgctctgtctctcaggtgccatatgtgacatccagatgacccagtctccatcctccctgtctgcatctgtgggagacagagtcaccatctcttgccaggcgagtcagggcattaactactttgtaaattggtatcaatcaaaaaccnggcaaacgggcctaaactcctaggtcaacgatgcatccaatcgggtnccagggcccatcaaggttcagcggcagtacgatctgggacagttcttcaccttcaccatcagcggctgcagcctgagatgtgcacatattacngtacaacaatntagacgattatagtactacgttttggaccctaggggaacaaggtgaagtctacgaaacgaaccgtggtacggcttacggacctaaccgaacttcgtagtttcctttactacttcccgttccccgg

SEQ ID NO: 153801 - DNA, 647 bp, Homo sapiens
  misc_feature: GYAE6OF02FXJ5X.24.59.F04.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtcgtggttctaggtcggctaatttaaaggngtcagtgtgaggtgaagttgttggagtctggggganccttggttcggcccgggggtcctgagctctcatgtgcagcctctggattcactatttaacacaatggcatgagttgctcgcaggctccgagggagggctggagtggtcgccgtaggttaggtgggagtggctaacaacactatttctacggcgggtctccggtggaagggtccattccaacctactcctaccgtaacgtactttaccaacgaacgacgtactagtaacgtacgtagtaagtagtaacgtacgtacgtagagacggtacgaacgaaccgtaccggttaccgtttacgtttacgttagttacggtaacggtaaaggtaacggttacgttacgtacggtacggtacgtaacgttacgttccgtaccgttacgtacggtacggtacgggtaccggtaccggtaccggtacggtaccgtaccg

SEQ ID NO: 153802 - DNA, 580 bp, Homo sapiens
  misc_feature: GYAE6OF02HQPUS.24.59.F04.1.454.CMB.1.raw
  modified_base (154)..(154): a, c, t, g, unknown or other
  misc_feature (154)..(154): n is a, c, g, or t
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggngtgtttctaggcggctaatttaaaggngtcagtgtgagtgaagttgttggagtctggggganccttggttcggcccgggggtcctgagctctcatgtgcagcctctggattcactattttaactacaattggcatgagttgctccgccagctccagggagggctggagtgggcncgtcggttagtgggagtggctacaacncattctacgcggctccgtgaacggccgattccacatctaccaagacttttcaagaacacgactgaatcgtaggaaactgaacagtgtagagatcgacgacgacgtaccctttatattgtgacgaaagaggttactagtggtccggtacgtaggttactacccggtccttttacggacgtaacggttcgggaccgtaacggggaacccttcgggtactaaccccgg

SEQ ID NO: 153803 - DNA, 627 bp, Homo sapiens
  misc_feature: GYAE6OF02F8SIY.24.59.F04.1.454.CMB.1.raw
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggcttttcttgtggctattttaaaaggtgtccagtgtgaggtgaagttgttggagtctgggggagccttggttcggcccgggggtccctgagactctcatgtgcagcctctggattcacatttaactacaatggcatgagttggctccgccaggctccgagggaaggggctggagtggcgcgtcgttggtggnggtggtcgactaacacactctacgcggcgcgtcgaggacggactcaccactctccacgacgttccttacgaacacnctgaatactcgaagtaagtacgaagtcgtgagagtacgtaccgacgtaaccgtacccgtttacctttagttacgttgacgtaaacggtaagggttacgttaacttagggtaccgggtaccggaacgttaacgtttacccgtcccgtttacgtacggaacggtacggggtaccgggaccgggtaacccggtaccggtcggtaccccg

SEQ ID NO: 153804 - DNA, 574 bp, Homo sapiens
  misc_feature: GYAE6OF02GOR37.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctgagactctcatgtgcagcctctggattcacatttaactacaatggcatgagttggctccgccaggctccgagggaaggggctggagtgggtcgccgtcgggttaggtgggagtggctacaacacattctacgcgggctccgtgaagggccgattcaccatctccaaggtactttccaagaacacgctagaatctaggaaatgaacagtctgagagtcgacgacacggtccctttattattgtgacgaaagtagggttactagtcggtccggacgtagttactcccgtcctttcggacgtagtcggggaccgagggaccctcggtcgtacccg

SEQ ID NO: 153805 - DNA, 590 bp, Homo sapiens
  misc_feature: GYAE6OF02GLYLV.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtcgttttctaggtggctattttaaaaggtgtcagtgtgaggtgaagttgttggagtctgggggagccttggttcggcccgggggtccctgagactctcatgtgcagcctctggattcacatttaacacaatggcatgagttggctccgccaggctccgaggggaaggggctgggaggtgggtcgccgtcgggttagtgggagtggctacgaacacattcacggcgggctccgtgaacgggccattcgacatctacaaggtactttaccaagaacacgctgaatcgtagaatgaacagtctagagagtcgacgacgacggtcccttttattagttgtagacgtaaaggtagggttactagttcggtaccggtatagttactcccgtacgtttacgacgtaagtcggggaccgacgggacccttggtacctacccgg

SEQ ID NO: 153806 - DNA, 493 bp, Homo sapiens
  misc_feature: GYAE6OF02FYPXM.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccaatctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccagggccccatcaaggttcagcggcagtagatctgggacatttcttcaccttcaccatcagcggcctgcagcctgaggatgttggcacatattactgtacaacaatatgacgtattatgtactacgttttcggaccgagggggaacaagggtgagctacgaaacgacgtgtggctgcacatctgtcttcatccttcccg

SEQ ID NO: 153807 - DNA, 492 bp, Homo sapiens
  misc_feature: GYAE6OF02H2DSB.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggcaagggccctaaactcctggtcaacgatgcatccaatcgggtgccaggggccccatcaaggttcagcggcagtagatctgggacatttctcaccttcacatcagcggctgcagctgagatgttggcacatattactgtacaacaatatgaacgtatatgtactacgttttggccgaggggacgaaaggtggagctacgaaacgactgtaggctgacaccatctgtcttctactcttccccg

SEQ ID NO: 153808 - DNA, 487 bp, Homo sapiens
  misc_feature: GYAE6OF02IJ9S2.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaatcctggtcaacgatgcatccaatcgggtgccaggggccccatcaaggttcagcggcagtagatctgggacatttcttcaccttcaccatcagcggcctgcagcctgagatgttgcacatattactgtacaacatatgacgatatgtacacttttggccaaggggacgaaggtggagctacaaacgacgtgtggctgccacagttctgtccttcactcttacccg

SEQ ID NO: 153809 - DNA, 483 bp, Homo sapiens
  misc_feature: GYAE6OF02F5EYC.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggcaagggccctaaactcctggtcaacgatgcatccaatcgggtgccaggggccccatcaaggttcagcggcagtagatctgggacattcttcaccttcaccatcagcgcctgcagcctgagatgttggcacatattactgtacaacaatatgacgatatgtacattttggccaggggacgaaggtgagtctacaaacgacgtgtggctgacacatctgtcttcatccttccccg

SEQ ID NO: 153810 - DNA, 760 bp, Homo sapiens
  misc_feature: GYAE6OF02GPQ6R.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgcgttttctaggtggctattttaaaaggtgtccagtgtgaggtgaagttgttggagtctgggggagccttggttcggcccgggggtccctgagactctcatgtgcagcctctggattcacatttaactacaatggcagtgagttgctccgcgagctccgagggacgggcgtggaggtcggtcgtccgttcgggttaggtgggagtggtacctaacgaacactacgttacgtaccggccgggtccttccggtacgggaacggggtaccgtacgtttacccgaccgtacttacccgtaccgtaacggttacccttttaccgaaacgtaaaccgaccgtacgtagtaaacgttacgtaaggtaaactacggaaactagttaccgtaggtaaggtacggtacggaaccgtaaccgtacccgggtttaacccttttaagtttacgttttacgggtacggtaacggtaaagggttaacggggtttaaccttagggttaccgggttacccggtacgttaacggtttacccgttacccggttaccgttttaacggaaccgtaacggtccggggtaccggaaccggggtaaccccgttcgggtacccgtaccccgg

SEQ ID NO: 153811 - DNA, 574 bp, Homo sapiens
  misc_feature: GYAE6OF02IYK82.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctgagactctcatgtgcagcctctggattcacatttaactacaatggcatgagttggctccgccaggctccagggaagggctggagtgggtcgcctcggttagtgggagtggctacaacacattctacgcgggctcgtgaagggccgattcaccatctaccaagtacttttaccaaagaacacgactgaatctaggaaatagaaacagtctagagagtcgacgacacgaccctttattattgtgcgaaagtagggttactagtggtaccggacgtacgttactcccgtctttcgacgtaacgtcggggaccaagggtaccctggtcctacccgg

SEQ ID NO: 153812 - DNA, 686 bp, Homo sapiens
  misc_feature: GYAE6OF02HGDCU.24.59.F04.1.454.CMB.1.raw
tcagactactatgtcacgaccggtgctcgatttagtacacacacttagggattggggtctgagagaggagcccagccctgggattttcgacggtgttttcatttggtgagtcaggactgaacagaggagaactcgaccatggagtttgggctgagctggcttttctacgtggctacttttaaaaggtgtcccagtgtgagtgaagttgttggagtctggggagccttggttcggcccgggggtccctggaggactcgtcatgtagtcgagcctctggtattcgtacatttaactacctaattcggaccaagtagacgttaggccttccgaccacggcctccgagggaacggggctggaagtgggtcgtccgtccggttagtcgggagtggacgtagaacacagttcgtacgcgggctccggtggaacggccgtatccacctactctaccgaacggtacttttccgaagtaacacgctacgaacttctaggaaactagtaacgtagtacgtagagtagtaccggacgtaccgtaccggtacccgtttagttacgttacgtacgtacggtaaaggtaacgggttaactacgtacgggttaccggaacgtacggttaccgtacccgtccgtttacgaccgtaaggttccgggaccgtacgggtaaccccttaggtcccgttaaccccgg

SEQ ID NO: 153813 - DNA, 572 bp, Homo sapiens
  misc_feature: GYAE6OF02IP94W.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtctgggggagccttgggttcggcccgggggtcctgagactctcatgtgcagcctctggattcactatttaactacaatggcatgagttgctccgccaggctccgagggagggctggagtgggcgcctcggttagtgggagtggctacaacacattcacgcgggctccggtgaagggccatcaccatctaccaaggtacttttaccaagaacacgctgaactctaggaaatagaacagtctgagagtcgacgacacggtaccctttattattgtgtacgaaagtaggttactagttggtccggtactagttactcccgtccgtttacgacgagtcggggaccgacgggacccgtggtccgtacccg

SEQ ID NO: 153814 - DNA, 486 bp, Homo sapiens
  misc_feature: GYAE6OF02GP2LO.24.59.F04.1.454.CMB.1.raw
  modified_base (403)..(403): a, c, t, g, unknown or other
  misc_feature (403)..(403): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggcaagggccctaaactcctaggtcaacgatgcatccaagtcgggtgccgagggccccatcaaggttcagcgcagtagatcgtgggactattcttcaccttcaccatcagcgctgcagcctgagtagtgttgcacatatactgtacaacaatangacgatatagtactagtttcggacgtaggggacgtaaggtggagctacaacgactggtgctgcacatctgtctcatcctcccg

SEQ ID NO: 153815 - DNA, 696 bp, Homo sapiens
  misc_feature: GYAE6OF02HPSWE.24.59.F04.1.454.CMB.1.raw
  modified_base (174)..(174): a, c, t, g, unknown or other
  misc_feature (174)..(174): n is a, c, g, or t
  modified_base (235)..(235): a, c, t, g, unknown or other
  misc_feature (235)..(235): n is a, c, g, or t
  modified_base (330)..(330): a, c, t, g, unknown or other
  misc_feature (330)..(330): n is a, c, g, or t
  modified_base (391)..(391): a, c, t, g, unknown or other
  misc_feature (391)..(391): n is a, c, g, or t
tcagactactatgtcacgaccggtgctcgatttagtacacacacttagggagtttggggggctctggaggagaggagcccagcccgtagggatttttcacggtgtttttcgatttgggtcgatcaggactccgaacagagtagaactcaccatggagtttgggctgagcggtgngtttctaggcgctatttaaacggctcgagtgtgaggtcgaagttgtaggacgtgtgggganccttgggttccggcccgggggtcctgagctctcaactaaagtcgctagtcctcgtacggattaccataatttaacaacgaacgtcggccagtggnggttggcctcgcgacgcgtaccgagggaacggcgacggcggtgggtccaccgtgggttagnggtagtcggtacacgtacacgtattcgaacggcgtctcggtcgtaacggccgtatccgaactcgtcgtaccgacgggtacgtttacgaacgtaacgagtacgtagaacttacgtagtaacgttaacgaactaagtaccgtaggtaagtaggttacgaccgtaacgtacccggttcgtttaaggttacgttcggtaacggtacgtaaacggttacggttacgtacggtcggtaccggcgttacgttaccgtacccgtcgttaccggccgtacggtacggccggtacggtacccgtacggtaccccg

SEQ ID NO: 153816 - DNA, 620 bp, Homo sapiens
  misc_feature: GYAE6OF02H80ID.24.59.F04.1.454.CMB.1.raw
  modified_base (429)..(429): a, c, t, g, unknown or other
  misc_feature (429)..(429): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggctattaactatttgtaaattggtatcatacaaaaaccaggcaagggcctaaatcctggcaacgatgcataccaatccgggtgcccaggggcccctatccaaaggttcgaagcgggacagtacgagtctgggacactttcttacacctttcaaccatccacgcgcctggcaagccctaggacgagtgttaggcactataatacttgtacaacaaatatnaacgtataaacttggtacctaacgttttttcggacccgagggggggtaacctaaagggggtaccgggaggtaccttacccgaaaacggtaaacccgtttagggtacgggtacccgtggttacccccgaaacgtaacttaaccccgggtttcgttccttttaacccgacgttttccctttaacccccccggg

SEQ ID NO: 153817 - DNA, 561 bp, Homo sapiens
  misc_feature: GYAE6OF02H6NSR.24.59.F04.1.454.CMB.1.raw
  modified_base (250)..(250): a, c, t, g, unknown or other
  misc_feature (250)..(250): n is a, c, g, or t
  modified_base (296)..(296): a, c, t, g, unknown or other
  misc_feature (296)..(296): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaaccnggacaagggccctaaatcctggtacaacgatgacatccaatcggtnccacggggccccatcaacggttcaggtcggcctagtagactcgtgggactattcttcacctttcactatcagcgcctgcagcctgagatgttgacacatattacngtacaacaattangaacgattactagttactacgttttcggaccgtaagggggaccgtaaagggtcggtaacgacgttaaccgaaacgtaaccgtggttacgggtctacggtacctaccgtacgttccgtgtttccgtttactaccttccgttacccccg

SEQ ID NO: 153818 - DNA, 578 bp, Homo sapiens
  misc_feature: GYAE6OF02HEOZA.24.59.F04.1.454.CMB.1.raw
  modified_base (218)..(218): a, c, t, g, unknown or other
  misc_feature (218)..(218): n is a, c, g, or t
  modified_base (405)..(405): a, c, t, g, unknown or other
  misc_feature (405)..(405): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtgtttctaggtggctaattttaaaggtgtcagtgtgaggtgaagttgttggagtctggggganccttggttcggcccgggggtccctgagactctcatgtgcagcctctggattcacatttaaactacaagtggcatgagttggctccgcaggctccagggaagggctggaggtgggtcgccgtacgggttagtgggagtgggctacaacgacattctacgcgggtctccgtgaagggccagttcacctntctaccaaggtactttccaagtaacacgctagaattcaggaaactgaacagtctgaagtgtacgacgacacggccctttattattgtagcgaaagtgggttatagtggtccgagtagttactcccgtcttcgaagtacgtacggggcccaaggggtacctcggtcctacccgg

SEQ ID NO: 153819 - DNA, 785 bp, Homo sapiens
  misc_feature: GYAE6OF02H4JOD.24.59.F04.1.454.CMB.1.raw
  modified_base (621)..(621): a, c, t, g, unknown or other
  misc_feature (621)..(621): n is a, c, g, or t
  modified_base (629)..(629): a, c, t, g, unknown or other
  misc_feature (629)..(629): n is a, c, g, or t
tcagactactatgtcacgaccggtgctcgatttagtacacacacttagggagttgggcacacgcgtggacatgagggtccctgtctcagctcctgggcctcctgctgctctggctctcaggtgcctagtatgtgactatccagatgtacccagtctccatcctccctgtctgacatcgtggtgggagacgagagtccaccattcgtcttcgaccgaggcgacgtcacgggctaagttaactacgtttacgtaaagttggttactacctaataaccgaaaaaaccgaggaccgaaaccgggtaccccttaaaacgtcccgttagggttaccgaaaaccgtacttaccggacctaacgttacccgaaaaggttccggggttacgacccggtaccgggggtcccctaagttaccggtaaacggttttcccgaacggtccgggtacgtaacgggttaacgtaacggtttccgggttaagggaaccttaacgttttaccgttaccgtaacccgtttccgaaccgtaacgttaccggaaccggtcggttacccgtcgaaccgacgtccgtaacggtaagtacgtagttacggacctaacgtaattactaacggttacttaaccgaanaacgttanacgtagtattaccgtagttacgtaacgttcggaccgggttagaacggtaaggtacgtaggtaacctaaccgggaaacgtaacggtcgggtacggtacgtacggtaacctaccgtacgttacgtccggtttacttccggtacccttccgttaacccg

SEQ ID NO: 153820 - DNA, 567 bp, Homo sapiens
  misc_feature: GYAE6OF02GP5KY.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggctttttcttgtggctattttaaaaggtgtccagtgtgaggtgaagttgttggagtctgggggagccttggttcggcccggggggtccctggagactctcatgtgcagcctctggattcacatttaactacaatggcatgagttggctccgccaggctccagggaaggggctgggagtgggtcgccgtcgggttagtggggagtggctacaacacatttctacgcgggctccggtgaagggccgattcaccatctccaagactttccaagaacacgctagaatctaggaaatgaacagtctgagagtcgacgacacgccctttatacgttgtgacgaaagtagggttactagtcggtcgacgtagttactcccgtctttgacgtagtcgggaccagggaccctggtctacccg

SEQ ID NO: 153821 - DNA, 647 bp, Homo sapiens
  misc_feature: GYAE6OF02IY1FT.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagccttggttcgggcccgggggtcctgagactctcatgtgcagcctctggattcactatttaactacaatggcatgagttgctccgcaggctccgagggagggctggagtgggtcgccgtcgggttagtgggagtggctacaacgacattctacggcgggctccggtgaacgggccgtattcaccatccgtaccgaaacggtacctttttaccgaacgtaaaccaccgtactacgaaacttctagggtaaaactcggaaacagttcgtagaaggagtacgacggacgaccggtacccttttagttagtttcgtagtacggtaaaggtagggttaacgtacgtacggttaccggacgtaaggtttacctcccggtcctttaggaccgtaagtcggggaccgaacgggtaacccgtcggtacccgtacccgg

SEQ ID NO: 153822 - DNA, 581 bp, Homo sapiens
  misc_feature: GYAE6OF02F9PD9.24.59.F04.1.454.CMB.1.raw
tcagactactatgtcacgaccggtgctcgatttagtacacacacttagggattggggtctgagagaggagcccagccccgggattttcaggtgttttcatttggtgatcaggactgaacagagagaactcaccatggagtttgggctgagcgtggcgttttctgtggctattttaaaaggtgtccagtgtgaggtgaagttgttggagtctgggggagccttggttcggcccggggggtccctgagactctcatgtgcagcctctggattcacatttaactacaatggcatgagttggctccgcaggctccgagggagggctggagtgggtcgccgtcgggttagtgggagtggctacgaacacattcgtacgcggctccgtgaagggccattcacatctcaaggactttaccaagaacacgctgaatctaggaaatgaacagtactgagacgtcgacgacgacggtaccctttattattagtgacgtaaagtacggttaactagtacggtcggacgtagtactcccgtcgttcgaacgtagtcgggaccgtacgggacccgtcggtaccgtacccgtccg

SEQ ID NO: 153823 - DNA, 625 bp, Homo sapiens
  misc_feature: GYAE6OF02G8VNC.24.59.F04.1.454.CMB.1.raw
  modified_base (154)..(154): a, c, t, g, unknown or other
  misc_feature (154)..(154): n is a, c, g, or t
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggngtgtttctaggcggctaatttaaaggngtcagtgtgaggtgaagttgttggagtcgtggggganccttgggttcgggccccgggggttcctggagactctcatgtgcagcctntgattccanatttaacacaagtgcatgagttcggctccgcaggcctcgagggaggtgngngtggcgcgtggtggtggngtgcacacactatcgtacgcggtcgtcgaggacggacgtactacacctactactacgtaacgtactttaccgtaacgaacgaacgacgtacgtagtacgtagaacgtaacgaacgagtacgtagagacgtacggacgacgtaccgtaccgttacttacgttacgtagtacggtaaacggtaacggttacgttacgtacggtacggtacgtacggttaccgttaccgtaccgttacgtacggtacggtacgggacggtacggtaccgtacggtacgtaccg

SEQ ID NO: 153824 - DNA, 597 bp, Homo sapiens
  misc_feature: GYAE6OF02GSI05.24.59.F04.1.454.CMB.1.raw
  modified_base (407)..(407): a, c, t, g, unknown or other
  misc_feature (407)..(407): n is a, c, g, or t
  modified_base (461)..(461): a, c, t, g, unknown or other
  misc_feature (461)..(461): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggctttttctgtggctattttaaaaggtgtccagtgtgaggtgaagttgttggagtcgtgggggagccgttggttcggcccggggggtccctgagactctcatgtgcacgcctctggattcactatttaactacaatggcatgagttggctccgcaggctcgagggagggctggagtggcgccgtcggtagtgggagtggctacgaacactattctacggccgggctccggtggaacgggccgtattccaccgntcctaccaaggtactttaccaagaacacgctagtagtaccgtagaaatagaacncgttacgtgagtatacggaacgacgaccgttccctttagttatgtgacgtaaagtacggttactagtcggtaccgacgtagttactcccgtcctttagacgtacggtggacccgacgggaccgttcggctacccgg

SEQ ID NO: 153825 - DNA, 564 bp, Homo sapiens
  misc_feature: GYAE6OF02F97RS.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctgagactctcatgtgcagcctctggattcacatttaactacaatggcatgagttggctccgccaggctccagggaggggctggagtgggtcgcctcgggttagtgggagtggctacaacacattctacgcgggctccgtgaagggccgattcaccatctccaaggtactttccaagaacacgctgaatctaggaaatgaacagtctgagagtcgacgacacggtccctttattattgtgacgaaagtagggttactagtggtccggactagttactcccgtcctttagacgtagtcggggaccagggaccctggtcctaccgg

SEQ ID NO: 153826 - DNA, 698 bp, Homo sapiens
  misc_feature: GYAE6OF02GPLV2.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccggggggtccctgagactctcatgtgcagcctcgtggattcactatttaactacaatggcatgagttggctcccgcaggctccgagggagggctggagtgggtcgccgttcggttaggtggggaggtcggctaacaacgtactagttcctacggcgggccttccggaggaacggggcccgattccacctactccgtaccgtaacgggtaccttttacccgaaacgtaaccaccgacgtacgaacgtacgtagggaaattacggaacgtaacgttcgtaggaggtacggtaccgaaccggaaccgaccgggtaccccttttaacgtttagtttcggtaggtaccggtaaaaggtagggtttacctagttcgggttacccgggaacttaacggtttaccgtcccgttaccgtttcggtaaccggtaacggtcggggacccgaacggggtaccccgtgggttaccccg

SEQ ID NO: 153827 - DNA, 587 bp, Homo sapiens
  misc_feature: GYAE6OF02FKHZ1.24.59.F04.1.454.CMB.1.raw
  modified_base (397)..(397): a, c, t, g, unknown or other
  misc_feature (397)..(397): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcgggcccgggggtccctgagactctcatgtgcagcctctggattcactatttaacacaatggcatgagttggctccgcaggctccgagggagggctgggagtgggtcgcctcgggttaggtgggagtggctacacacattcgacgcgggctcgtgaagggccgattcaccntctaccaggtactttccaagaacacgctagaatctaggaaatgaactagtctagagagtcgacgacacggtccctttattagttgtacgacgtaaaggtagggttaactagttcggtaccggtactacggttacgtcccgtacgtttacgacgtacgtcggggaccgtacgggaccctggtcctacccgg

SEQ ID NO: 153828 - DNA, 594 bp, Homo sapiens
  misc_feature: GYAE6OF02FY8JU.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccggggggtccctgagactctcatgtgcagcctctggattcacatttaactacaatggcatgagttggctccgccaggctccgaggggaaggggctgggagtggggtccgccgttcgggttagtggggagtgggctacaacacattctacgcgggctccggtgaagggccattcaccatcctccaaggtacttttaccaagaacacgcgtgaactcgtaggaaatgaacagtctgagagtcgacgacacggtcctttattagttgtgacgaaagtagggttactagtcggtccggtaactacgttacgtcccgtcgtttacggacgtaacggtacggggccgacgggtacccgtggtacccg

SEQ ID NO: 153829 - DNA, 619 bp, Homo sapiens
  misc_feature: GYAE6OF02GV5SD.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggcgttttctagtggctattttaaaaggtgtccagtgtgaggtgaagttgttggagtctgggggagccttggttcggcccggggggtccctgagactctcatgtgcagcctctggattcacatttaactacaatggcatgagttggctccgccaggctccgagggaagggctggagtgggccgcgtcggttagtgggagtggctacaacacattctacgcgggctccggtgaacgggccgtattccaccagtctaccgaagtaccttttaccaaagaaccaacgtctagaatctacgggaaatgaacgtagtactgtagagtacggacgaacgacggtcccttttaagtctttaggtgtaacggaaagtaacggttaactagtaggtaccggtacgagttacgtaccccgtctttacggacgtaacgtacggggcccaaggggtaacccgtacgggtctaccccgg

SEQ ID NO: 153830 - DNA, 683 bp, Homo sapiens
  misc_feature: GYAE6OF02IIKDC.24.59.F04.1.454.CMB.1.raw
  modified_base (284)..(284): a, c, t, g, unknown or other
  misc_feature (284)..(284): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtcgtgggggatccgttggttcgggcccgggggtccctgagactctcatgtgcagcctctggattcactatttaacanaatggcatgagttggctccgcaggctccgagggagggctgggagtgggtcgccgttcgggtagtgggagtggctacaacactattacgacgcgggcctcggtacggaagggtccctaattccaacctacgtcctaccgtaacggtaccttttacccgaaacgaacctacgcgtagaaactcgtaagaaatgaacgtagtactagagtacgtacgaaccgtacgtaacccggtcccttttaagttacgtttaggtacgaacggtaaaaggttacgggtttaacgttagtacgggttaccggacgttaacgttacccgttacccggttccgtttacggaaccggttaagggtaccggggtaccgtaaccggggtaacccggttcggtacccgttaccccgg

SEQ ID NO: 153831 - DNA, 508 bp, Homo sapiens
  misc_feature: GYAE6OF02H828F.24.59.F04.1.454.CMB.1.raw
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactacttgtaaattggtatcatacaaaaaccaggacaagggaccctaaactcctaggtcaacgatgcatccaatcgggtgccgacgggcccatcaaggttcagcggcagtagatcgtggacnttctcaccttcacatcagcgctgcngctgngntgttgacacatatactgtacaacgaatagtgacgattatagtactacgtttggacgtagggaacgaggtgacgtactacgaaacgtacgtgtacggctagctaaccgtcttcgtgttaccttctacttccgttacccg

SEQ ID NO: 153832 - DNA, 719 bp, Homo sapiens
  misc_feature: GYAE6OF02HNLOO.24.59.F04.1.454.CMB.1.raw
  modified_base (182)..(182): a, c, t, g, unknown or other
  misc_feature (182)..(182): n is a, c, g, or t
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcggtgtgttctaggtcggctatttaaaggngtcagtgtgagtgaagttgtggagtcgtgggngccttggttcggccgggggtcctggaagactctnagtgtgcagtctgtgtatcagtattaacgacagtcgatagtgtacgtgaccgtccgacgacggtccgtacggagggtaacgggcgtaggtaggtcgggtcggtcggttcgggttacgggtacgggtacggtcggtacgtaacgtaacgtaacgtacgttacgtacggtacggtacgtaccggtacggtacgggtacggtaccgtaccgtacgtaccgtaccgtaccgtaacggttaaccgttaaccgtaacgtaacgtacgtacgtacgtaacgtacgtaacgtaacgtaacgtaacgtaacgtacgtagtacgtacgtacgtaccgtaaccgtaccgtaccgttaacgttacgttacgtacgtaacggtaacggtacggttacgtacgtacggtacggtaacgtacgttacgtaccgttaccgttacgtacggtacggtacggtaccggtaccggtaccggtacgtaccg

SEQ ID NO: 153833 - DNA, 538 bp, Homo sapiens
  misc_feature: GYAE6OF02GK71N.24.59.F04.1.454.CMB.1.raw
  modified_base (296)..(296): a, c, t, g, unknown or other
  misc_feature (296)..(296): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggcaagggcccctaaactcctggtacaacgatgcatccaatcgggtnccgaggggccccatcaagggttcagcggcagtagatctgggacatttcttcaccttcacatcagcgcctgcagctgngatgtgcacntatactgtacaactaatatagaacgattatagttacctacgtttttcggaccgtaagggggaacgtaagggtaggagtacctacgaaacgtaacgttggtggtacgtacggaccaaccgtacttcgtcgttaccttactactccctttacccccg

SEQ ID NO: 153834 - DNA, 555 bp, Homo sapiens
  misc_feature: GYAE6OF02IFJ78.24.59.F04.1.454.CMB.1.raw
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtctgggggagccttggttcggcccgggggtcctggagactctcatgtgcagcctctggattcacatttaactacaatggcatgagttggctccgcaggctccgagggagggctgggagtgggtcgctcggtagtgggagtggcanacacattcacgcggctcgngaggcatcacatctcagctttacaacgacacgctgatctagaatagaacagtactgagagtacgacgacacggtcctttattattgtgacgtaaagaggttactagtacggtaccgacgtagttacgtcccgtccgtttacgacgaagtcggggaccgaacgggtacccgtcggtccgtacccg

SEQ ID NO: 153835 - DNA, 584 bp, Homo sapiens
  misc_feature: GYAE6OF02FKGHE.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaggtgtccagtgtgaggtgaagttgttggagtctgggggagccttggttcggcccgggggtccctgagactctcatgtgcagcctctggattcacatttaactacaatggacatgagttggctccgccaggctccgaggggaagggctggagtgggtcgccgtcggttagtgggagtggctacacacattctacgcgggctccggtgaacgggccgattcaccatcctccaaggtactttccaagaacacgctgaactcgtagaaatgaacagttctgagagtcgacgaacgaccgtaccctttattagttgtacgacgtaaaggtaggttactagttggaccggagtacgttactcccgtctttacgaacgtaggtcgggacccgagggaccctggtccctacccgg

SEQ ID NO: 153836 - DNA, 521 bp, Homo sapiens
  misc_feature: GYAE6OF02F1QZP.24.59.F04.1.454.CMB.1.raw
  modified_base (338)..(338): a, c, t, g, unknown or other
  misc_feature (338)..(338): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatcaaaaaccaggacaagggcccctaaaactcctggtcaacgatgcatccaatcgggtgccaggggccccatcaaggttcagcggcagtagatctgggacnttcttcaccttcaccatcagcggcctgcagcctgaggatgttggcacatattactgtacaacaatatgacgaatatagttactacgtttttgggaccgtaagggggaacgtaaagggttggaagccgtacgaaaccggaacgttggtggctcgacaccattctgttcttcactccttaccccg

SEQ ID NO: 153837 - DNA, 801 bp, Homo sapiens
  misc_feature: GYAE6OF02H9NW1.24.59.F04.1.454.CMB.1.raw
  modified_base (379)..(379): a, c, t, g, unknown or other
  misc_feature (379)..(379): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtcgtgggggagccgtttgggttcggcccgggggggtccctgagactctcatgtgcagccctcgtggtatttccactattttaaacctacaaagtggactatggagttcgggctccgcccaggcctccgaggggaaggggctgggaggtgggtcgccgtagggtttaggnggggagtggctaacaacgactattctacggcggtctccgtggaacggccgtattccacctactcctacccgaacggtaccttttaccgaaacgtaaccgaaccgtacgtacgtaaacgttcgttaacgggaaaacttaaggtaaacctaacggttaccgttagggaacggtaaacgggttccggtaaaccggaacccgtaacccggttacccccgtttttttaaagtttaacgttttacggttaacgggtaacggtaaaaacggggttaacgggttttaacgtaacggtttacggggttaaccccgggtaacggttaacggtttaccggtacccccggtttacccgttttacggtaacccgggttaacggtaccgggggtaccccggtaacggggtaaccccccggttagggttaaccccgg

SEQ ID NO: 153838 - DNA, 616 bp, Homo sapiens
  misc_feature: GYAE6OF02GG43F.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggccgggggtccctgagactctcatgtgcagcctctggattcacatttaactacaatggcatgagttggctcgccaggctccgagggaaggggctgggagtgggtcgccgtcggttagtgggagtggctacacacattctacgcgggctccgtgaagggccgattcaccatcacaggtacttttcaagaacacgctagaactctaggaaatgaacagtctgagagtacgacgaccacggcccttttattacttgtaggcgtaaaggtacgggtttaacttagttacgggtcccggtaacgtaacggtttaacgttccccggtaccttttacggaaccgtaaggttcgggggacccgtaacggggtaaccccgtgggtacctaaccccgg

SEQ ID NO: 153839 - DNA, 660 bp, Homo sapiens
  misc_feature: GYAE6OF02IP2X4.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcagtcagggcattaactactttgtaaattggtatcaatacaaaaaccaggacaacgggcccctaaactcctggtacaacgatgacactaccaagtccgggtagccgacggggaccccatcgaaggttcgagcggcgagtagacgttcgtacgggaacactttcttaccgtaaccctttacaacctaacttaccacgggaccggtccctagggacccaacggccccgttaggaacgggtaagtttcggttacgggacctaaccgtaatttacgtttaaacgtcggttaccaaaactaaattaacgttagaaccgtaattaacttaggttaaccttaacgtttttacgggacccgttaagggggaaccgtaagggtacgggtagaccttacgaaacgtacgtaggtcggacgtaggaccaccgtactacgtttcgttacttacttacgtccgtttaccccg

SEQ ID NO: 153840 - DNA, 935 bp, Homo sapiens
  misc_feature: GYAE6OF02HCH87.24.59.F04.1.454.CMB.1.raw
  modified_base (214)..(214): a, c, t, g, unknown or other
  misc_feature (214)..(214): n is a, c, g, or t
tcagactactatgtcacgaccggtgctcgatttagtacacacacttagggattggggtctgagaggaggacgcccacgcccgtgggttatttttcgaggtttgttttctagttttgggtgatcgaggactagaacagagagaactcaccagtggtaggtttgggctgaggcgtggtcttttacgtgtggtacttaagtttaaaggtgtcagtgngagtgagttgttggagtcggtggggactccgttgggtccggggtccccgggggtcctggacgtacctctcagtgtcgcacgccctgtaggtacttcaacttaatttaacactaagtcggactagtcggtaggttcggccctccgaccgaggtcctaccggaaggggacgggctggggaggttcggggtccgtccggtttacggggttttagggacggggttaacggttcggggacctaaacgtaaaccgtacgttaacgtttttacccggaaccgggtaccggggttcctttaccccggggttaagggggaaaccggggggtccccgtttaaatttaaccccgaaaccccttacgttacccccgttaaacccggtaaacgggttttaaacccctttttaaccccgaaaacggtaaaccccgtaaccgtaacccgttaaccggtaaacgttaacccggttaaaggtaaaccgttaacgtaaacgtaacgtttaccggtaaggtaaccggtaacggttaacccgggaaccgaaccggttaaccccggggttacccttttaaacgtttacgtttagggtacggttaaacggtaaaacgggttacggggtttaacgttacggttacggtacccggttaacgtaaccggtttaccgttcccgttaacgttacgtaacggtacggttaccgggacggtaacccggttcccggtacgcccgtacccgg

SEQ ID NO: 153841 - DNA, 563 bp, Homo sapiens
  misc_feature: GYAE6OF02H94S0.24.59.F04.1.454.CMB.1.raw
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtcctgagactctcatgtgcagcctctggattcacatttaactacaatggcatgagttggctccgcaggctccgagggagggctggagtgggtcgcctgggttagtgggagtggctacaanacattcacgcggctcgngaggcatcacatctacagactttcaanacacgntgaatctagaatgaactagtcngagagcgacgacgacgtacctttatattgtagtacgaaaggtacgggttactagttcgggtccggacgtacggttactcccgtcctttagacggtacgtacggggaccgaacgggacccgttacggtctacccg

SEQ ID NO: 153842 - DNA, 562 bp, Homo sapiens
  misc_feature: GYAE6OF02IU91Z.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctgagactctcatgtgcagcctctggattcacatttaactacaatggcatgagttggctccgccaggctccaggggaaggggctggagtgggtcgccgtcggttagtggggagtggctacaacacattcacgcgggctccgtgaagggccgattcaccatctaccaaggtacttttaccaagaacacgctgaatctaggaaatgaacagtctagagagtcgacgacacggtcctttattattgtgacgaaagaggttactagtggtccggacgtgttactcccgtcttgacgtagtcgggccacgggaccctggtctacccg

SEQ ID NO: 153843 - DNA, 597 bp, Homo sapiens
  misc_feature: GYAE6OF02F5GS6.24.59.F04.1.454.CMB.1.raw
  modified_base (183)..(183): a, c, t, g, unknown or other
  misc_feature (183)..(183): n is a, c, g, or t
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
tcagactactatgtcacgaccggtgctcgatttagtacacacacttagggattggggtctgagagaggagcccagccctgggattttcaggtgttttcatttggtgatcatgactgaacagagagaactcaccatggagtttgggctgagcggtgtgtttctaggtcggctaattttaaaggntccagtgtgaggtgagttgttggagtcgtgggganccgttggttcggcccgggggtccctgagctctcatgtgcagcctctggattcactatttaactacatggcattgagttggctccgcaggcncgaggaggctggagtcgggcgctcggttagtgggagtcggctacgacatacttcgtacgcggctcggtagaacgggcagtccacatcacgtaacgtctttacgaagaaccacgtcacgtaacactggaaatgtaagacgtctagagacgtacgacgtacaccggtcctttaagttcttcgtagacgtaaagaccggttagtagttcggaccggactacggttaaccgtcccgttacctttacggaaccggttacgtaggggcccgtaacgggtacccgtcgggtaccc

SEQ ID NO: 153844 - DNA, 576 bp, Homo sapiens
  misc_feature: GYAE6OF02HCH6V.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctgagactctcatgtgcagcctctggattcacatttaacacaatggcatgagttggctcgccaggctccgagggaagggctggagtgggtcgccgtcggttagtgggagtggctacaacacattcacgcgggctccggtggaacgggccgattcacctatctaccaaggtacttttaccaaagaacacgctagaatcgtagaatagaacagtcagagagtcgacgacgaccggtacctttattattgtgacgaaaggtaggttactagtcggtcgacgtacgttactccgtcctttacgacgtagtcgggaccgacgggacccgtcggtctacccg

SEQ ID NO: 153845 - DNA, 582 bp, Homo sapiens
  misc_feature: GYAE6OF02F39N1.24.59.F04.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
  modified_base (467)..(467): a, c, t, g, unknown or other
  misc_feature (467)..(467): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtcgtttctaggtcggctaatttaaaggngtcagtgtgaggtgaagttgttggagtcgtgggganccgttggttcggccgggggtccctgagctctcatgtgcagcctntggattcccttagngtactttggatgacctgggtccgcaggctaccgaggggacgggcttggagtggggcgccaattanaagggcacggatggactagcatgaacttntcgtggactcgtgtaggacggctactacactntcgacagacaccgaaccgctaacgtacctctacgtactactacgtaggaaatcgaacgacgtcngacgagacgacggacgacgtacgtacgttagttacttacgtgtacgtacgacgtagtacgtacacgtacgtaccgtacgtacgtacgtacgtacgtacgtacgtacgtacgtacg

SEQ ID NO: 153846 - DNA, 647 bp, Homo sapiens
  misc_feature: GYAE6OF02HJW2M.24.59.F04.1.454.CMB.1.raw
  modified_base (486)..(486): a, c, t, g, unknown or other
  misc_feature (486)..(486): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctattttaaaaggtgtccagtgtgaggtgaagttgttggagtcgtgggggagccgttgggttccgggcccgggggtcctggagactctcatgtgcagcctctggattcactatttaactacatggcatgtagttcggctccgccaggcctcgaggggacgggcgtgggagtcgggtcgccgttcggttaggtgggagtggactaacaacgactacttcgtacggccgggtctcggaggacgggaccgtacttccgacctatccgtaccgaaaggttaccttttaccgaaacgtaccacgctagaattacgaggtaaancgaaacgtgtacgtggagacggtacgaaccgacgtaccgttacctttagttacgttacgtgaacggtaaagtacggttactgtacgggtacgacgtgttaccgtcccgttacttagacggtaggtccggggacctaaccgggtaccttcggaccctaccgg

SEQ ID NO: 153847 - DNA, 599 bp, Homo sapiens
  misc_feature: GYAE6OF02HKRH6.24.59.F04.1.454.CMB.1.raw
  modified_base (182)..(182): a, c, t, g, unknown or other
  misc_feature (182)..(182): n is a, c, g, or t
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (544)..(544): a, c, t, g, unknown or other
  misc_feature (544)..(544): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtgtttctaggtcggctattttaaaggngtcagtgtgaggtgaagttgttggagtctggggagccttggttcggcccgggggtcctgagactctcatgtgcagcctctgattcacatttaacacaatggcatgagttggctccgcaggtcnccgagggaggctggagtggtcncgtggtagnggagtggctanaacacgnttcgacgcggctccgtgaacggcgattcacctatccgtacgaacggtaccttttaccgaaagtaaccgacgtactacgtaatccgtaaggtaaactgaaacgtagtcgtagagagtcgacgaacgtccggtacctttagttacttgagtaacgaaagtacggttatacgtggtaccggtacgtagttacncccgtcgttacgacggtacgtcggggacctacgggtaaccctcggtactacccgg

SEQ ID NO: 153848 - DNA, 661 bp, Homo sapiens
  misc_feature: GYAE6OF02H3IPX.24.59.F04.1.454.CMB.1.raw
  modified_base (218)..(218): a, c, t, g, unknown or other
  misc_feature (218)..(218): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctggggganccgttggttcgggcccgggggtccctggagactctcatgtgcagcctctggattcactattttaacacaatggcatgagttgctccgcaggctccgaggggagggctgggagtcgggtcgccgttgggttaggtggggagtcggctaacaacaccgtatttccgtacggccgggtcttccggtacgaacggggtcccgatttacccgacctatccgttaccgtaacggtacctttttaccgaaacgtaacgacgacgtagaaacttcgtaggaaattacgaactagtctagagacggtaccgacgaccgaccggtacccttttattacttgtagacgtaaagtaggttacttagtacggtaccggtacgtaagttaccgttcccgtccgtttacgacggttacgtacggggacccgaacgggtaaccgtcggtacctacccgg

SEQ ID NO: 153849 - DNA, 1012 bp, Homo sapiens
  misc_feature: GYAE6OF02H5NH7.24.59.F04.1.454.CMB.1.raw
tcagactactatgtcacgaccggtgctcgatttagtacacacacttagggattggggtctgagagaggagcccagccctgggtattttcaggttgttttcatttggtgatcaggactgaacagagagaactcaccagtggtaggtttggctgagcgtggtcttttttcttgtggtcttaagtttttaaaaggtgtccagtgtgaggtgtaagtttgttggagttcggtgggggatccgtttgggttccgggccccgggggttcctggacgacctctcagttgtgcacgcctcgtggtatttcaactaattttaaacctaactaagttggactagtggtaggtttggccgtccccgaccgacggtccgtaccggaagggggaacggggtccggtaggggtaggttcgggggttcccggtcccggtttacggggtttaagggttcgggggtaaggttcgggaccttaaccgaaacctaaccgttacgttttaccgtaccgggccgggtacccgttcccgggtagggaaccggggtaccgttacgtttacccgaacccgtaacttccccgttaacccgtaaacgggtttaaccccgttttttaacccgaaaaccggtaaaccgtaacccggtaccgttaacggtaaaccgttaccgttaagggtaaaacgttacggtaaaaccgttaacggttacgttaacgggtaacgggtaacggttaacccgggaaaccgggtaaacccggttaaaccccgggtttaccccgtttttttaaacgtttttaacggtttacgggtttaaccgggttaaaccgggtaaaaacggggtttaacgggttttaaaccgtttaacggttaccgggggtttacccgggtaaccggtttaacggttttaacccgttacccccggtttacccggttttaaccggaacccgggttaacgggttaccggggggtaccccggtaaacccgggggttaacccccggttaccggggttaccccgttaaccccccggg

SEQ ID NO: 153850 - DNA, 586 bp, Homo sapiens
  misc_feature: GYAE6OF02GS6AI.24.59.F04.1.454.CMB.1.raw
  modified_base (366)..(366): a, c, t, g, unknown or other
  misc_feature (366)..(366): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggcttttctgtggctattttaaaaggtgtccagtgtgaggtgaagttgttggagtctgggggagccgttgggttcggcccgggggtccctgagactctcatgtgcagcctctggattcacatttaactacaatggcatggagttggctccgccaggctccgagggagggctgggagtggggtcgccgtcgggttagtgggagtggctacaacncattctacgcgggctccggtgaacgggccgtattccacatcctaccaaggaccttttccaacgaacacgacctgaactcgtaggaaatacgaacagtctagagagtcgacgacgacggtccctttattagttgtgacgtaaagtagggttactagtacggtccgacgtagttactcccgtcttcgacgagtcgggaccacgggtaccctcggtcctaccg

SEQ ID NO: 153851 - DNA, 720 bp, Homo sapiens
  misc_feature: GYAE6OF02JFE9P.24.59.F04.1.454.CMB.1.raw
  modified_base (324)..(324): a, c, t, g, unknown or other
  misc_feature (324)..(324): n is a, c, g, or t
  modified_base (360)..(360): a, c, t, g, unknown or other
  misc_feature (360)..(360): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagttttggctgagcgtggtcgttttctaggtggctattttaaaggtgtcagtgtgagtgaagttgtggagtcgtggggagcgttggtcggcccgggggtcctggagctctcatgtgcacgccgtgtggacttcactatttaaccgtaactaagtcggtctaagtgtaggttcggtccgttacccnccgacggtcctccggaggggaacggggtcctagggnggtcggggttccgaccggttgggttaacggtggggtaacggtcggacttacggaactacgtagttaccgtacgcgggtacgtccggtacgggaagggtccgtacttcgaaccctgtaccctaccgaaacggtcctttaaccgaacggtactacgccgtagtactacgtaggaaactgaacgtactgtgacgcgttacgaaccgacgtacccggtacccttttagttaaccgttcgtaacgacggtaaacgttaacgggtaccttaggtaccggtacggtaacttaacggtttaccggaccccgttacgttagaacggtaaccggtcgggtaccggaaccgggttaccctacggttaccgg

SEQ ID NO: 153852 - DNA, 565 bp, Homo sapiens
  misc_feature: GYAE6OF02F8FFA.24.59.F04.1.454.CMB.1.raw
  modified_base (333)..(333): a, c, t, g, unknown or other
  misc_feature (333)..(333): n is a, c, g, or t
  modified_base (370)..(370): a, c, t, g, unknown or other
  misc_feature (370)..(370): n is a, c, g, or t
  modified_base (448)..(448): a, c, t, g, unknown or other
  misc_feature (448)..(448): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaggtgtccagtgtgaggtgaagttgttggagtctgggggagccttggttcgggcccgggggtccctgagactctcatgtgcagcctctggattcacatttaacacaatggcatgagttggctccgccaggctccgagggaagggctgggagtgggcnccgtcggttgtgggagtggctacaacacattcgacgnggctcggtgaagggccgattcaccgatcctaccgaaggtaccttttccaacgaacacgctagaatctaggaatgaacngtctgagagtcgacgacgacggtcctttaatattgtgtacgaaagtaggttactagtcggtaccgacgtagttactcccgtctttgacgagtcgggcacgggacccgtgtccgtccg

SEQ ID NO: 153853 - DNA, 579 bp, Homo sapiens
  misc_feature: GYAE6OF02HVEI2.24.59.F04.1.454.CMB.1.raw
  modified_base (308)..(308): a, c, t, g, unknown or other
  misc_feature (308)..(308): n is a, c, g, or t
  modified_base (399)..(399): a, c, t, g, unknown or other
  misc_feature (399)..(399): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccgttgggttcgggcccggggggtccctgagactctcatgtgcagcctctggattcacatttaactacaatggcatgagttggctccgcnggctccgaggggaaggggctggagtgggtcgcctcggttagtgggagtggctacaacacattcacgcgggctcggtgaagggccattcacntctccaaggactttccaagtaacacgctgaatctggaaatgaaacagtactgagagtacgacgacgacggtccctttattattgtgtacgaaaggaggttactatggttccgggacagtttatcccggcttttacgacggaagttgggggacctaacggggaaccctggtccgtaacccg

SEQ ID NO: 153854 - DNA, 802 bp, Homo sapiens
  misc_feature: GYAE6OF02HX03O.24.59.F04.1.454.CMB.1.raw
tcagactactatgtcacgaccggtgctcgatttagtacacacacttagggattggggtctgagagaggagcccagccctaggattttcaggtgttttcatttggtgatcaggactgaacagagagaactcaccatggagtttgggctgagctggctttttctgtggctattttaaaaggtgtccagtgtgaggtgaagttgttggagtcgtgggggagccgttggttccgggcccggggggtcctggacgacgtctcatgtgcagcctcgtggattcctaacgtattttaaacctactaaagttggactattggaagtttcgggccttcccggccgaggccttaccggaagggggaagggggtcctgggaggttcggggtccgtccgttcgggtttaaggtggggacggttgggactaaccgaaacacgatttccaacggcgggtcctccggtagggaacgggaccgtaacttcccaacgtacttcccgtaaccgtaacgggtaaccctttttaccgaaaggtaaacccacgtacgtaacgtaaactccgtagggaaaagttacggaaacgtagttacgttaggaaggtaacgttaccggaacgtaacccggtaccgggttacccttttaagtttacgttagtacgtacggtaaaaggtaacggggtttaacctaggttacgggtacccggtaacgttcggtttaaccttcccggttacccggtttttaagaaccggtaacggttacgggggaaccccgttaaacggggttaaccccgttcggggttacccctaaccccggg

SEQ ID NO: 153855 - DNA, 746 bp, Homo sapiens
  misc_feature: GYAE6OF02F9QGR.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctggagactctcatgtgcagccctctggtattcacatttaactacaatggacatgagttggctccgccaggcctccgagggaacgggcgtgggaggtgggtcgccgtcggttaggtggggagtcgggtctaacgaaccaactacgttcgtaccggccggggtcctccggtaggaaacggggtcccgtacttccgaacccacttccgtaccgtaaacggtaccctttttaccgaaacgtaacctaaccggtcctacgtaaacttcgtacgggaaaacttagaaactaagttaccgtaggtaacggaacgttaccggaaccgtaacccgaaccggttccccgtttttaagtttaacgtttcgttaggaccgtaaaggtaacgggtttaacttaggtcgggtacccggtaacgttaacggttaaccttaccccggtacccttttacggaacgtaacggttcggggtaacccggtaacgggaaccccggttacggtcccgttaaccccgg

SEQ ID NO: 153856 - DNA, 828 bp, Homo sapiens
  misc_feature: GYAE6OF02H1TSA.24.59.F04.1.454.CMB.1.raw
  modified_base (300)..(300): a, c, t, g, unknown or other
  misc_feature (300)..(300): n is a, c, g, or t
tcagactactatgtcacgaccggtgctcgatttagtacacacacttagggattggggtctgagagaggagcccagccctgggattttcaggtgttttcatttggtgatcaggactgaatagagagaactcaccatggagtttgggctgagcgtggtcttttctaggtcggctaattttaaaaggtgtccagtgtgaggtgagttgttggagtcgtgggggagccgttgggttcgggccccggggggtcctggacggactcgtcagtgtgcagcctctggtattcacctatttaaacctanaaagtcggactagtgtaggttcggctcccgcacggctccgaaggggacgggctagggaggtgggtccgtccgttcgggttaggtacggggtagtacgggtcctaacgaaacgtactactttacgacggtccggggtcttaccgggtaggtaaccggggtacctacgttaccgaccacgttcctaaccgtaacgttaccgtttaccgtaaacgtaaccgaaccgtacgtacgtaactacgtaaggtaaacgtaacggtaacgtaacgtacgtacgtaacggtacgtaccggtaaccggtaaccggtaacccgggttacccgttttaaccggtttaacgtttacggtttacggtaaccggtaaaacgggtaaacgggttttaacgttaacgggttacgggttaccgggtacggttaacggtttaaccggtttacccggtacccggttttacggtaaccggttacgggaccgggttttttttaccgggaaccggggttaacccggttaccgggttacccgttaaccccggg

SEQ ID NO: 153857 - DNA, 831 bp, Homo sapiens
  misc_feature: GYAE6OF02H0FBI.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcacatggagtttgggctgagcgtgtctttttctgtggctagttttaaaaggtgtcagtgtgaggtgaagttgttggagttcgtgggggagccgttgggttccggcccgggggtcctggagacttctctatggtgcagccttcgtggattcctactaactttaactacaaatcggcagtgaggtttcggccgtccgcccgtaaggtccgtacccggaaggggtaacggggtccgtggggacgggttcggggtcccggtccggttacggggtttacgggtcgggggtacgggttcgggtaccgttaaacgaacccgtaacgtaacgtttaccgtaaccgggtccggggtaacccgttccgggtttaggaacgggggtcccgttaacgtttacccgaacccgtacgtttaccgtacccgtaaacgggtttaacccttttaccgaaaaggtaaacctaccgtccgttaagaaacgttaccgttaaggaaaacgttacgaaacgttaacgttcgttaaacggaggttaaccggtaccggtaaccggaaccgttacccggttaccccttttaagtttacgtttacggtcggtaaacggtaaaagggttacgggttacttacggtacggttacccggaagtaacggtttccgtacccgttcgttacggtacgtaggtccgggaccgtacgggtaccctggtaccccg

SEQ ID NO: 153858 - DNA, 749 bp, Homo sapiens
  misc_feature: GYAE6OF02H0YZI.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtcgtttctaggtcggctaattttaaaaggtgtcagtgtgaggtgaagttgttggagtcgtgggggagccgttggttcgggcccgggggtcctggacgactctcatgtgcagcctcgtggattcaactatttaaactacgaattggctaagtgagttggcctccggaccaggtctaccggaagggggaaggggcctggtacggtggggtccgtacccgttggggttagtaggggagttcgggacttaacgaacgtaacctagtttaccgaacggtccgggtcctttcccggagggtaaacggggtcccgttaagtttacccgaacctaacgttcccgttacccgtaaaacgggttaccgtttttaacccaaacggtaaaccctaccggtacgtaacgtaacgttacgtaaggtaaactacgtaacgtagtacgtagtagtacgtaccgacgaaccgtacggttaccctttagttagttacgtcgtacgtaaacggtacggttaacgtacgttacggtacggtacgtaacgttaccttaccgtccgtttacgacgtacggtcgggaccgtaacgggtaccgttcggtaccgtaccg

SEQ ID NO: 153859 - DNA, 753 bp, Homo sapiens
  misc_feature: GYAE6OF02H08QH.24.59.F04.1.454.CMB.1.raw
  modified_base (184)..(184): a, c, t, g, unknown or other
  misc_feature (184)..(184): n is a, c, g, or t
  modified_base (369)..(369): a, c, t, g, unknown or other
  misc_feature (369)..(369): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgtcgttttctaggtggctaattttaaaaggngtccagtgtgaggtgaagttgttggagtcgtgggggagtccgttgggttccgggccccgggggtcctgagtcctctcagtgtgcagcctctggattcacattttaacacaatcgcatgagttggctccgcaggtctcgagggagggctggagtggtcgccgtggttagtgggatggctacacagntttcacggcggtctccgtaggaacgggcctattccgaccatccgtacctaacggtaccttttacgaacgaacctacgtacgttacgaaacgtccgttaggtaaaacgttagaaccgtaagttaccgtaggtaaacggtacggtaacccgggtaacgaaacccggttaccgggttaaccccctttttaagtttaaccgtttacgggtacggtaacccgggtaaaaggttaacggggtttaaccgttaacggttaccgggttacccgggtaccgtaacgggttttacccgtaccccgggtttaaccgttacgtaacccggttaagggtacccgggggtacccgtaacccggggttaaccccgttcgggtaacccttaacccccggg

SEQ ID NO: 153860 - DNA, 708 bp, Homo sapiens
  misc_feature: GYAE6OF02FFDKT.24.59.F04.1.454.CMB.1.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtcttttctagtggctatttaaaggtgtccagtgtgaggtgaagttgttggagtctgggggagcttgggtcggcccggggggtccctggagacgtctcatgtgcagcctatggattcacatttaacacaatggcatgagttggctcgccaggctcgagggaggctggagtcgggtcnccgttgggttagngggagtggactacgacngtactcgtacggcggctccgtggaacggtcccgtattccaccgtatctaccgaacggtcctttaccgaagaacctacggtctaggtaacttccgtaaggaaacttcgaaacgtcggttaccgtaggaacggtacgtacccgggaaccggtaacccgtaccgggttacccttttttaacgttacgtttacggtacgggaaccggttaaaagggtaccgggtttaacgtaggttccgggtaccgtacgttaacggtttaacgcccccgttaacgtttacgggaaccgttaacgggtaccggggggtacccctaacgggggtaccccttaggggttaccctaacccccgg

SEQ ID NO: 153861 - DNA, 738 bp, Homo sapiens
  misc_feature: GYAE6OF02HR4NV.24.59.F04.1.454.CMB.1.raw
  modified_base (186)..(186): a, c, t, g, unknown or other
  misc_feature (186)..(186): n is a, c, g, or t
  modified_base (296)..(296): a, c, t, g, unknown or other
  misc_feature (296)..(296): n is a, c, g, or t
tcagactactatgtcacgaccggtgctcgatttagtacacacacttagggattggggcacagcgtggacatgagggtccctgctcagctcctggcctcctgctgctctggctactcaggtgccatatgtgactagtccagatcgaccctagtctccatcctccctgtctgactatcgtggtggganacgagtaggtccaaccgtattccggtcttcggacccgtagggccgtaaggtcggacgggtactaatttaaccttacttttaggtaaattggtatctactaacaaaaacgnggtaccaacggacccttaaactcgtagtacaacgatgactactccgaagtcgggtacgccggacgggccctagtcgtaaggttcaggcggacaggtacgagtcggtaggactagtttactactaaccttcaactactacgacggacggtcgtcgactacgtaccgtaggaaggtagttgttacggactaagtaacttaacgttaccgtagttaaccaaacgttaagtaacgtacggtaaacctaagttaacgttaccggtttaaccgtttaacgggtttacggggtaaccgggtaaacggggggttaaccggtaacgggtaacgggttaccgtaaccggttaacgtaaaaccgggttcgttagggtccggtacgtaccgaaccgtacccgttaagttccggttacgtttacccgtttactaccggtttcccttaacccccgg

SEQ ID NO: 153862 - DNA, 669 bp, Homo sapiens
  misc_feature: GYAE6OF02FKC3Q.24.59.F04.1.454.CMB.1.raw
  modified_base (218)..(218): a, c, t, g, unknown or other
  misc_feature (218)..(218): n is a, c, g, or t
tcagactactatgtcacgaccggtgctcgatttagtacacacacttagggattgggggtctgagagaggagcccagccctgggattttcaggtgttttcatttggtgatcaggactgaacagagagaactcaccatggagtttgggctgagctggctttttcttgtggctatttaaaaggtgtccagtgtgaggtgaagttgttggagtctggggganccttggttcggcccggggggtccctgagactctcatgtgcagcctctggattcactatttaacacaatggcatgagttggctccgcaggctcgagggagggctggagtgggtcgcgtcggttagtgggagtgctacacactattcgacgcggctccggtgaacgggcctattccacctatccaccaacggtactttaccaagaacacgctagaacttacgtaggaaatagaactagtacgtaggaagtacggtacgacgtaaccgaccggttaccctttaagtttacgttacggttacggtaacggtaaagggttaacgggtttaacttaggttacgggtaccggtaacgttacggttaaccgttacccggttccgttttacggaacggtaacggtccgggggtaacccggtaacggggtaaccccggttacgggttacccgtaaccccgg

SEQ ID NO: 153863 - DNA, 846 bp, Homo sapiens
  misc_feature: GYAE6OF02JCBEQ.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtcgtgggggagccgttgggttccgggccccgggggtccctgagactctcatgtgcagcctctggattcactaatttaacacaatggcatgtagttcggctccgccaggcctcgaggggaagggcgtggaggtcgggtccgccgttgggttaggtgggtagtcgggactaacgaacactacttacgtaccggcggggtccttcccggtagggaaacggggtcccggtaatttacccgaaccctacgttacccgttaacccgaaacgggtttaacccttttttaaccccgaaaacggtaaaccctaaccgggtaccttaaggtaaacgttaccgttaaacgggtaaaacgttacggaaaacgtacggttacgtacgggtaacggtacgggtaccggaaaccggtaacccgtaacccgggtttaccccgttttaagttttaacgtttcgggttacggttaaacgggtaaaacgggttaacgggtttaacgttaacggttacgggttacccgggtaaccggttaaccggtttaacccgttcccggttacccggtttttaacgggaaccggttaaccgggttaccgggggtacccggtaaacccgggggtaacccccggtttacgggtacccggttacccccgg

SEQ ID NO: 153864 - DNA, 872 bp, Homo sapiens
  misc_feature: GYAE6OF02GN0BI.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaggtgtccagtgtgaggtgaagttgttggagtctgggggagccttggttcggcccgggggtccctgagactctcatgtgcagcctctggattcactatttaaactacaatggcatgagttggctccgcaggctccgagggagggctggagtgggcgcgtcggttagtgggagtggctacaacactattcgacggcgggaccttccggtaggaaaggggtcccgtatttccgaaacccgtagttacccgttacccgaacgggttaacctttttacccgaaacgtaaaccgaaccgtaccgtacggtaaacgttccgttaacgggtaaacgttacggtaaacgtaacggttaccgttacgggaacggtaacgggtttacccgggaaacccgggtaaccggttaaccccggggttaaccccgtttttttaacgttttaacggttttacgggttaacgggttaacccgggtaaaacggggtttaaacggggttttaaccgtttaaacgggtttacggggttaccccgggggttaacccggttaaaccgggttttaaacccggttttacccccgggtttaaccccgtttttaccggggttaaacccggggttaaaccggtttacccggggggggtaaccccgggtaaccggggggttaaaccccccggtttaccgggggttacccgttaaaccccccgggg

SEQ ID NO: 153865 - DNA, 731 bp, Homo sapiens
  misc_feature: GYAE6OF02IZ9PL.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccgaggcgagtcgaggcattaactactttagtaattggtatcatacaaaacagacaaggccctaaactcctggtacaacgatgcgactaccaagttcgggtcgcccggacgggcccccagttccgaacggtttcacggacggacgtaaggtacgtacgtcggtacgggtaacctactttccgtttacctaaccctttaccaaccctaactccgaacggtcccgtacccgttcggacctaacggtcccgtaagggtaccgggtagttttacgggttcgggaccctaaacgttaacgtttaacgtttaaccgttacgtaacccgtaaaaccttaaagttaacgttaggaaacccgttaattaacgtttaacgttaaccgtttaaccggtttttcgggaacccggttaacggggggtaaaccgggttaaagggttacgggaacgtaccgtaccggtaaaacggtaccgttaagggtcggtacctacgaccgtacctacgttccgttgttaccttaccgtacttccccgttaaccccgg

SEQ ID NO: 153866 - DNA, 662 bp, Homo sapiens
  misc_feature: GYAE6OF02HL3XL.24.59.F04.1.454.CMB.1.raw
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggcttttctgtggctatttaaaggtgtccagtgtgagtgagtgttgagtctggggagcttggttcggccggggtcctgcgactctcagtgtgcngctctggnttcactattaactacaatgcatgagttggctcgcagctcgaggagggctggagtgggtcgccgtagggttcggtagggtacgtggctacgaacacgtatttcgacggcgggtctcggtcggacggccgtattcacgtactccgtaccgaacggtacttttaccgaaacgaacgtacgacgttagaacgttctacggtaaactacgtaacgtagttacgttggaacgtacgtacggtaacgaacgtaacccggtaccctttacgtttacgttgttacgggtacgtaaacggaggtttaccgtaaggtcgggttaaccggtacgtacggttacgttaccccgtccgtttacgtaacggaacggttaccggggtaccggaccggtaacccggtcggttacccgtacccgg

SEQ ID NO: 153867 - DNA, 696 bp, Homo sapiens
  misc_feature: GYAE6OF02HLO0R.24.59.F04.1.454.CMB.1.raw
  modified_base (340)..(340): a, c, t, g, unknown or other
  misc_feature (340)..(340): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtcgttttctaggtggctaatttaaaaggtgtcagtgtgaggtgaagttgttggagtcgtgggggagccgttggttcggcccggggggtcctggagactcgtcatgtgcacgcctctggacttcaactattttaacacaatggcatgagttgctccgcaggctcgagggaggcgtggagtgggtcncgtcggtaggtgggacgtggctaagaacacagttctacgcgggctccggtaggaacggccgtaacttcgacctatctacgaacggtacttttaacaaacgaacacgtacgtagaaacttacgtaagggaaacttacgaaacgtacgtccgttaaggaagtacgttaaccggaacgtaccggaaccggttaccccgtttttaagttaacgttttacggtagtaaccggaaaaaggttagggtttaacctagttaccggggttaccggaacgtacggtttaacctcccggtaccttttacgggaacgtaacggttacgggggacctaacggggtaacccgtagggtaccctaacccgg

SEQ ID NO: 153868 - DNA, 860 bp, Homo sapiens
  misc_feature: GYAE6OF02H1G9Z.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttggctgagctggtctttttcttgtggtctattttaaaaggtgtccagtgtgagtgaagttgttggagtcgtggggagtccgttgggttcggcccgggggtccctgagtactctctatgtgcacgtcctcgtggtattcacctattttaaccactaagtggactagtagaggttcggccgttccgccgacggtccttccggaacgggggaacggggcgtagggtacggtggggtccgtccggttacggggttagggtcggggtacggttcgggtaccgttaaaccgaacctaacgtacgtttaccgtacggggtaccggggtcccgttaccgggacgggtaaccggggtaccccggttacgttaaccgtacccctagttaccccttaccggtaaacggtttacctttttaaacccgaaacggtaaaacccgtaccgtaccggttaacgtaaacgttacccgtaaagggtaaaacttaacggtaacccgtaagttcgtaaacggtaaggtcgtaaccggtaacccggaaaccggtacccggtttaccccgtttttaaagtttaccgttacggttaacggtaaccggtaaaaggttaaccggtttaacgtaacggttcggtaccggtaacttaacggttaacccgttccccggtacgtttacggtaaccggtaggtaaccgggtaccggaaccggttacccgtaccggtaccgttaacccgg

SEQ ID NO: 153869 - DNA, 669 bp, Homo sapiens
  misc_feature: GYAE6OF02IE634.24.59.F04.1.454.CMB.1.raw
  modified_base (248)..(248): a, c, t, g, unknown or other
  misc_feature (248)..(248): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattgtatcatacaaaaaccnggacaaggccctaaactcctggtcaacgatgacatccaagtcggtgccacggggcccatacgaaggttcagcggcagtagtagtcgtacgggactagtttcctttacaccgtttccaaccattccgaacggtcgggcccttagccgtaggtccttacgggagggtacttgggtttacgggacctaacgtaagttaactttaccgttacggttaaccaaaacgttaaacgttacgttaacggaacggttaacttaacgttaacggtttaaccgttaaccggttttttcggggaacccgttaaggggggtaaccggtaaaggggtagggtaacgtaccgttaacgaaaccggtaaccggttggtaacggtactacggactacgtactacgttacttcggtttaccttactacgtttaccccgg

SEQ ID NO: 153870 - DNA, 721 bp, Homo sapiens
  misc_feature: GYAE6OF02I2HB0.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtaggagacagatcaccatcacgttgttgggacaagtgacgacctattagcagtcttcgtttgagttgacatctaattacgaaaaccagggtaaaccgacccctaactcctgaccttactaacgtactcggaccgttacctaaatttacacgtaggtcgggtacccctagttcccaggttaccaggtacggactaagttgggaacttcggtacggggaacacggttaacgttccaaccgttccgtaccaaacctacgtttaacccgaaggtccctaaacgttcttaacggaccctaacgttacgaaacgttaccgtttagaaccctaaacttttaaactttacggttacttaaccaaacgtttaacgttaaccgtttaccgtaacccggtttacccggttccgttaacccgttcggggaacgggtaacgggtaaccgtaaggggtcgaagtactaaccgaaccgtacgtaaccggttggtaacggttcgaaccggtccaaccgtacgtttcgttaacggttcctttacccgacgtttccccgtaaccccg

SEQ ID NO: 153871 - DNA, 851 bp, Homo sapiens
  misc_feature: GYAE6OF02INLWJ.24.59.F04.1.454.CMB.1.raw
tcagactactatgtcacgaccggtgctcgatttagtacacacacttagggtagttgggggtactgagtagaggagcccagccctgggacttttccaggtgttttcaatttaggtgatacgaggacctgtaacgtagtacgacgaactcaccgagtggacgtttcgggcgtaggtacgtcgtcgtctttttccgttaggttggtccttaagttttaaaaggtcggtccctaggtagtggtaggtagtaagttggttggagtccgtggggtacgtccgttggttcggcccggggttccctggacgtacgtcgtcgtacttcgtacgacgtaacgcctacgtaggtaacttacgtacgtaactttaacgtaacgtacgtacgacctacgtaggtaggttcggtccgtaccggtccgtaggtccgaccggtaaggggtacgggtacgttaggtacggtcgggtaccggtacccggttaccggttaaccggttcgggtacggttcggtaccgtaaccgaaccgtaacgtacgttaccgtaaccggcccggtaccgtaccggtacggacggtaccgtacgttacccgaacccgtaacgtacccgtaaccgtaaccgttaccgtttaaccgaacgtaacgtacggtcgtacgtacgtaccgtaacggaaacgtacgtaaacgtacgttacgtacgtacggtacgtaccggtacgtaacccgtacggttaccttaagttacgttcgtacgtaacgtaaaggttacggttaacgtacgtacgtaccgtacgtacgttaccgtaccgttacgttagtacggtacggtcgggtaccggaacggtacccgtacgtacctaccg

SEQ ID NO: 153872 - DNA, 583 bp, Homo sapiens
  misc_feature: GYAE6OF02F255N.24.59.F04.1.454.CMB.1.raw
  modified_base (334)..(334): a, c, t, g, unknown or other
  misc_feature (334)..(334): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccgggggtccctgagactctcatgtgcagcctctggattcacatttaactacaatggcatgagttggctccgccaggctccgagggagggctgggagtgggtcnccgtcggttagtgggagtggctacgaacacattctacggcgggctccggtggaacgggccgattcacctatctccgaagtactttccaagaacacgctagaatctagaatagaacagtcgtagagagtcgacgacgacgtcctttattattgtagacgtaaagtaagggttactagtgggtaccgacgtagttacgtcccgtcttacgacgtacgtcggggaccgtagggaccccgtggtcctacccgg

SEQ ID NO: 153873 - DNA, 828 bp, Homo sapiens
  misc_feature: GYAE6OF02I8EBG.24.59.F04.1.454.CMB.1.raw
  modified_base (120)..(120): a, c, t, g, unknown or other
  misc_feature (120)..(120): n is a, c, g, or t
  modified_base (179)..(179): a, c, t, g, unknown or other
  misc_feature (179)..(179): n is a, c, g, or t
tcagactactatgtcacgaccggtgctcgatttagtacacacacttagggattgggcacagcgtggacatgagggtccctgctcagctcctgggcctcctgctgctctggctctcaggtnccatatgtgacatccagatcgacccagtctccatcctcctgtctgcatcgtggtggganacagagtcacctatctacttcgaccgaggcgtacgtcgagggctaatttaacttacgtttagtaaattggtatacgaactaacaaaaaccgtggacgtaacgggtaccccttaaaacgtccgtagggtacaaacggtacgtacgaccgtaactaccgtaacggtccgggtacgaccccggtaccggggaccccctaagtaccccggtaaaggttaccggaacggtaccgggtaaccgtaaacgggtaacggtaacggttaccggttacgggtaaccgttttaccgtttacccgttaacccgttaaaccccggtttacctaaacccggttacgtaccggtaaccgggtaacccgggttcccgttacgggtacccgtaaacgggtacccggtaacgggtaacgggttaacggttcggtttacggaccgttaaactaacggtttaaacttaccgttacgtaaacccgtaaacgtaacgttaaagtacgaacgttaactacggttaacgttccgtttaacgtttcgaacccggggtacgggtaaacgggtaacggtacgggaacgtaccgtaacgtaaccggttaccgtaggttacgacgtacgacctaacgttacgttacctacgttacctacgtaccgtacccttacccgg

SEQ ID NO: 153874 - DNA, 685 bp, Homo sapiens
  misc_feature: GYAE6OF02JM8PT.24.59.F04.1.454.CMB.1.raw
  modified_base (179)..(179): a, c, t, g, unknown or other
  misc_feature (179)..(179): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatccctccctgtctgcatctggtggganacagagtccacatctctcgccaggcgagtcgaggctaattaacttacgtttgtaaattggtatactatacaaaacaggacaacggtacctaactccgtaggtacaacgatagctactaccacgtcggtcgaccgacgggcccagtacgtagtcgaggcggtacgagtagacgtcgtacggacttacgtttaccttactaccgttaccacctaacgtaccgaccggtaccggtccgtcggacctaccggtccgttaggtaacgggtacgttcgggttacggtaccgtaataacgttactttacgtaacgttaaccgtaactaaacgttacgtacggtacgtaacgttaagttaccgttacgtttacgggtttaccggaaccgggttaacggggaacgggttacggtaacggacgtacgtaacgtaaccggtaacggttgggtaccggacgttaccgacctaaccgttagttccgttacgttacttaccgttacttacccctacccgg

SEQ ID NO: 153875 - DNA, 690 bp, Homo sapiens
  misc_feature: GYAE6OF02IURNS.24.59.F04.1.454.CMB.1.raw
  modified_base (269)..(269): a, c, t, g, unknown or other
  misc_feature (269)..(269): n is a, c, g, or t
  modified_base (393)..(393): a, c, t, g, unknown or other
  misc_feature (393)..(393): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggcgtttttctagtggctattttaaaaggtgtcagtgtgagtgaagttgttggagtctgggggagccgttgggttccggcccgggggtcctgagactctcatgtgcagcctgtcgnttccataatttaactacgaatcggacatggtagtggctccgcaggccttcgagggggacgggctgggacggttgggtcgacccgttgggttagtgggagtggctacaactacgattctaccggnggtaccgtccggtaggaacggggcgacgttcacctaacgtcttaccgacggttaaccttttcccgaaagtaccgaacgtccgaggtaatcctaagggaaacttagaacgtagtcgtagacggtaggtaccgacgacctacggtcccgtttaagtttctttaggtccgtaacggaaagttaacggggttacgttacgttcgggttacccggaaggttcggtttaccgtacccggttccttttagggaacctaagggccggggtacccgacgggtaaccccgttcggtctaaccccggg

SEQ ID NO: 153876 - DNA, 589 bp, Homo sapiens
  misc_feature: GYAE6OF02HINOA.24.59.F04.1.454.CMB.1.raw
  modified_base (258)..(258): a, c, t, g, unknown or other
  misc_feature (258)..(258): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (392)..(392): a, c, t, g, unknown or other
  misc_feature (392)..(392): n is a, c, g, or t
  modified_base (416)..(416): a, c, t, g, unknown or other
  misc_feature (416)..(416): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccgttgggttcgggcccgggggtccctgagactctcatgngcagcctctggattcactatttaacacaatggcatgagtgctccgcaggctcgagggagggctgggagtgggtcgccgtggttagngggtagtggctacaacncattcacggcggctcgtgacgggcattcacntctacgaaggtctttacaagaacncgtatagatcgtaggaaactgaactagtctagagagtcgacgacgaccggttacctttaagttactgtcgaacgtaaaggtaggttactagtcggtaccggacgtagtaccgttcccgtactttaggacgtaacggtcggggacgaccgggtaaccctgggtaccctacccgg

SEQ ID NO: 153877 - DNA, 737 bp, Homo sapiens
  misc_feature: GYAE6OF02JMPMG.24.59.F04.1.454.CMB.1.raw
  modified_base (393)..(393): a, c, t, g, unknown or other
  misc_feature (393)..(393): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtcgtttttcttggtggcttaattttaaaaggtgtccagtgtggaggtgaagttgttggagtcgtgggggatccgttgggttccgggcccgggggtcctggacgactctcagtgtcgcaggcctcgtaggatttcactatttaaactacaaagtggctatggtagttggccgtaccgccgaggcctcggagggaacgggctgggagtcgggtcgcgttcggtaggtgggagtggactanaacacgtactttacgacggtcgggtccctacgggtaggaaacggggccgtactaccgaccgtactcctaccgtaacggttacctttaccgaaacggtacaacgtacgttacaaacgttcggtaagtaaacgtagaactacgttacgtaggacgtaacgtacgaacgacgtaacccgttaccgttttacgttaacgttacggttacgaacggtaaaggttacggggttaactacgttacgggttacgtaccgttaacggttacccgttaccggtcgtttaacggaacggttaccggtacggggtacccggaaccgggtaaccgttaccgggtacccgttacccgg

SEQ ID NO: 153878 - DNA, 700 bp, Homo sapiens
  misc_feature: GYAE6OF02HIVEB.24.59.F04.1.454.CMB.1.raw
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
  modified_base (405)..(405): a, c, t, g, unknown or other
  misc_feature (405)..(405): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtntccagtgtgaggtgaagttgttggagtcgtggggganccgttgggttccgggcccggggggtccctggacgacgtctcagtgtgcgacgcctctggtacttcataatttaacacaagtggacatgagttcggctccgtcgaggcctcggaaggggacgggtcgtgggtacggtcgggttccgtccggttcgggttaggcgggtaggtcggcgtaacaacgactnttacgacggtcgggccttacggtggacggtaccgtactacaccactcctaccgaacgttacctttaccgaaagtaacgaccgtcgtaacgtaatacgtaaggtaactaagtaacgtacgtacgtagtagaacgttaccgaacgtaacgtaccgttaccgtttagtttaacgtcgtagtaacggaaaggttacgggttactaaggtcggtaccggtacggttacgttaccgttcccgtacttacggaacgtacggtaccggggaccgtaccggtaccggttcgtacccgtacccgg

SEQ ID NO: 153879 - DNA, 831 bp, Homo sapiens
  misc_feature: GYAE6OF02GR6QO.24.59.F04.1.454.CMB.1.raw
  modified_base (177)..(177): a, c, t, g, unknown or other
  misc_feature (177)..(177): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtggganacagagtcaccatctcttgccaggcgagtcgagggcattaactactttagtaaattggtatcatacaaaaaccaggacaacgggacccctaaaactcccgtaggtacaaacgattaggacactaccaagtccggggtacgcccggaacgggggccccctaagtaccgtaaacgggtttccgaacggtaccgggacgtaacgggttaacgtaacgttccgttaagggggtaaccttaacggtttttccctttaaccccggtaacccttttacccgaaccccgttaaacttacccgtaaacggggtaccccgggttccccgttacgggaccccgtaaccgggtccccggttaagggtaacggggtacggtttacggggtttaccgggacctaaaccgttaagtttaaaccgtttaaccgttacgttaaaccgtaaaacgttaaacgttaacgttacgtaaacggtaatttaacggttaaccggtttaaaccgttttaccggtttttaccgggaacccgggttaagggggtaaaaaaccgggtgggttaacgggtacgtaccgtaacgaaaccggttaacggttcgggtacggtaccgtggtaacctaccgtacgttccgttacgttaccgttaccgttacttcccgttaaccccgg

SEQ ID NO: 153880 - DNA, 593 bp, Homo sapiens
  misc_feature: GYAE6OF02FVAEF.24.59.F04.1.454.CMB.1.raw
  modified_base (217)..(217): a, c, t, g, unknown or other
  misc_feature (217)..(217): n is a, c, g, or t
tcagactactatgtcacgaccggtgctcgatttagtacacacacttagggattgggcacagcgtggacatgagggtccctgctcagctcctgggcctcctgctgctctggctcccaggtgccaaatgtgacatccagatgacccagtctccttccaccctgtctgcatctgtaggagacagagtcaccatcacttgccgggccagtcagagtgttcngcctgggtgcctggtatcagcagaacgaggaagcccctaaattcctgatctatagctacttagtttacaaggtcgggtcccttacgaacggttcagtcggacgtagtggatcgtagggaactaggaattccgacttctacactaatcgaagcagccctgaccagtcctagtatcgtagtttcgacttaacttacttacctgaccctaagtagttatgtaattcgacgtttacctcccgtacgttaccggaccgtacgggaccacggtcgttacggtaactacgttaacgtaccgtacttcggtacgtccgtagacccgtactacgttccgttacgttccttaccgtacgttcccgttacccggtactacgttaccg

SEQ ID NO: 153881 - DNA, 732 bp, Homo sapiens
  misc_feature: GYAE6OF02GQ7TN.24.59.F04.1.454.CMB.1.raw
  modified_base (181)..(181): a, c, t, g, unknown or other
  misc_feature (181)..(181): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtcttttcttgtggctattttaaaggtntccagtgtgaggtgaagttgttggagtcgtgggggagtccgttgggttccgggcccggggggtccctggacgtactctcagtgtgcagcctcgtggtattcactactttaactacgtaatggctagtgtaggttggctcgacgccgaggtccgtccggaagggggaacggggtcgtggggtaggtcggggtccgtccgttgggttacgggtggggagtgggaccttacgaactacgtagttccgtaccgggcgggtccgttccggtaggaacgggtccgtaattccgacctacttccgtaccgtaacggtaccttttacccaaagaaccacgtactacgtaactcgtaaggtaaatacgaactacgtacgtagacgacggtaaccgacgtaaccgtaccggttaccttttaacgttagttacggtacgtaaccggtaaaggtacggtttaacgttacggttacggtaccggtacggtaacgtttaccgtcccggttccttacggtacggtacgggtaccgggtaccggtaacgggtaccccgtggtacccg

SEQ ID NO: 153882 - DNA, 667 bp, Homo sapiens
  misc_feature: GYAE6OF02HBJNG.24.59.F04.1.454.CMB.1.raw
  modified_base (220)..(220): a, c, t, g, unknown or other
  misc_feature (220)..(220): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgtcgttttctggtggctaattttaaaggtgtccagtgtgaggtgaagttgttggagtcgtgggggancgttggttcgggccccgggggtcctggacgactctcatgtgcgagcctctggacttcactatttaactaacagtgcatgacgttgctaccgcaggctcgagggagggctggaggtcggtcgcgttcgggttaggttaggggagtggactacaacgactattcaccggtcgggactcggtaggacgggcctacgttcactacgtctaacgtaacgtacctttacgaagaacctacgctagaattcgtaggaaactcgaacgtagtgtacgagacgtacgaacaccgtaccgtaccgttttattacgttagttcgggaaggtaaacgtagggtttacgtacggttacggggtacgtaccgtacgggtttaaccctcccggttacgtttacggacgttaacgggtcgggaaccggtaaccggggtaccccgtggttaccccggtaacccg

SEQ ID NO: 153883 - DNA, 916 bp, Homo sapiens
  misc_feature: GYAE6OF02HKKTE.24.59.F04.1.454.CMB.1.raw
tcagactactatgtcacgaccggtgctcgatttagtacacacacttagggattgggggtctgagagaggagcccagccctgggattttcaggtgttttcatttggtgatcaggactgaacagagagaactcaccatggagtttgggctgagcggtgtcgttttctaggtcggctaattttaaaggtgtccagtgtgaggtgtaagttgttggagttcgtgggggagtccgtttgggttccgggccccggggggtccctggacgacttctcagtgtgcacgcctcgtcggtattcaccttatttaacgtaactaagtggactagtggtacggttcggccttcccggccgacggtcccgttaccgggaagggggtaacgggggaccgtggggtagggttacgggggtcccgtacccggtttacgggggtttaagggtcgggggtaaggttacgggtacgtaaacctaaacgacttacgtttaccgtaacgggtccggggtcccgtttaccgggtacgggtaaacggggaccgttaacggtttcccaaacccgttacgtttacccgttaacccgtaaacggtttaaccccttttaacccggaaaacgtaaacccgtaccggttaacccttaacggtaaacgttacccgggtaaaggtaaaaacgtacggttaaaacctacggtttacggtaaggtaacgtaacgggtaccgaacgggtaaccctaaccgggtttaccctttaagtttagttcggtaaccgggtaaaggttaaacggttaacgggtttaactaccgggtttacgggtaccggttaacgttaacggttttaccccgtacccgtttacgtttacgggaaaccggttacgggtacccggggtaaccggaaccgggttaaccccgtcggttaacccgttcccgg

SEQ ID NO: 153884 - DNA, 716 bp, Homo sapiens
  misc_feature: GYAE6OF02JG15S.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtcgttttctaggtggctaattttaaaggtgtccagtgtgaggtgaagttggttggagtcgtggggagccttggttcggcccgggggtcctggagactctctatgtgcagtcctgtaggatttcactaattttaaacacgtaatggacatgaggttggctccgccaggcctaccgaaggggaacgggcgtaggaggtcgggtccgtccgttacgggttaaggtcggggtagtgggactacgaactaccagttttacgacggtccgggtcctacccggtaggaaacggggtcccgtaatttcccgaacgtactccgttaccgaacgggttaaccttttaccgaaacgtaaaccgtaccgtaccttaggtaaacgttccgtaaggtaaacttaggaaactaacgtccgtagaacgtacgtacggacgacgtaccgtacccgtttagttacttgtacgagtaaacggtacggttagtacgtcgtaccggtactacgttaacctcccgttccgttacgaccgtacgtacgggtaccgtaacggtaacccgttcggtacctacccgg

SEQ ID NO: 153885 - DNA, 707 bp, Homo sapiens
  misc_feature: GYAE6OF02GNSXS.24.59.F04.1.454.CMB.1.raw
  modified_base (154)..(154): a, c, t, g, unknown or other
  misc_feature (154)..(154): n is a, c, g, or t
  modified_base (176)..(176): a, c, t, g, unknown or other
  misc_feature (176)..(176): n is a, c, g, or t
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggngtgttctaggcgctattaaggntcagtgngagtnagtgtgngtcgtgggnctggtcggccggggtctgagctctgatgtgctgcctntaggtnttcatacttacgactaatggntagtcgtgttcggctccgccgaggtcctaccggaggggaacggtcgtgggaggttcgggcgtccgttccggttaggtaccggggtgttccgggaccgttaaccgaactacgtactttttacggaaccggtcgggtcctttacccggaggtaacccgggacccggttaattcccggtaaacctcgttacccgtaccgtaaaccggtttacccgttttaaaccgaaacgaacgtaaccccggttagtaacgtactacggtaacgaaacgtacgacgtaggtacgaggtaccgtagtaccggaccgtacgttaccgtttaccgtttagtttcgtacgtacggaacgttacggaacgtttctacgggtcgtaccgtaaggttccgtacccgtcgtacggtaacgacgttacgggtcggaaccgtacggtcgtaccgcccgtac

SEQ ID NO: 153886 - DNA, 752 bp, Homo sapiens
  misc_feature: GYAE6OF02H7LJ2.24.59.F04.1.454.CMB.1.raw
  modified_base (221)..(221): a, c, t, g, unknown or other
  misc_feature (221)..(221): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctaattttaaaggtgtccagtgtgaggtgtaagttgttggagtcgtggggganccgttgggttccgggccccgggggtcctggagtacctctcatgtgcacgtcctcgtggattcactaatttaacctacaagtggactagtggtagttcggtcctcccggactacggccgtaccggaagggggtaacggggtcgttggggaacgggttcggggtccgtcccggttacggggtttagggtcggggtaacggttcgggaacctaacgaaacctaccgtacgttttaccggaaccgggccgggtacccgttaccggtacgggtaacgggggtccctaacgtttcccgaacccgttaacttaccgttaacccgtaacggttaacccttttaacccgaaacgtaaaccgtaccgtacgtacgtaacgtacgtaaggtaaactacgtaacgtagtacgtagaacgtacgaccgacgacgtaccgttacctttagttacgttagtcgtaagaaggtaagttatagtacggaccgtagtacgtcgtccgtcgtagacgtacggtacggacgacggtaccgtcgtcgtaccg

SEQ ID NO: 153887 - DNA, 761 bp, Homo sapiens
  misc_feature: GYAE6OF02F2I6T.24.59.F04.1.454.CMB.1.raw
tcagactactatgtcacgaccggtgctcgatttagtacacacacttagggtaggtttggggcgactaggcgtggaccagtgaggggtccctgctcagcctctgggcctcctcgctggcttctcggtctctcgaggttgccatatgtgacacgttccgagagtcgacccgaggtaccgtcccagtcccgttcccgttgtcgtggtctattcgtaggtgggagacgtagtagtaccacctatcgttccgttcgtcccgtagggaccggaacgggttccgacgggtacctaactttaaacttaccgtttaggtaaagttcggtaactaccaactaaacgaaaaaccgacggtaacgtaacggtacccctaaacgtaccgtaggtaccaacggtatacgacgactaccgaacgtcgggtacgaccggacggggtcccctagttacgtaacggttcgacggacggtacggtaggtaagtacgtacggtacggtacttacgtttccgtacgtaccttaccgaccgacgtacggtaccggtccgtccgtacggtcctcgtacgtacggtacggtcgtacggttacgacctacgttacgttacttaccgcgtaccgttacagttacgcgtacgacgttacgtacgtaccttacgggtacgaccggaagggtacggtacggtacggaccgtacgtacggtaacgtcggttacggacgttcgaccttacgacgttacgttccgtcgttactcggtcccgtacgtaccccgg

SEQ ID NO: 153888 - DNA, 661 bp, Homo sapiens
  misc_feature: GYAE6OF02F3MZK.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctcctgtctgcatctgtgggagacagagtcaccatctcttgccaggcgagtcgagggctattaacttactttagtaattggtatcactacaaaaaccgaggaccgaacgggacccctaaacgtccgtacggtacaaacgtatagcactaccgaagtcgggtacgccgaccggggaccccctagtcgtaacggttcacggcggctaagtacgagtcgtagggactacgtttctactacccgttccacctatccgacggccgaccttgacgacgccgtagggaggtacttggttcgactaacgtaattaacttacgttacgtactaaactaattaacgtacggaacttaagtaagtttaccgttaaccgtttacgttttacgggtaaccgggtaagggggtaaaccggtaaaggggttcgtaacgtaccgttaacgaaacggttaaccgttgggtacggtactacggacctacgtacttcgttcgtacttccgtaccttccctaccccg

SEQ ID NO: 153889 - DNA, 822 bp, Homo sapiens
  misc_feature: GYAE6OF02HV408.24.59.F04.1.454.CMB.1.raw
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (538)..(538): a, c, t, g, unknown or other
  misc_feature (538)..(538): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcggtgtgttttctaggtcggtctaagttttaaaaggntcagtgtgagtnagttgtggatgtggggatccgttgggtcggcccggggtcctgagactcgtacagtgtgcacgtcctgtaggtaatcctaactaattttaaacctacgaagttcggacttagtaggtacgttggacctcccggactaacggtccacggtacggggaagggacgtggtaggttcgggtaccgtccgttggtaaggttagggagttaccggactaacgaactcgtaaatttccgaaaccgccgggtaccgtttcggaaacggacggggtacctacctttacgaaccctagtaccgtaaccgtaaacgtttaccgttttaacgaaacgttaaacgacccggtntaaacgtaaactacgttaaggtaaaacacggtaaacctaaggttaccgtacggaagttaaccggtaaccggaaactaccggtaacccggttaccgttttaacgttaagtttacggttaacggtaaaaggtaaaggttaacggggttaaccgttacgggtaaccgggtttacccggtaacggttaaacggtttcccggttaaacccggttcgtttaaccgggtaacgtaaaccggggttcggaacccggttacccgggtaacgttccggtaccgttaaccccggg

SEQ ID NO: 153890 - DNA, 883 bp, Homo sapiens
  misc_feature: GYAE6OF02ITZON.24.59.F04.1.454.CMB.1.raw
  modified_base (276)..(276): a, c, t, g, unknown or other
  misc_feature (276)..(276): n is a, c, g, or t
tcagactactatgtcacgaccggtgctcgatttagtacacacacttagggattgggggctctgagagaggagcccagccctgggattttcaggttgttttcatttggtgatcaggactgaacagagagaactcacatggagtttgggctgagtcgtggtctttttcttgtggtcttaagttttaaaaggtgtccagttgtagaggtagtaagtttggttggagtcggtggggacgtccgttgggttccgggcccggggggtcctaggacgtacctntacgtagttggtcgccgacgtcccttgtaggtacttcgtaacttaatttaaacctactaagtcggtacgagttgtacggttcggtccctcccggaccgaggtcctaccggaagggtacggggcttcggggtaggtcgggtcggtaccgttacgggttaggtacggggtaggtcggtacctaaacgacctaacgtacgttaccgtaccgggcggtaccgttccggtaagggaccggtccgtaacgttcgaacccgtagttaccgtaccgtaaacggtttacccgttccctaaaaagggtaccctaaccgtcgtaaacttaaacgtaccggttaaacggtaaagttacggtaaaccgttacgggttaccgtaacggtaaaggtacccgggttaaaccggggaaactaaccccggtttaaccgggtttacccgtttttaaagtttaaccggtttaacggtacggggtaaaacgggtaaggggttttaaccgggtttaattaccgggttacggggtaccccttaaaggtttccctaccggtacccgtttacggtttacgaacgggttacgggtccgaaccgggtaacccgggttcccgttagttaccccgg

SEQ ID NO: 153891 - DNA, 572 bp, Homo sapiens
  misc_feature: GYAE6OF02JCWTO.24.59.F04.1.454.CMB.1.raw
  modified_base (449)..(449): a, c, t, g, unknown or other
  misc_feature (449)..(449): n is a, c, g, or t
  modified_base (481)..(481): a, c, t, g, unknown or other
  misc_feature (481)..(481): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtctgggggagccttggttcggcccgggggtccctgagactctcatgtgcagcctctggattcacatttaacacaatggcatgagttggctccgcaggctccgagggaagggctggagtgggtcgcctcgggttagtgggagtggctacaacacatttctacggcgggctccggtgaaggggccagttccacatctacaaggtacttttaccaagaacacgctagaatctaggaaatgaaacngtctgagagtcgacgacgacggtccctttatnttgtgcgaaagtagggttatagtggtcggacgtagttactcccgtactttcgacgtagtcgggacctacgggaaccctggtacctacccgg

SEQ ID NO: 153892 - DNA, 599 bp, Homo sapiens
  misc_feature: GYAE6OF02I1D4V.24.59.F04.1.454.CMB.1.raw
  modified_base (217)..(217): a, c, t, g, unknown or other
  misc_feature (217)..(217): n is a, c, g, or t
  modified_base (361)..(361): a, c, t, g, unknown or other
  misc_feature (361)..(361): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtctggggganccttggttcggcccgggggtccctgagactctcatgtgcagcctctggattcacatttaactacaatggcatgagttggctccgcaggctccgagggaagggctggagtcgggtcgcctgggttagtgggagtggctacgaacncattcacgcgggctccgtgaagggccattccgacatcctaccaagtctttaccaagaacacgctagatctagaaatgaacagtctagagagtacgacgacgacgtaccctttattacgttgtagcggtaaagagggtttactaggttcggtaccggaacgtaggttacctacccggtccgtttacgaccggtaagttcggggacccgtaacgggtaacccgtacgggtacctacccgg

SEQ ID NO: 153893 - DNA, 641 bp, Homo sapiens
  misc_feature: GYAE6OF02GSP1K.24.59.F04.1.454.CMB.1.raw
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (305)..(305): a, c, t, g, unknown or other
  misc_feature (305)..(305): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (428)..(428): a, c, t, g, unknown or other
  misc_feature (428)..(428): n is a, c, g, or t
  modified_base (577)..(577): a, c, t, g, unknown or other
  misc_feature (577)..(577): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttggctgagctggctttttctgtggctattttaaaaggtgtccagtgtgaggtgagttgttggagtcgtgggganccgttggttccggcccgggggtcctgagactctcatgtgcagcctntggacttcactattaactacaagtgacatgagtgcctccgcnggcctacgagggaggcgnggaggtggcgcgtggttaggngagtgcacacatactcgacgcggtcaccggtgaacggtcctattccaccgtatcctacgaacggttacctttacgaacgaaccncgtactagtaactacgtaaggtaattacgaaacgtagtctacgagtacggtacgaccgaacgtacccgggttacctttagttacgttcgtaacgggtaactaaagggtcgttaactacgtacgggtaccggtaattaacggtttacccncccgtttaccgttagaacggttaccggcgggtacccgtaacgggtaaccccgtggttaaccccg

SEQ ID NO: 153894 - DNA, 670 bp, Homo sapiens
  misc_feature: GYAE6OF02HLE31.24.59.F04.1.454.CMB.1.raw
  modified_base (250)..(250): a, c, t, g, unknown or other
  misc_feature (250)..(250): n is a, c, g, or t
  modified_base (278)..(278): a, c, t, g, unknown or other
  misc_feature (278)..(278): n is a, c, g, or t
  modified_base (319)..(319): a, c, t, g, unknown or other
  misc_feature (319)..(319): n is a, c, g, or t
  modified_base (384)..(384): a, c, t, g, unknown or other
  misc_feature (384)..(384): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtcctccttccaccctgtctgcatctgtaggagacagagtcacatctcttgccaggcgagtcgaggctaatttaacttctttagtaattgtatcaatacaaaacngacaacggacctaactctgtacaacgangcatccagtcggcgccgacggcccatcgaagttcagcgganagtagacgtcgtggactactttccgttaccaaccttccaactacgtccacggtccgtctcggacncggtacccgtaggacggtagttcggttacggactaactaatttacgttacgtacgttaacctaaactaagtttacgtaacgtactaagttacttaacgttaaccttttaccggtttacggaaccggggtaacggggtaacggtaaggggttaccggtaacgttaccgtaaaccgggtaaacgttacggttacgggtaacggtccttaccggaccccgtaaccgttcgtttacccgttacgttttacccttaacgtttacccgtttccccggttaccccgttaaccg

SEQ ID NO: 153895 - DNA, 743 bp, Homo sapiens
  misc_feature: GYAE6OF02H778O.24.59.F04.1.454.CMB.1.raw
  modified_base (267)..(267): a, c, t, g, unknown or other
  misc_feature (267)..(267): n is a, c, g, or t
  modified_base (472)..(472): a, c, t, g, unknown or other
  misc_feature (472)..(472): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccactcctccctgtctgcatcgtggtgggagacagacgtcacctatctcttgccgaggcgagtcgagggactaatttaacctagtttagtaaagttggtatactataacgaaaaacgnggaacgaacggtacccttaaaccgtccgtacggtactaacggatcaactactaaccgtaagtcggtacgaccggaaccgggccctacgtaccgtaaacggttccgaacggtcggtactaaggtaacgtacgttcggtacggtacgttaacgtttccgttacctacccgtttacgaacctacgtaccgtaccggttccggtacccnggttacccgacggtaccggttaccggtagggtaacggtttggttaccggtaccgtaaacgtacggtttacttaaccgtacggtttaaacaaaccgttaaagtaccgtaagtaaccggttaattaaccggtttaagttaacccggttacttacggggttaccgaaaggggtacgggtaaggtaaggttaccgacgtaaccgtaaacgtacggtcggagtcctacgggacctacggtacttacgtgtttaccctactccggttacctacccgg

SEQ ID NO: 153896 - DNA, 702 bp, Homo sapiens
  misc_feature: GYAE6OF02INLYT.24.59.F04.1.454.CMB.1.raw
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccactcctccctgtctgcatctggtgggagacagagtcaccatctcttcgccaggcgagtcgagggactaattaacttactttagttaaattggtatacaataaccaaaaacaggacgaacggaccctaaactcctagtacaacgactgactactaccgaagtcggtcgaccgacgggaccccagtacgtaacggtacgacggcggacgagtacgtagtacgtacgggtactactttcttacctaccttacctaacctactacgacggtaccggccgtacgacgtacgtccgtaggaggtacgttaggttacggacctaacgtacttaacgtttacgtacgttaacctaaagtaaacttaacgtacgaacgttaagttacgttaacgtttaaccgttacggttttaacggacccgggttaaggggtacggtaaagggtcggaacgtaccgtaacgtaaaccggtacggttaggtaccggtacgttaccggaccgtaaccgtacgtttaccgttcgtttacccgtttaccttacccgtttacccggttaccccg

SEQ ID NO: 153897 - DNA, 681 bp, Homo sapiens
  misc_feature: GYAE6OF02H915J.24.59.F04.1.454.CMB.1.raw
  modified_base (207)..(207): a, c, t, g, unknown or other
  misc_feature (207)..(207): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggngtcgtgggggagtccgttgggttcgggcccgggggtccctggagacctctcatgtgcagcctcgtggattcactatttaactacaagtggcatggtagttggctccgccaggccgtccgaggggaaggggcgtggaggtcgggtccgtccgtcgggttagtgggagtggactacaacacgtacttctacggcggtcgtaccggtcggaagggccgtagtccaccgacttaccgtaccgaacggtaccttttaccgaagtaaccacgctagaactcgtaggaaatacgaactagtacgtagacgtacgtaccggacgaaccgtaccggtccctttaagtttagttacgtacgtaacggaaaggttaacggttacgtacgtagggtaccggtacgtaacggttacctcccggttccgtttacgaacggttacggtacggggtacccgtagggtaaccccgtcgggtaccctaccgg

SEQ ID NO: 153898 - DNA, 745 bp, Homo sapiens
  misc_feature: GYAE6OF02GQDJY.24.59.F04.1.454.CMB.1.raw
  modified_base (178)..(178): a, c, t, g, unknown or other
  misc_feature (178)..(178): n is a, c, g, or t
  modified_base (256)..(256): a, c, t, g, unknown or other
  misc_feature (256)..(256): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatccctccctgtctgcatctgtggganacagagtcaccatctcttgccaggcgagtcgaggggcattaactactttagtaaattggtatcgaatacaaaaaccgnggacaacgggacccctaaactccgtaggtacaacgtatacgcactacccaagtccgggtacgaccgacggggcccctagtaccgaaacggttccaacggtccggacgtacggtacgacgttcgtacgggacctacgtttacttccgtaaccttaccaccgtatccgacggccggtccctaggctacgccgttaggaaggtcgtaggttcggacctaacgtaactttaacgttaacgttaggtaaccctaaaaccgtaagttacgttaacggaacgttaattacggtttacggttaacccgtttaccgttttacggggacccgggttaaagggggtaacccggtaaaggggttcgggtaaccgaaccggtttaaccggaaaacccggttaacggtttacggggtaccggtacttaccgggaaccctaacccgttacgtttaccgttcccgggttacctttaaccgtaccgtttccccggttaaccccccg

SEQ ID NO: 153899 - DNA, 726 bp, Homo sapiens
  misc_feature: GYAE6OF02HBNMN.24.59.F04.1.454.CMB.1.raw
  modified_base (141)..(141): a, c, t, g, unknown or other
  misc_feature (141)..(141): n is a, c, g, or t
  modified_base (357)..(357): a, c, t, g, unknown or other
  misc_feature (357)..(357): n is a, c, g, or t
  modified_base (578)..(578): a, c, t, g, unknown or other
  misc_feature (578)..(578): n is a, c, g, or t
tcagactactatgtcacgaccggtgctcgatttagtacacacacttagggattgggcacagcgtggacatgagggtccctgctcagctcctgggccctcctgctgctctggctctcaggtgccatatgtgacatccagatnacccagtcctaccactccctccctgtctcgactatcgtggtagggacgacaggacgtccaacctattcctcgttcgacccgaagggtccgtaaggtccggaagggaccttaaacgtttaacccttagttttagtaaaagtttcggtaactacgtaataaaaccgaaaaaccgtggaaccgaacggtaaccctaaacgtccgtacggtacaacgtancgactaccgacgtaacgccggtacgaccggtacggccccctagtaccgtaacggtcgaacggtacggacgaaggacgtacgtacgtagggtacttacgtttcgtaccctacgttacccaccgttacacgtacgtcggccgttacgaccgtcgtacggacgtaggtagttaggaccggttagaaccttaacgttacgttaacttacgtaactaaacgttaanaacgtagtacggtaactaggttaaccttagtaccgttacggtaaccgaaggggtttaaccgggagtaacggtaccgattaaccggaacgttacgaggtacggtactaccgaccgtaactccgtactgtactacgtacctcggtacccg

SEQ ID NO: 153900 - DNA, 841 bp, Homo sapiens
  misc_feature: GYAE6OF02HAYH9.24.59.F04.1.454.CMB.1.raw
  modified_base (209)..(209): a, c, t, g, unknown or other
  misc_feature (209)..(209): n is a, c, g, or t
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
tcagactactatgtcacgaccggtgctcgatttagtacacacacttagggattggggtctgagagaggagcccagcccgtgggattttcaggttgttttcatttggtgatcaggactgaacagagagaactcaccagtggtaggtttgggctggagcgtcggtcgtttttcgttggtcggtcttaagttttaaaaggtgtccagtgtgnggtgtaagttgttggagtcgtggggagtccgttggtccgggcccgggggtcctgacgctctnagtgngcgagcctcgtaggtactcactaatttaactcaagttggctagtcggtagttcggcctcccgaccgcggtcctaccggaagggggcggggccgtggacggttcgggcgtaccgttcgggttaggtgggaggttcggactaaccgaaccgtatacggttaccgacggtccgggtacgttaccggacgggtaaaccggtcccggtaacttcccggttaacccgaacgttttccccgtaacccggtaaggaaaccgtaaaccctaaacccgtttaccaaaacccgggttaaacctttccgggttcctttaacggttttcccggttagaaaccggtaaacttacgttaaactccggtcgttaaccgccgttaacggtcgtaaccggaaggaaccccgttacggttccgtttgttaacccgtttaaacgtttccgtacgggtttaaccacgggttaaaccgttcccggtttaccccccggtcctttttaccggtaaacgtttaaccgggttttcggttaccgggttaccccgtaccccgtttaaaggccggtttccggaaccggttcggg

SEQ ID NO: 153901 - DNA, 769 bp, Homo sapiens
  misc_feature: GYAE6OF02HTVYT.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtgcgttttctaggtggtctaatttaaaggtgtccagtgtgaggtgaagttgttggagtcgtgggggagccgttgggttcgggtccccgggggtccctgacgactctcatgtgcagcctctggattcactatttaacacaatggcatgagttgctccgccaggcctaccggagggaaggggcgtggaggtcgggtcgccgttcggttaggtggggacgttggactacgaacacgtactttaccgtaccggccgggtaccgttccggtagggtaacggggtccgtactttaccgaccgtacttacccgtacccgtaaaggttaccctttttaacgaaacggtaaccaaccggtaccgtagtaaacttcgtaaggtaaacttacggaactagtacgttgaaacgggtacgtaaccggacgacccgtaccggttacccttttagttacttacggttacgtaaacgggtaaaggttaacggggtttaacttaggtttaccggggttaccggtaaccgtaacggtttaccgttaccccgggttaccttttaccggacggttaaccggttccggggaaccggtaccccggggtaacccggtaccgggttacccgtaaccccggg

SEQ ID NO: 153902 - DNA, 861 bp, Homo sapiens
  misc_feature: GYAE6OF02J07YF.24.59.F04.1.454.CMB.1.raw
tcagactactatgtcacgaccggtgctcgatttagtacacacacttagggagttggggtctgagagaggagcccagccctgggattttcaggtgttttcatttggtgatcaggactgaacagagagaactcaccatggagtttgggctgagctggctttttctgtggctattttaaaggtgtccagtgtgaggtgaagttgttggagtcgtgggggatccgttgggttccgggcccgggggtcctgacggtactctcgatgtcgcagcctctggtattcactatttaactacaagtcggacatgagttcggcctaccgccgaggctccggaagggaggggctgggaggtcgggcgtccgtggttaggtgggtaggtcggactaacgaacgtactagttccgtacggtccgggtacttcccggtagggaacgggtcccgtacgttaccgacccgtacttcccgtaccgaacggttaaccgttttacccgaaacgtaaccgaaccggtaccgtacgtaacgttaccgtaacggtaaacgttacggaaaaccgttagttaccggtaacgggtaacggtaacggtaacccgggtaacggtaacccggttaacccgggttaccctttttaaacgggtttacgtttaccggtttaacgggtaaccggttaaaacggggtaacggggtttaacgtttaaccgggttacgggttaacccgggttaacggttaaacccgggttttaaccgttaccccgggttaacccggttttaccggtaacccgggtttaaacgggttacccgggggtaacccggttaacccgggggttaaaccccggttaccggggttaaccccggtttacccccggg

SEQ ID NO: 153903 - DNA, 835 bp, Homo sapiens
  misc_feature: GYAE6OF02GNPEQ.24.59.F04.1.454.CMB.1.raw
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
tcagactactatgtcacgaccggtgctcgatttagtacacacacttagggattgggggctctgagagaggagcccagccctgggtattttcaggttgttttcatttggtgatcaggactgaacagagagtaactcaccatggagtttgggctgagcttggtactttttcgtgtggcttaattttaaaggtgtccagtgtgtaggtgtaagttggttggagtcgtggggatccgtttcgggttccgggtcccgggggttccctaggtacgtaccttctacagtgtcgcacgtcctcgngtacttcactaatttaacaanaagttganacgtaggtagttcggtcctccggccaggccgttaccggaaggggaacgggcttaggggtcgtcggggttccgtccggttagggtttaggtcggggacgttacgggaccctaaagtaaaccgtaacgtaccgtttacgtaacccgggggtccggtaccgtttacccgggtaacgggtaacccggggtaccggtttaacccttacccggaacccgtttaacgttacccgtaaaccggttaaacggtttaccccgttttaaaccgaaaacggtaaaccgacccgttacgggtttaactaaacggtttacggaaaggtaaaacgttcggaaacttacggtcgtaagtaaacggtagtaacggacccgtaaccgtaccggtttacttttaagtcgttagacgtaacgtaaagggttacgttacgtaggtacgggtaccgtaattacccggtaacgtacccttcggttaacgtacggtacgggtacggacccgtacgggtacccgtgtaacccgg

SEQ ID NO: 153904 - DNA, 716 bp, Homo sapiens
  misc_feature: GYAE6OF02F1RO1.24.59.F04.1.454.CMB.1.raw
  modified_base (184)..(184): a, c, t, g, unknown or other
  misc_feature (184)..(184): n is a, c, g, or t
  modified_base (291)..(291): a, c, t, g, unknown or other
  misc_feature (291)..(291): n is a, c, g, or t
tcagactactatgtcacgaccggtgctcgatttagtacacacacttagggattggggtctgagagaggagcccagccctgggatttttcaggtgttttcatttggtgatcaggactgaacagagagaactcaccatggagtttgggctgagcggtgtcgtttctaggtcggctaatttaaaggngtcagtgtgagtgaagttgttggagtcgtgggggatccgttggttcgggcccgggggtccctgagactctacatgtgccagtcctgtggattccactatttaacaanaagtggacattggacgttggaccttccgccaggcctccggaggggaacgggtctgggaggtcgggtaccgccgttgggttaagtggggaagttggacctacgaactacgtatttaccgacggcggacttaccggagtaacggggcccagttcccacctaagttccctactaacgggttacttttaccgaaaggaacctaacgtccgtaaggtaacttaccggtaagtaaagtagtaaacacgtctaggagtacgtcggaacgtaacaaccgggttcctttaacgttaacgttggttacgtaacgtaaaggttaggttacgtaagttaccggtaccgtaggtaacggtttaacctcccggttaccgtttacggaacggaacggttacgggacccggtaagggtaccccgttaggtacccgttaacc

SEQ ID NO: 153905 - DNA, 272 bp, Homo sapiens
  misc_feature: GYAE6OF02HWRVA.24.59.F04.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (261)..(272): a, c, t, g, unknown or other
  misc_feature (261)..(272): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctggtggganacagagtcaccatctctnccaggcgagtcgagggactattaactactttagtaaattggtatcatacaaaacaganaacggtnnnnnnnnnnnn

SEQ ID NO: 153906 - DNA, 720 bp, Homo sapiens
  misc_feature: GYAE6OF02GP3Q1.24.59.F04.1.454.CMB.1.raw
tcagactactatgtcacgaccggtgctcgatttagtacacacacttagggattgggggtctgagagaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccgttgggttccgggcccggggggtccctgagactctcatgtgcagcctctggattcactatttaactacaagtggacatgagttggctcccgccgaggcctccgaggggaaggggcgtgggaggtcggggtccgccgttcgggtttagggtggggaggtggactacaacgactattcgtacggcgggtctccggtaggacgggccgattccacctatcctaccgaaggttaccttttaccgaaacggaaccaccgtagtagaacgttacgtaggaaacttacggaaactaggttacgtaggaagtacgtaccgggaacgtaccgaaccgggttacccttttaatttacggtttagtacggtacggtaaaacggttagggtttaaccgtagttaccggggtaccggtaacgttaacggtttaccgttaccccggtcgttttacggaaccggttaaggtcgggggacccgtaacggggtaacccgttgggtccctaacccgg

SEQ ID NO: 153907 - DNA, 661 bp, Homo sapiens
  misc_feature: GYAE6OF02JE489.24.59.F04.1.454.CMB.1.raw
  modified_base (207)..(207): a, c, t, g, unknown or other
  misc_feature (207)..(207): n is a, c, g, or t
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
  modified_base (390)..(390): a, c, t, g, unknown or other
  misc_feature (390)..(390): n is a, c, g, or t
  modified_base (427)..(427): a, c, t, g, unknown or other
  misc_feature (427)..(427): n is a, c, g, or t
tcagactactatgtcacgaccggtgctcgatttagtacacacacttagggattgggcacagcgtggacatgagggtccctgctcagctcctgggcctcctgctgctctggctctcaggtcgaccatatgtgacatccagatcgacccgagtcctccattccctccttgtcctgcatctggtggagactaggcgtccaaccattcgtntcggaccgagggtcgagtccggaggtacttaacttaacgttacgtttagtaaagttcggtactgaactaacgaaaaccgtagacgaacggtaacctaactccgtgtacaacgtntacgtcacacacgtcggtcgacggacggacccgtanacgtacggtacaggacgcgtacgtagcgtacgnggtactatcttcgtaacctcaactctacgacgcgtcngactacggccgtaggacgtgtacggttcgacctaaggttatacgttacgttctaaacgaaactattaacgtcgtaacgtaacgttaagttaccgtaccgttttagggtaccggtacgggtaaacgggtaacggtaggtacggtaccgtaactaccggtaaacgtcggtaacggtccgtggttaacccgaccgttcttaacgtcgtaccgttatccggttacctcccggttaccc

SEQ ID NO: 153908 - DNA, 605 bp, Homo sapiens
  misc_feature: GYAE6OF02IHRXF.24.59.F04.1.454.CMB.1.raw
  modified_base (157)..(157): a, c, t, g, unknown or other
  misc_feature (157)..(157): n is a, c, g, or t
  modified_base (182)..(182): a, c, t, g, unknown or other
  misc_feature (182)..(182): n is a, c, g, or t
  modified_base (217)..(217): a, c, t, g, unknown or other
  misc_feature (217)..(217): n is a, c, g, or t
  modified_base (266)..(266): a, c, t, g, unknown or other
  misc_feature (266)..(266): n is a, c, g, or t
tcagactactatgtcacgaccggtgctcgatttagtacacacacttagggattgggggtctgagagaggagcccagccctgggattttcaggtgttttcatttggtgatcaggactgaacagagagaactcaccatggagtttgggctgagcggtgngtttctaggtggctattttaaaggngtcagtgtgaggtgaagttgttggagtctgggggnccgttgggttcggcccggggggtcctgaggactcgtcatgtgcagcctntggattcactatttaactacaatggcatgagttcgccgtaccgcaggctacgacgggaagggcgtggagtgggtcgacctcgggtagtggggagtcggactacaacacatttcaggcggtactcggaggacggcgattcactatctacagtctttacaagaacacgactagactacgaggtaaatcgaacgagtcgtagagtacgtcggacgacgtaccggtacctttagttagttgacgtacgtaaaggtaagggttactagttacggtccggtacgtacggttactcccgtacttggaacgtacgtcgggacgaccgggacctggtaccctacccgg

SEQ ID NO: 153909 - DNA, 785 bp, Homo sapiens
  misc_feature: GYAE6OF02HMO3E.24.59.F04.1.454.CMB.1.raw
  modified_base (184)..(184): a, c, t, g, unknown or other
  misc_feature (184)..(184): n is a, c, g, or t
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtcttttttcttgtggcttattttaaaggtntccagtgtgaggtgaagttgttggagtcgtgggggagtccgttgggttccgggcccgggggtcctgagctctcatgngcacgccttcgtggtcttacactaatttaacctactaagtcggnatgtagttcgctcccgcacggcctaccggagggaacgggcgttggaggttcgggtccgtccgttcgggttagggtgggtaggttcgggacctaacgaaccactactttccgaccggtaccgggtccttccgggacggaacggggtcccgttacgtttcccaaccgtacttaccgtaacccgtaacgggtttacccttttaaccggaaaactaacccgtacgtaccttaggtaaacgttcgtaaggtaaacttagaaaccgtagtacccgtaggacgtaaggtacccgaccggtaaaccgtacccggtttacccttttaagtttacgttaggtaggttaaccgggaaacgggttagtttaaccgttagggtacgggttacccggttacgttacggttccccttacccggttaccgtttaacggaccggtacggttccggggaccgtaacccggggtacccgttacgggtaccctaccccgg

SEQ ID NO: 153910 - DNA, 646 bp, Homo sapiens
  misc_feature: GYAE6OF02I49EZ.24.59.F04.1.454.CMB.1.raw
  modified_base (286)..(286): a, c, t, g, unknown or other
  misc_feature (286)..(286): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (459)..(459): a, c, t, g, unknown or other
  misc_feature (459)..(459): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggtctttttctgtggcttaatttttaaaaggtgtcctagtgtgaggtgtaagttgttggagtcgtgggggagtccgttgggttccgggccccggggggtccctggacgacctctcagtgtcgcagcctcgtgnttcactatttacacaatggcatgagttggcctcgccagctcgagggacggcnggngtggcncgtgtgnggngtgcanacactnttcgacgcggtctcggaggaggctatccgctcgtctactaagtacctttaccgaataacgcgactagtatcgtaagaactgaactcgtangacgagtaccgaacgtacgtaccgttacctttagttacgttgcggtaaacggtaacggttaacgggttacttacggttacgggtccggtaaacgtacggtttacccgttacccggttacgttacggtaacggttacgggtccgggtaccggtaaccgggtaccccgttacgggtacccttaccccgg

SEQ ID NO: 153911 - DNA, 881 bp, Homo sapiens
  misc_feature: GYAE6OF02JQF5W.24.59.F04.1.454.CMB.1.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (290)..(290): a, c, t, g, unknown or other
  misc_feature (290)..(290): n is a, c, g, or t
tcagactactatgtcacgaccggtgctcgatttagtacacacacttagggattggggtctgagagaggagcccagccctgggatttttcaggtgtttttcatttggtgatcaggactgaacagagagaactcaccatggagtttgggctgagctggtctttttcttgtggcttatttttaaaaggtgtccagttgtggagtgaagttgttggagttcgtgggggatccgttggttcgggcccgggggttcccngacgactcgtacntgtgcagccgtntggattcgactntttaacacaatgtcattgaggttcgcttccgccgacgtcgacggacggggaagggtccgtaggaggtcgggtccgtaccggttcgggttaggtggggttggtcggttacctaacgaagtacctacgtttacgtaaccggtccggggtcccgttacccggtaggtaacccgggggtaccgttacgtttacccgtaacccgttacgtaccccgttaaccgtaaacggttttacccgtttttaaccggaaacccggtaaaccgaccgtaacccgggtttacgaaacgtttaacccgggttaaggtaaacttaaccggtaaaccgttaaaggttcccgtaaggttaaccggtacgggtacccgtaaaggtaccccggttaccgggttaaaccccttttttagtttaaccgtttagggttaaccggttaaacggtaaacggggtttaaacgttttaccgaacgggtttaccggttaaccgggtccgttaaacggtttacccgtttacccccggttacgtttacgggtaaccgtaccggggttccggaaccgggttaaccccgggtacgggtttacccggacccgtttaacccccgg

SEQ ID NO: 153912 - DNA, 766 bp, Homo sapiens
  misc_feature: GYAE6OF02HR7GO.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtcttttttcttgtggtcttaattttaaaaggtgtccagtgtgaggtgaagttgtggagtcgtgggggagtccgtttggttccgggtcccggggggtccctggacgactctacagtgtgcagcctcgtggtattccaactaattttaaactaacaaagttcgggacatggtagtttcgggctcccggccacggctacccgaagggggaagggcgtgggaggtcgggtcgtccgtcgggttagtgggtagtggactacgaacactattcgtacggcgggctccggaggacggaccgtatccacctatccgtaccgtaaggtacccttttaccgaaacgtaacgaccgacgttacgaacgttacgtaacggtaaatacggtaaacgtacgtacgttagaacggtacgtaccggaacgaacccgtaccgggttacccttttaacgtttagttcggttaacgtaacggtaaacgggttaaacgggtttaacttacggtacgggttaccggtaacgtaacggtttacccgttaccccggttacccgtttaacggaaccggttacggtaccgggggtaacccgtaaccggggtaaccccgttccggtaacccgtcccgg

SEQ ID NO: 153913 - DNA, 696 bp, Homo sapiens
  misc_feature: GYAE6OF02IMJ2L.24.59.F04.1.454.CMB.1.raw
  modified_base (294)..(294): a, c, t, g, unknown or other
  misc_feature (294)..(294): n is a, c, g, or t
  modified_base (556)..(556): a, c, t, g, unknown or other
  misc_feature (556)..(556): n is a, c, g, or t
  modified_base (651)..(651): a, c, t, g, unknown or other
  misc_feature (651)..(651): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatcgacccagtcctccatcctccctgtctgcatctggtggagacagacgtcaccatctcttgccgaggcgagtcgagggctaattaacttactttagttaattggtatcaataccaaaaaccaggacgacggaccctaactccgtacggtacaacgntcgcctactaccgtaagtcgggtcgaccggtaccggggacccctacgtacgtaacggttacgacggcggacgtaaggtagtacttacgggtacgggtaccttaacgttttaccttacccggttaaccctttaccgtaacccttacgtaccggtccgtacccgggtacccgtttcggaccctaacggtcccgtaggtaacgggtacgttcgggttacggacctactaagtttaacgttacgtacgtaactaagtaactagtanaacgttataacgttacgttaaccgttacgtttacgggaccgggtaagggtaacggtagggtacgacgtacgtacgaaacgtcggtacgtcggtanaccgactacgtacttcgttactccgttatccgttaccctacccgg

SEQ ID NO: 153914 - DNA, 791 bp, Homo sapiens
  misc_feature: GYAE6OF02IZ8YO.24.59.F04.1.454.CMB.1.raw
  modified_base (180)..(180): a, c, t, g, unknown or other
  misc_feature (180)..(180): n is a, c, g, or t
  modified_base (587)..(587): a, c, t, g, unknown or other
  misc_feature (587)..(587): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatcgacccagtctccatcctccctgtctgcatcgtggtggganacagacgtaccacctatctcttcgaccgacgggtcgtagtccgaacgggtactaaactttaaacgttacgttttaagttaaacgtttgggttacttacgaacttaaccgaaaaaccgaggaaccgtaaacggtaaccccttaaaccgttaccggtaggtaaccgaacgtagtacgaccgtaacctaccgtaacggttccgggtacgacccggaaccggggcccctaagtacgtaaaccgggttcgaacggtcggactaaggtaacgtacgtacggtacgggtaccttactttaccgttaccgtaccttaccaacgtacgtaccgacggtaccggtcgttaccgacgtacgtacgtacggaaggttcttggttacggactaacgtacttacgttactactaacgtaanaacgttacgtacgtaacggttattacgttacgttaacgttccggtttagggaccgggtaacgggaagggttaaacggtacggtaacggtaacccgtaacggtaaaccggtaacggttcgggacggttaaccgtaccggtaaccgaaccgtttacgttcgttaacggttacccttaccggttaccccggttacccgtttaccccg

SEQ ID NO: 153915 - DNA, 643 bp, Homo sapiens
  misc_feature: GYAE6OF02FSS1W.24.59.F04.1.454.CMB.1.raw
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
  modified_base (486)..(486): a, c, t, g, unknown or other
  misc_feature (486)..(486): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatccctccctgtctgcatctggtgggagacagagtcaccgatccttcgttcgccgagggcgacggtcgagggctaatttaactactttagttaaattggtatactataacaaaaaccgaggacgaacggtaccctaactccgtaggtacaacgatcgcactaccaagtcgggtcgaccggacgggccccagtactaaggttacacggacggacgagtagagtcggtaggactntttcctctactcaacctancgtacgccgctcgacgacgctaggaggtagttcggtagactactagtacttacgttacgactaactaagtagtacgtaacgtnttaagtacgttacgttacgtttacgggaccgggtaaggggaacggtaacgggttcgggtacgtacgttaaccggtaaacggtacggttggtaccggttctacggacctaaccgttacgttcgttaccgttacctttaccgttactcccgttaccccg

SEQ ID NO: 153916 - DNA, 751 bp, Homo sapiens
  misc_feature: GYAE6OF02I9TU1.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggctttttctgtggctattttaaaaggtgtccagtgtgaggtgaagttgttggagtctgggggagccgttggttcggccccgggggtcctgagactctcatgtgcagcctctggattcactatttaactacaatggcatgtagttggctccgaccaggcctccgagggagggcgtggaggtgggtcgtccgttacgggttaggtggggtaggtcgggtccaacgaaacgtacgtactttccaaccggggccgggtccgttcccggtagggaaaccggggtcccgtaacgtttccaacccgtattcccgtaccgaacggttaccttttacccgaaacgtaaccacgtacgtagtaacttccgtaaggaaaacttcggaaactacgttacgtacggaagtaccggtacggtaaccgaaccgtaacccgggtttacccctttttaatttaacgtttggtacgtaacggtaaaacggtacgggttttaaacgtacgttacgggtaccgggtaccgtaagtttaaccgttccccggtacgtttacgaccggttaacggtccggggtacccggtaacgggtacccgttacgggtactaaccccgg

SEQ ID NO: 153917 - DNA, 918 bp, Homo sapiens
  misc_feature: GYAE6OF02I0YRH.24.59.F04.1.454.CMB.1.raw
  modified_base (221)..(221): a, c, t, g, unknown or other
  misc_feature (221)..(221): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagcgtggctttttcttgtggcttattttaaaaggtgtccagtgtgaggtgaagttgttggagtcgtggggganccgttggttcgggcccgggggtcctgagactctcatgtgcagcctcgtgtcttacactatttaactacaatggcagtgtagtgctccgcacgctccgaggggaggctggaggtcgggtcgccgttaggttacggtgggagttggactaacgaacgtactagtttaccgtaccggcgggtccgttaccggtaggaaccggggtaccgtaacgttttacccgaacccgtacgtttacccgtaacccggtaaacggttaacccgttttttaaccgaaaacgggtaaaccctaccggtacgttacggtaaacgttaccgttaagggtaaaacttacggtaaacgtacggttacgttacggttaacggtaacggttacccgggtaaaccgtaaccgggttaaacccgggttaacccccgtttttttaaaggttaacggttttaaccggtaacgggttaaaccgggtaaaaacgggtttaaccggggttttaaacgtttacggggttacccggggtttaacccggttaaccgggttaaacggtttttaacccccggttaacccccgggtttttaacccgttttaacccgggggttaaacggggtttaaacccggggttaccgggggggttaaaccccccggttaaccggggggtttaaaccccccggtttacggggtttaacccccgtttaaacccccggggg

SEQ ID NO: 153918 - DNA, 925 bp, Homo sapiens
  misc_feature: GYAE6OF02F8VZZ.24.59.F04.1.454.CMB.1.raw
tcagactactatgtcacgaccggtgctcgatttagtacacacacttagggattggggtctgagagaggagcccagccctgggattttcaggtgttttcatttggtgatcaggactagaacagagagaactcaccagtggtaggtttgggctgagcgtggttctttttcgttggtggtactttaaagttttaaaaggtcgtaccgtaggtgtggagggttgtaaggtttggttggagtcggtgggggactccggtttgggtccggggtccccgggggtcctggacgtacgttcgtctagtggtagccacgtccttggtcggtacttcaacttaatttaaaccgtacaaggttcggactagttaggtacggttcgggccccgtacccgccggacggcccgttacggggaacggggggtaacggggtccggtggggtacgggtttacgggggtcccggttccgggtttacgggggtttaagggtcgggggtacggttccgggacttaaaccaaccgtaaccgtacgttttccggaaccggggccggtccgttaccgggaggtaacccgggtctaccttacgaaccctcgttacccgtaccgtaacgggtttaaccctttaaccgaaacgaaacccgtacgtacgttacggtaaacgttcggtaaaggtaacgtaacggtaaacggttacggttacggtacggtaaggttaaccggtaccggtaaccgtaaccgttacccggtttaacttttaacggtttagtttacgggtaggtaacgttaaacggggtttacggttacgtaaggttacgggtacccggtaacgtttaacgttaacccggttcccggttaacgtttaacggtaaccgggtaacgggttccgggaacccgggttaacccgggtcccggtaccggtaccccgttacccgg

SEQ ID NO: 153919 - DNA, 814 bp, Homo sapiens
  misc_feature: GYAE6OF02FW5G2.24.59.F04.1.454.CMB.1.raw
  modified_base (191)..(191): a, c, t, g, unknown or other
  misc_feature (191)..(191): n is a, c, g, or t
tcagactactatgtcacgaccggtgctcgatttagtacacacacttagggattgggggcctctgagagaggagcccagccctgggatttcaggtgttttcatttggtgatcaggactgaacagagagaactcaccatggagtttgggctgagcgtggtcttttctgtggctatttaaaggtgtcagtgtgngtgagttgttggagtcgtgggggatccgttggttccggcccggggggtcctggagtactctcactgtgcacggtcctcgtggtacttcaacgtaacttttaaacctacaaagttcggaacctagttaggacgtttcgggccttccggacccgaagggttcctaccgggaaggggtaacggggtcctggggtaacgtggggtaccgtccgttcggggttaggtacggggggttacggcgtaacaacgtactacttccgaacgggtccgggcgttccggtagaacgggtcctacgtacaaccgtatccgttaaccaacggttaccctttaccgaacgtaaacgaccgtacttacggaaacgttaccgtaacggtaaacgttaacgaacgttaacgttaccgtacgggttacgaaacgggttcccgaaaccggtaccgtaaccccgggttacccttttacgtttaaccgtttacggtaacggttcggaaaaacgggttcgggttacgttaacgggttaccgggtaccggttaaacggtaccgtttaccggtaaccccgtttcccgttaaggtaaccggtacgggtaaccggggtacccgtaaccggggtacccgtaagggtccccg

SEQ ID NO: 153920 - DNA, 653 bp, Homo sapiens
  misc_feature: GYAE6OF02GX7AS.24.59.F04.1.454.CMB.1.raw
  modified_base (217)..(217): a, c, t, g, unknown or other
  misc_feature (217)..(217): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggcttttctgtggctatttaaaaggtgtccagtgtgaggtgaagttgtggagtcgtggggganccttgggtcgggcccggggggtccctgagactctcatgtgcagcctcgtggtattccaactatttaaaccacaaatggcagtgagtggcctccgcaggctccgagggaagggctgggagtgggtcnccgtaggttaggtggggngtggacctaacgaacactattcgacggcgggtctccggtggaacggcacttcacctatcctaccgaaggtaccttttaccaaagaaccgtaacgcgtacgtaaagtcctaaggtaaactaggaactagttcagagacgtcgaacgaaccgacggtaccctttagttattcgtagtacggaaaggtagggttaacgttacgtcggttaaccggacgttaacggttaactccccggttccgtttacggaacgtacgggtacgggtacccgaaccgggtacccgtacggtacccg

SEQ ID NO: 153921 - DNA, 916 bp, Homo sapiens
  misc_feature: GYAE6OF02HLJSF.24.59.F04.1.454.CMB.1.raw
tcagactactatgtcacgaccggtgctcgatttagtacacacacttagggattggggtctgagagaggagcccagccctgggatttttcaggtgttttcatttggtgatcaggactgaacagagagaactcaccatggagtttgggctgagctggtcttttttcttgtggcttaagttttaaaaggtgtccagtgtgaggtgaagttgttggagtcgtgggggagccgttgggttccgggccccgggggtccctggagaccttcgtcagtgtgacacgcccttcgtggtacttaccgaaccttaatttttaaaacctaacgtaaagttcggactagttaggtaaggttccgggtccgttaccccggcccggaacgggtaccctacccggaaggggggaacgggggtcgtggggtacgggttcggggtacccggtccggtttaccgggggtttaaggtagggggttacggttcgggtaaccgttaaaccgaaaaccgtaaccgtaagttttaccggtaaccgggtcccggggtacgttacccggttagggaaaccgggggtccgttaactttacccgaacccgtacttacccgttacccgaaacggtttacctttttaacccgaaacgtaaaccgaccggtaacgttaacggaaacttaccggtaaacggtaaaacgtacggtaaacgtacgttacgaggtaacggtaacggtaaccggtaacgaacccggtacccggttaacccgtttttaacttacgtttaggtcggtaaacggtaaaacggttaacgggtttaacgttaggttaccggggtaccgtaccgttacggttaccgttacccgttacccgtttacggaacggtaacggttccggggaccggtaacccgggtaacccggttacggtacccgtaacccgg

SEQ ID NO: 153922 - DNA, 850 bp, Homo sapiens
  misc_feature: GYAE6OF02IP5LI.24.59.F04.1.454.CMB.1.raw
  modified_base (186)..(186): a, c, t, g, unknown or other
  misc_feature (186)..(186): n is a, c, g, or t
  modified_base (226)..(226): a, c, t, g, unknown or other
  misc_feature (226)..(226): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccagtggtagttgggctgagctggtctttttcgtgtggacttaagttttaaaggngtccaggttgtggaggtagtaagttggttcggagttcggngggggactccgtttggggtccgggtccccgggggtcctggacgtacctcgtacagtgtcggacctagtccttcgtagtacttaccaacttaactttaaaccaagtaagtcgggactagttaggtcggttcggtcccgtaccggacccgtacgggtacctaccggggaagggggtacggtacggtcgggtacggtttcggggtacccgttcccgggttagggtttagggtacggggtacgtcggtaaccttaacgaacctaccgtagttcccgtaacggtccggtccgttacgggtaaggacgggtacctacgttaccgacgtactccgttacgtaaacgttcgtttaaccaaggtaaccacgtacgttaacgaacgttacggtaacgtaaagtaccgaaacgtcgtacgtaagtacgtacggtaccggtacgacccggtttacgtaccttttagttaacgtcggtaaccgggtaaggtaaacggttagggtttaaccctacgggtacgggttacccgttacggttaccgtttacccggtccggtttaactttaacgggaccggttaacgggtacccggggtaacccgttaaccggggtacccgttcggaccccggtttaccccg

SEQ ID NO: 153923 - DNA, 814 bp, Homo sapiens
  misc_feature: GYAE6OF02IAG3A.24.59.F04.1.454.CMB.1.raw
  modified_base (186)..(186): a, c, t, g, unknown or other
  misc_feature (186)..(186): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (254)..(254): a, c, t, g, unknown or other
  misc_feature (254)..(254): n is a, c, g, or t
  modified_base (612)..(612): a, c, t, g, unknown or other
  misc_feature (612)..(612): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggaggtttgggctggagcggtcgtcgtttctagcggctaagtttaaacggntacgangtgtaggngtagttgtaggngttcgtaggggatcgtggtacgggtcccggggttacctaganaccgtctatagtgtacgcgagtctccgtggtattacgaccttaagttttaaaccgcaagttccggataacggtcggttaagtgggtacccgtacccgtaaccaagggtcccttaaccggtagggggacccggttagtaaggaacggtcgggtaccgtacccggttttggaaggttgggaagttcggaccttaaccggaaaacgcccctttaagtttaacgtcccgggagggtttccccttaacccgggaaggttaacggggccctaagttccgaactcgtttaaccggacttacgggtacctttacaaacggtacaggttaccaggtacctagtacgtaacaggatacccggagttanacccggtacgaagttaccggaccgtaaccgtttacccgttaactttaggttaccgtaagggtttaaacccgaagggtttaaacccgtaagttaggttaccgaaccgggttacttaaaaccggtttcccgtaccgtttaacccggttaggtacccgttaaggccggtaacccggttcggaacccggtagtttcccgaacccgg

SEQ ID NO: 153924 - DNA, 657 bp, Homo sapiens
  misc_feature: GYAE6OF02H71RJ.24.59.F04.1.454.CMB.1.raw
  modified_base (183)..(183): a, c, t, g, unknown or other
  misc_feature (183)..(183): n is a, c, g, or t
  modified_base (272)..(272): a, c, t, g, unknown or other
  misc_feature (272)..(272): n is a, c, g, or t
  modified_base (469)..(469): a, c, t, g, unknown or other
  misc_feature (469)..(469): n is a, c, g, or t
tcagactactatgtcacgaccggtgctcgatttagtacacacacttagggattgggcacagcgtggacatgagggtccctgctcagctcctgggcctcctgctgctctggctctcaggtcgccatatgtgaccatccagatcgacccagtcctccatccctccctgtctgcatcgtggagganacagtagtcaccatctctgaccaggcgagtcgagggactaatttaaccttagttagttaaagttggtactactaactaaccaaaaacgnggacgaacggtaccctaaacgtcgtacggtacgaacgtatcgaccaataccgaacgtcggtacgaccgacgggacccagtacgtaacgttacgacgacggtacgtaggaacgtacgtcgtacggtacttacgtccttactacctaccactaaccgtcgacggccgtacgtcgacgcgtcgtacgtagacgtgtcganacgtaattacgtactcgtataacaagtatacgacgtaagtcttaggtacttaccgggtttagacccgggtagggtaacggtaaaggtaccggagtaacctacgtaacggtaccggtgttacggcgttaacccgacgtaaccgttacggttacttcggtaaccctttccgtacgttcccgttaaccccg

SEQ ID NO: 153925 - DNA, 688 bp, Homo sapiens
  misc_feature: GYAE6OF02FV4FW.24.59.F04.1.454.CMB.1.raw
  modified_base (642)..(642): a, c, t, g, unknown or other
  misc_feature (642)..(642): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtcctccatccctccctgtctgcatctgtggagacagagtccacctattccttcttgccgaggcgtagtaccgagggctaagttaactactttagtaaagttggtatcaactaacaaaaaccgtaggacaacggtaccctaaactccgtaggtaccaacggactacgcctaacgtaccgtaaaggttccgggtcgacccggtaacggggtccccctaagttaccgtaacggtttaccgaacggccggtaacgtaacggtaacgtacggtacgtacggtaaccttaatttacccgttacctacccgttaccaacccttaatccggaccgtaccggtacctacggccgaaccgtccgtaggtaacgggtattcggttacgacgtaactagtacttagtacgtaacaactaatatacgtaatattatacgttacgttacgtttaggaccgggtacggaggtagtacggacgtacgtaacgtaacgtacgtcggtagtacncgtacgaacctgttacttacgtcgtttccgtaccgttccctaaccg

SEQ ID NO: 153926 - DNA, 687 bp, Homo sapiens
  misc_feature: GYAE6OF02GWOQ3.24.59.F04.1.454.CMB.1.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (404)..(404): a, c, t, g, unknown or other
  misc_feature (404)..(404): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatcctccctgtctgcatctgtggganacagagtcaccatctcttgccgaggcgagtcgaggctaatttaactactttagtaaattgtatcaatacaaaacnggacaacggaccctaactccgtagacaacgatgacatccgaagtcgggcgccggacgggcccagtacgtaaggttcgacgcggacgtagtagtactcgtacggacttactttaccttacgtaccttaccaacctctacgacggaccggtccngcacggtcctaggaggtagtggttacggacctaagtacgtttaacttaccgttaggtaaaccctaaagtaaacttaactaggtaaacgtacttaacgttacgtttaaccgttttaacggtttacccgggaacgggtaacgggggtaaacggtaaaggggttaccgggaacggtacccggttaaacgaaaccgggttaaccgggttggtacgggttacccgtaggtacccgttaacctacgttcggttacttaccgtctttaacccttacccccggtttacccg

SEQ ID NO: 153927 - DNA, 945 bp, Homo sapiens
  misc_feature: GYAE6OF02HAV7C.24.59.F04.1.454.CMB.1.raw
tcagactactatgtcacgaccggtgctcgatttagtacacacacttagggattggggtctgagagaggacgcccagccctgggattttcaggtgttttcatttggtgatcaggactgaacagagagaactcaccatcggagtttggctgagcgtgtctttttactgtggtacttagttttaaaaggtcgttaccaggttgtaggaggttagtaaaggtttggttgggtacgtcggtagggggacgtccgtttggggtttacccgggggccccggggggttccccttaggaacggtaccgttaccgtacgtacgttagtacgaccgtacggtcccgtacgttaggtaacctttacgtaacttaacttttaaaccgactaaacgtcggactagttaggtacgttcggtaccgtaccgtaccggtaaccggaccgtaccgggacgggggaacgggtccgtagggggtacggtccgggtaccgtcccggttacggggttagggtacggggtaggtaccggtacttaaaccggaacctaacgtacgttccggtaaccggtccgggtccgttacccggaggggaaaccgggttccctaaacgttacccggtaacctacgtttaacccgtaaccggtaacgtttaacccttttaaacggaaaaccgtaaccgttaaccgaacggtaacgtaaacgttacggtaaacggtaaacgttaaccggaaacgttaagttaccggaagttaacggacggtaaccaccggaaacgtacccgggttaacttttacgtagttacgtacgggtaaacgaaaaggttcggttaaacgttacggttaccgggtaccggtaacgtttcggttaaccccggttaccgtaaccggtttagaacccggttaacggggtaccgggttaaacccgggcccgtaaccgggttcgtaaccccgttaacccgg

SEQ ID NO: 153928 - DNA, 807 bp, Homo sapiens
  misc_feature: GYAE6OF02GH3NQ.24.59.F04.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
tcagactactatgtcacgaccggtgctcgatttagtacacacacttagggattgggggctctgagagaggagcccagccctggggattttcaggttgttttcatttggtgatcaggactgaacagagagaactcaccatggagtttgggctgagctggtctttttcttgtggcttaagttttaaaggtgtccagtgtgaggtgagttgtggngtcgtggggngtccgttgggttcgggccccggggggtcctggagtactctcatgtgctacgcctcgtggtacttcgaactaattttaacctaactaaatggactagtggtagttcgggacccttcccggaccgaggccctcggaacgggggtaggggtcgtaggggacggttggggtacccgccggtttcgggttaggtgggggagttcgggacctaacgaactacgtacgttccgtaaccgggtcccgggtacgttcccgggtacggggaaccggggtcccgtacgtttacccgacctacgttcccgtaacccggtaacggttaacccgttttaccgaaaacgtaaccgacggtactagtaacttacgtaacggtaaattacggaactacgtcagtacgacgttaccgaaccgtaccgtacccggtttacccgttttaattttacgtagttacggaaacggtaacgggttaggtttaacgttacggtaccgggttaccggtaacttaacgggtttcccgccccggtttaccgtttaggaccgggttaggggtcccgggtaaccgtacccgggggttaccgtccggtaaccccgg

SEQ ID NO: 153929 - DNA, 720 bp, Homo sapiens
  misc_feature: GYAE6OF02FN5UE.24.59.F04.1.454.CMB.1.raw
  modified_base (121)..(121): a, c, t, g, unknown or other
  misc_feature (121)..(121): n is a, c, g, or t
tcagactactatgtcacgaccggtgctcgatttagtacacacacttagggattgggcacagcgtggacatgagggtccctgctcagctcctgggcctcctgctgctctggctctcaggtcnccatatgtagacatccagacttcggaccctagtcctccattccctccctgtctgccatcgtgtacggagtacaggactccactatctacgtttggtcgggactaaggtgacctactattacgcgactcgtttacgttggtacgttcggactacgtacctaaattaaccgaaaccggtaacgggaaacctaaccccttaacccgttcgtgtaacttaccttaaccttacgtcgaccgttaccttaaacgttaccgacgtacggggtccgggttaccctacgttaccggttacggttacgtagggtaccgtataacgtggtacgttcggttacgggaactaacggttaccgttacctaacgtcccaacctacctacgctacgacgtacgtcgtacactaacggtatacgtacgttacaacttacttacgttataccgacgttaatcgtaacctttcccgtacgttcccggtactccgggtacggtaccgggacgtacggtacggtacgtacgactccacgtacggtacgtcggtaacggccgtacgaccctttaccgacgttttccgtacgtttacccttcgtaccctttcccgtaacccg

SEQ ID NO: 153930 - DNA, 890 bp, Homo sapiens
  misc_feature: GYAE6OF02GRD3I.24.59.F04.1.454.CMB.1.raw
  modified_base (182)..(182): a, c, t, g, unknown or other
  misc_feature (182)..(182): n is a, c, g, or t
  modified_base (262)..(262): a, c, t, g, unknown or other
  misc_feature (262)..(262): n is a, c, g, or t
tcagactactatgtcacgaccggtgctcgatttagtacacacacttagggattggggtctgagagaggagcccagccctgggattttcaggtgtttcattggtgatcaggactgaacagagagaactcaccatggagtttgggctgagcgtggctttttctgtggcttagttttaaaaggtntccagtgtcgaggtagtaagttgttggagtcgtgggggagtccttggttccgggaccccgggggtcctaggacgactctnaacgtgtcgacagtcctagtacggtaattccagtaacttttaaccgtaaccgaaagttcggaactaacgtggaagtttacggaccttaccggtacccgaagggcccttaacccggaaagggggaaccggggtacgtacgggtaacgggttcggggttaaccccgggtaccgttttaaccgggggttaggtaacgggggtaggttaccgggtaacttaaacccggaaactaaccgttaaacgtttccggtaacggtaaccggggtcccttaccgggtaaggtaaccgggacccggttaacttacccgaaacgtacccgttcgtaacccgtaaacgggttaacccttttaaccgaaaaccggttaacgaaccgtaccgttaacggtaacgttaccgtaagggtaaaccgtaacggtaaacgtacgttaccgtaggtaacgtacgtacggaacccgtaacggtacccgttaaccgttttaacgttaagttccgtaagggtaaccgtaaaggttaaccgggtaacttagtaccgggtacccggtaagttaaccggttacgtacccgttaccgttacgaaacgggtactcggggacccgtaacccgggtaaccttcggaccgtttaaccccgg

SEQ ID NO: 153931 - DNA, 781 bp, Homo sapiens
  misc_feature: GYAE6OF02GOQSY.24.59.F04.1.454.CMB.1.raw
  modified_base (304)..(304): a, c, t, g, unknown or other
  misc_feature (304)..(304): n is a, c, g, or t
  modified_base (505)..(505): a, c, t, g, unknown or other
  misc_feature (505)..(505): n is a, c, g, or t
tcagactactatgtcacgaccggtgctcgatttagtacacacacttagggattgggcacagcgtggacatgagggtccctgctcagctcctgggcctcctgctgctctggctctcaggtgccatatgtgacatccagatgacccagtctccatccctccctgtctgcatctgtggagacagtagtcaccatctcttagccgagcgagtccagggcagttaactactttgtaaattggtatctaacgtacaaaaaccgaggaaccgaacgggaccctaaaccttcccgtaggtacctaaacgganacggacattacccaagttacggggtacgacccggaacggggccccctaagtaccgaaacggtttacggacggtaccggtaccgaaggttacggaaagtccgtacggggtaactacggtttacctttcccggttaaccttctaacccgtaaggttaccacggtccggacgtttccgcgtaaccggtcccgttgaacggggtnttacggtttacggaccgtataaccgttaatttaccgtacgttaaccgtaaacgtaaactacgttaacggaacggttacttaacgtaacggttaaccttaaccgggttttttacggaacccgggtaacccgggggtaaccggtaaaaggggttcgggaactaccgggttaacccgttaaaacggaaccgtttacgggtaacgggtacggttcgacccgttttaacccacggttacgttaccgtttcggtttacccttacgtttacccgtaaccccgg

SEQ ID NO: 153932 - DNA, 792 bp, Homo sapiens
  misc_feature: GYAE6OF02JFAIZ.24.59.F04.1.454.CMB.1.raw
  modified_base (183)..(183): a, c, t, g, unknown or other
  misc_feature (183)..(183): n is a, c, g, or t
  modified_base (208)..(208): a, c, t, g, unknown or other
  misc_feature (208)..(208): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttctgtggacttattttaaaggtntccagtgtgaggtgaagttgttggngtcgtgggggatccttgggttccgggcccgggggtcctagagctctcntgtncacgtcctctggacttcacttaatttaacacaagtcgcagtcgtagttcggcctccgccgaggctccggagggggacgggtcgtgggagtcggggtactccggttagggtcggtggggtacggttggaccttaacaccgaacttagtttaccgtacgggtccgggtactcccggggtagggaaccgggggtacccttacgtaccctaccgtaccttccgtaaccggtaacggtttaccttttacccgaaagaaacccgtcgacgttacgaacgttcgtaacggaaacgttggaaccgtagttaccggtaggaacggtaccgtacggaaacccgaccggttacccggtttacccgtttagtttaccggttaggttaaccggtaacggtaaacgggtttacgtttaccggttacggttaccgggaccgttaacgtttaaccggttaccttcccggttaccgtttaaggaaccggttacgggttaccggggtacccgggtaaccggtaacccggttcggtaccccgttaccccgg

SEQ ID NO: 153933 - DNA, 1025 bp, Homo sapiens
  misc_feature: GYAE6OF02IQ5TK.24.59.F04.1.454.CMB.1.raw
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagctggtctttttcttgtggcttaattttaaaaggtgtccgagtgtgtaggtgaagtttgttggtagtcgtagggggacgtccgtttgggttccgggcccggggggtccctgacgactctctatgtgcgagccgttcgtacggtattacaacttaactttaaactaacaagtagccaagtgtaggttcggtacctcccgaccgaacgggccgttaccggaagggggaacgggggtacgtagggggtacgggttgggggttaccggtccccggtttacggggtttaaacgggttcggggggtaagggttaccgggaccgtaaccgtaaaaaccggtaacttaacgtttacccggtaaccgggtacccggggttccgtttacccggggttaaacggggttaaacgggggaccccgttaacggttttacccctaaaacccgtaacgttaacccgtttaacccgtaaaccggttttaaacccgtttttaaaccgtaaaaacccggttaaaaccggtaaaccccggtaccgttaaagggtaaacgtttaacccggtttaaaggggttaaaaccgtaaacgggtaaaaccttacggtttaagttacggtaaagggtaaacggtttccggaaaaccgggtaacggtaaaccccgggttaacccgttttttaaacttttaccgggttttaaaggttaaccgggaaagttaaaaacggggtaaccggggttttaaccggttacggtaaggggtttacccggtaaaccgtttaaccggtttaacccgttaccccgggttaacccgtttttaacgggaaacggttaaccgggttacgggtaaccccgggaaacccggggtaaaccggtttacccgggttaacccgg

SEQ ID NO: 153934 - DNA, 715 bp, Homo sapiens
  misc_feature: GYAE6OF02GA01B.24.59.F04.1.454.CMB.1.raw
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
tcagactactatgtcacgaccggtgctcgatttagtacacacacttagggattgggggctctgagagaggagcccagccctgggatttttcaggtgttttcattttggtgatcagggactgaacagagagaactcaccatggagtttgggctgagctggtctttttctgtggcttaatttttaaaaggtgtccagtgtgaggtgaagtttggttggagttcgtgggggagtccttgggttccgggccccggggggttcctggagaccttctcatggtgcagctcgtgnttcactatttaacanatggcatgagtggctcgcacgctcgagggacggntggaggnggtcgcgttcggtaggtggngtcgactacgactactnttacgacggcggtctccggtaggaacggtccgtacttcccaccgtagttaccgtaccgtaacgttaccgtttaccgaagtaacgacgtacgtagtaactacgtaaggtaaattacgaactaacgttagtagagtacggtaccgaaccggtacgtacccgttaccttttaagtttacgttagtacgtaacgggtaaaacgggttacggttaacgttacggttaccgggttacccgtaacggttaccgttttaaccggttccccggttaccgtttacggaaccggtagggttaccggggtaacccggaacgggttaccccggtagggttacccccg

SEQ ID NO: 153935 - DNA, 782 bp, Homo sapiens
  misc_feature: GYAE6OF02FJSZ8.24.59.F04.1.454.CMB.1.raw
  modified_base (193)..(193): a, c, t, g, unknown or other
  misc_feature (193)..(193): n is a, c, g, or t
  modified_base (226)..(226): a, c, t, g, unknown or other
  misc_feature (226)..(226): n is a, c, g, or t
tcagactactatgtcacgaccggtgctcgatttagtacacacacttagggattgggcacagcgtggacatgagggtccctgctcagctcctgggcctcctgctgctctggctctcaggtcgccatatgtgacatccagatcgaccctagtcctcccactcccgttccctgtcctgctacttcgtggtgggganacgagacgtccacctatctctcgcaggcagtcnggctacttactacttagtaagttgtactcataccaaaacgcgacgaacggtaccctaacgtccgtcggtacactacgtcactactaccgtagtcggggtaccgccggaccgggacccctaagtaccgtaacggttccgacgggaccgacggtaacggtacgtacggttccggtacgggtacttaccgtttacccttcccttaacccgttaccaacccgttaccgtacccggaccgggttcccgggtaccgtacggtacccgtaacggtcccccggtaagggtaacgggtttggtttacggtcccggtaaaccttaacgttaaaccggttagtttaaaccgttccgttaaacgttaaaactaacgtttaaccgtaggtaacctaagtttaccggttaacgtttaccgttaaccggttttccgggaacggggtaacggggtaccgttaaacggggcgtaaccgtacgtaacccggaaacgttacggtaggtccggtacctaaccggacctacctacggttcgttacccgtttacttacccgtactttcccccgtaccg

SEQ ID NO: 153936 - DNA, 729 bp, Homo sapiens
  misc_feature: GYAE6OF02F7XUJ.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggctattttaaaggtgtccagtgtgaggtgaagtttgttggagtcgtgggggatccgttggttccgggcccgggggtccctgacgtactctcatgtgcacgtcctcgtggatttaactatttaacctacaatggacagtgtagttcggctccgcacggccgtccgaaggggacggcgtggaggtcgggtcgccgtttcgggttaggtgggtagttcggctaacgaactacgtacttcgtaccggcgggtcctaccgggtggaacgggtcccgtaacgttccaacctacgttcccttaaccgaacggtttacccttttaaccgaacggtaacctacggtaccttagtaaactcgtaacggtaaactagaacgtagttacgaggagacgttacgaccgacctaccggttaccctttagtttattccgtagtaaccggtaaacggttaggtttaacctagggttacggtacggtaccttaggttccttcccggttacgttaaccgacggttaccggtacggggtcccgtaaacgggtaccccggttggttacccgtacccgttccg

SEQ ID NO: 153937 - DNA, 777 bp, Homo sapiens
  misc_feature: GYAE6OF02IJXUM.24.59.F04.1.454.CMB.1.raw
  modified_base (83)..(83): a, c, t, g, unknown or other
  misc_feature (83)..(83): n is a, c, g, or t
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (506)..(506): a, c, t, g, unknown or other
  misc_feature (506)..(506): n is a, c, g, or t
tcagactactatgtcacgaccggtgctcgatttagtacacacacttagggattggggtctgagagaggagcccagccctgggnttttcgaggtgttttcatttggtgatcaggactgaacagagagactcacatggtagtttgggctgngcgtgtntttctggtgctatttaaaggngtcngtgtgtaggtntagttgttggagtcgtagggggntcgtttgggtccgggcccggggtctgtagcctgtacagtgtcgcacgtctcgtaggtnttaccacttacgttttaacctaacgtaactggcctagtgtaggtttcggccctcccgaccacgggtcctaccgggaaggggtagggcgtgggacggtggtacgcgttacgggttagtgggacggtntaccgtanactaactnttccggtaacggtccgggtacgtcggtacgggacggtaccgtaacttccgaccaactttccgtaacgtaacgggtttacctttaaccgaanaacggtccagttaccaagttcgtaaggtaacgtagtaacgtcgttacggttgacggtaagccgggtaaccgggaccgttcggtttaaccgtttacgttaagtttcggtaactaacggggtaaacgtttaacggggttaacttacgggtaccggtttaccggggaacccttttaacgggtttcccctaccccggtttaaggttcggttaaaccggtcccgggttacggggttaaccccgttaccggggaccctttcccggggtaaccctccg

SEQ ID NO: 153938 - DNA, 911 bp, Homo sapiens
  misc_feature: GYAE6OF02HDAZS.24.59.F04.1.454.CMB.1.raw
tcagactactatgtcacgaccggtgctcgatttagtacacacacttagggattggggtctgagagaggagcccagccctgggattttcaggtgttttcatttggtgatcaggactgaacagagagaactcaccatggagtttgggctgagctggtctttttcttgtggcttattttaaaggtgtcagtgtgaggtgaagttgttggagtcgtgggggagtcgttgggttccgggcccgggggtccctggacgtacctctcagtgtcgcacgccttctggtacttccgaattaacttttaaacctaacctaaagtcgggacctaagttacggtaaggttcgggtcctcccggccgtaacgggccgttacccggaaaggggggtaacgggggacggttacggggtaaggggttcgggggttacccggtccccgtttacgggggttttaacgggttagggggtacgggttacgggtaccttaaccgaaaaccgttaaccgttaacgtttaccggtaaccgggtccggggttaccccttacccggggttacggaaaccgggggtacccgttaacgttacctaacccgtaaatttccccgttaccggtaaacgggtttaccctttttacccgaaaaacggtaaccgtacggtaccgttaacgtaacgttaccggtaacggtaaaacgttaacggaaaccgttacggttaacgtaggtaacggtaacggttaccggaacggttaaccgaacccggtttaccggttttaaacgttttacgtttagggtaaccggttaaacgggtaaaggttaacggggttaaacttacggtaccgggtaccggtagttaacgttccgtacccgtacgttacgacgtacggtacggggacctaacgggtcccgttacggccttacccgg

SEQ ID NO: 153939 - DNA, 730 bp, Homo sapiens
  misc_feature: GYAE6OF02JP2MI.24.59.F04.1.454.CMB.1.raw
  modified_base (191)..(191): a, c, t, g, unknown or other
  misc_feature (191)..(191): n is a, c, g, or t
  modified_base (229)..(229): a, c, t, g, unknown or other
  misc_feature (229)..(229): n is a, c, g, or t
  modified_base (285)..(285): a, c, t, g, unknown or other
  misc_feature (285)..(285): n is a, c, g, or t
tcagactactatgtcacgaccggtgctcgatttagtacacacacttagggattgggcacagcgtggacatgagggtccctgcgtcagctccgtgggcctcctgctggctctggtctctcgtacggtgccatatgtgacatccgagatcgacccagtctcctattcctcctgtctgcatccgtggtgggacncctagagtccaccattctctcaccgagccgtaagtcgnggacctagttaaacctatttacgtaaagttggtacttacaacgtacgaaaaaccgnggtaaccgaaccggtacctaaaccggtcctacgggtcaaacggtactcgtactacttaccgaagtccgggtaccgacggaaccgggtaaccccgtacgtccgttaaacggtcgtaacggccgggtacctaacggtacggtaacgttcggtaacgggtacttacccggtttcttaaccggtacctttaaccaccgttacgtactacgggtccgcgtaacgtaccgacggtcctaggaaaggtcgttacgtacggactacgtaagtacttacgttaacgaccctagaaccttaagccgtaaacgggttaccctagggtttaaccgtaccgtttaacggttaacggtacccgggtaaaggtacccgggtaaggtacggacgtacaaccgtacgtaacgtcggtacgtgtaccgactccgtaactccacggttcctacgccttactccg

SEQ ID NO: 153940 - DNA, 750 bp, Homo sapiens
  misc_feature: GYAE6OF02FUR96.24.59.F04.1.454.CMB.1.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
tcagactactatgtcacgaccggtgctcgatttagtacacacacttagggattgggggctctgagagaggagcccagccctgggattttcaggtgttttcatttggtgatcaggactgaacagagagaactcaccatggagtttgggctgagcgtgtcgtttctaggtggctatttaaaggtgtcagtgtgngtgagttgtgagtgtggggagcttggtcggcccggggggtcctggacgacttcncgtatggtcgactagccgtctgggtaacttcaacttagtttaaacctaacaagttcggactaacttggtaaggttcggtcctccggacgtacggcctcggaacggggtaacgggcttgggacgttcgggtcgaccgttagggttcggtggggtacgttgggcctaaacgaacacgtacgtttacggaacggtccgggaccttcgggaggaaccgggtccgtaacttccgacctataccgtaccgtaacgtaccttttaccgaaacgtaaccgtacggtactacggtaacttacgtaaacggtaagttaacgaacgtaggttaccttagacggttacgacggtaaacgtaacgtacccggtttaccttttacgttaagtttcggtacggtaacggtaaaggttacggttaaccgtggttagggtaccgtaaggtaaccgttcgtacccggtttcgttaacggacggacggtaccgggtccggtacggttacccggtagtacccgg

SEQ ID NO: 153941 - DNA, 646 bp, Homo sapiens
  misc_feature: GYAE6OF02HS9AE.24.59.F04.1.454.CMB.1.raw
  modified_base (369)..(369): a, c, t, g, unknown or other
  misc_feature (369)..(369): n is a, c, g, or t
tcagactactatgtcacgaccggtgctcgatttagtacacacacttagggattgggcacagcgtggacatgagggtccctgctcaggctcctgggcctcctgcctgctctggctctcgaggtgccatactggtgacatccagatgacccagtctccactcctccctgtctgctatctggtgggagacagacgtaccaccattctcttgccgaggcgagtcgagggctaatttaactactttagtaaagttgtatcatacaaaaaccaggacgaacggtacccctaaactcctcggtacaactatcgacataccaagtcgggtgacccggacggggccccatacgaacggttcgacgcggacaggtacgngtcgtggtactatttctctacctcactactcgacgcgctcgcacgcgtagacggtagtggttgacactattacgttactacgtacaaactaatagtacgtacagttaacttacgttacgttacgttttacgggaccgggtaacgggttaaggggaacggttaagggacgtacgtaacccggtaaaggtaaccggtggttacccgggacgttaccgtaccttaacccgtcgtttccgttccggtttaccttccctttacccgttcccgttaacccccg

SEQ ID NO: 153942 - DNA, 154 bp, Homo sapiens
  misc_feature: GYAE6OF01DJA89.41.70.G04.1.454.CMB.1.raw
  modified_base (153)..(154): a, c, t, g, unknown or other
  misc_feature (153)..(154): n is a, c, g, or t
tcagtctatactatcacgaccggtgctcgatttagtgtagtgtgaagggaaagggaccaaagtggaaatcaaacgaactgtggctgcaccatctgtcttcatcttcccgccatctgaatagtatagactgagcgggctggcaaggcgcatagnn

SEQ ID NO: 153943 - DNA, 155 bp, Homo sapiens
  misc_feature: GYAE6OF01C0I8G.41.70.G04.1.454.CMB.1.raw
  modified_base (153)..(155): a, c, t, g, unknown or other
  misc_feature (153)..(155): n is a, c, g, or t
tcagtctatactatcacgaccggtgctcgatttagtgtagtgtgaagggaaagggaccaaagtggaaatcaaacgaactgtggctgcaccatctgtcttcatcttcccgccatctgaatagtatagactgagcgggctggcaaggcgcatagnnn

SEQ ID NO: 153944 - DNA, 177 bp, Homo sapiens
  misc_feature: GYAE6OF02GP9X2.41.70.G04.1.454.CMB.1.raw
  modified_base (155)..(177): a, c, t, g, unknown or other
  misc_feature (155)..(177): n is a, c, g, or t
tcagtctatactatcacgaccggtgctcgatttagtgtagtgtgaagggaaagggaccaaagtggaaatcaaacgaactcgtggctgcaccaatctgtcttcatcttcccgccatctgaatagtatagactgagcgggctggcaaggcgcatagnnnnnnnnnnnnnnnnnnnnnnn

SEQ ID NO: 153945 - DNA, 224 bp, Homo sapiens
  misc_feature: GYAE6OF01D2IHA.10.38.D05.1.454.CMB.1.raw
  modified_base (222)..(224): a, c, t, g, unknown or other
  misc_feature (222)..(224): n is a, c, g, or t
tcagcatagtagtgcacgaccggtgctcgatttagtatctgatagttgggtttgggtgccgaagttgctggaggtcaccgtctcccagcctccaccaagggcccatcggtcttcccctggcgccctgctccaggagcacctcagagagcacagcggccctgggctgcctggtcaaggactacttcccactactatgctgagcgggctggcaaggcgcatagnnn

SEQ ID NO: 153946 - DNA, 163 bp, Homo sapiens
  misc_feature: GYAE6OF01AHR22.10.38.D05.1.454.CMB.1.raw
  modified_base (162)..(163): a, c, t, g, unknown or other
  misc_feature (162)..(163): n is a, c, g, or t
tcagcatagtagtgcacgaccggtgctcgatttagtatctgatagttgggtttgggtgtggtggtctccactcccgccttgacgggctgctatctgcccctcggtcactctgttcccgccctcctccactactatgctgagcgggctggcaaggcgcatagnn

SEQ ID NO: 153947 - DNA, 221 bp, Homo sapiens
  misc_feature: GYAE6OF01CQVR8.10.38.D05.1.454.CMB.1.raw
  modified_base (220)..(221): a, c, t, g, unknown or other
  misc_feature (220)..(221): n is a, c, g, or t
tcagcatagtagtgcacgaccggtgctcgatttagtatctgatagttgggttggtgccgaagttgctggaggtcaccgtctcccagcctccaccaagggcccatcggtcttcccctggcgccctgctccaggagcacctcagagagcacagcggccctgggctgcctggtcaaggactacttcccactactatgctgagcgggctggcaaggcgcatagnn

SEQ ID NO: 153948 - DNA, 447 bp, Homo sapiens
  misc_feature: GYAE6OF01C5KBW.10.38.D05.1.454.CMB.1.raw
  modified_base (357)..(357): a, c, t, g, unknown or other
  misc_feature (357)..(357): n is a, c, g, or t
  modified_base (441)..(447): a, c, t, g, unknown or other
  misc_feature (441)..(447): n is a, c, g, or t
tcagcatagtagtgcacgaccggtgctcgatttagtatctgatagttggggtttggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgttggcggcgggactaaggtgaccgtccngggtcagcccaaggctgccccctcggtcactctgttcccgccctcctccactactatgctgagcgggctggcaaggcgcatagnnnnnnn

SEQ ID NO: 153949 - DNA, 224 bp, Homo sapiens; identical to SEQ ID NO: 153945
  misc_feature: GYAE6OF01DIH6Y.10.38.D05.1.454.CMB.1.raw
  modified_base (222)..(224): a, c, t, g, unknown or other
  misc_feature (222)..(224): n is a, c, g, or t

SEQ ID NO: 153950 - DNA, 225 bp, Homo sapiens
  misc_feature: GYAE6OF01CW8WU.10.38.D05.1.454.CMB.1.raw
  modified_base (222)..(225): a, c, t, g, unknown or other
  misc_feature (222)..(225): n is a, c, g, or t
tcagcatagtagtgcacgaccggtgctcgatttagtatctgatagttgggtttgggtgccgaagttgctggaggtcaccgtctcccagcctccaccaagggcccatcggtcttcccctggcgccctgctccaggagcacctcagagagcacagcggccctgggctgcctggtcaaggactacttcccactactatgctgagcgggctggcaaggcgcatagnnnn

SEQ ID NO: 153951 - DNA, 223 bp, Homo sapiens
  misc_feature: GYAE6OF01DMO7Q.10.38.D05.1.454.CMB.1.raw
  modified_base (222)..(223): a, c, t, g, unknown or other
  misc_feature (222)..(223): n is a, c, g, or t
tcagcatagtagtgcacgaccggtgctcgatttagtatctgatagttgggtttgggtgccgaagttgctggaggtcaccgtctcccagcctccaccaagggcccatcggtcttcccctggcgccctgctccaggagcacctcagagagcacagcggccctgggctgcctggtcaaggactacttcccactactatgctgagcgggctggcaaggcgcatagnn

SEQ ID NO: 153952 - DNA, 166 bp, Homo sapiens
  misc_feature: GYAE6OF01ETGRQ.10.38.D05.1.454.CMB.1.raw
  modified_base (166)..(166): a, c, t, g, unknown or other
  misc_feature (166)..(166): n is a, c, g, or t
tcagcatagtagtgcacgaccggtgctcgatttagtatctgatagttgggtttgggggtgtggtggtctccactcccgccttgacggggctgctatctgccccctcggtcactctgttcccaccctcctccactactatgctgagcgggctggcaaggcgcatagn

SEQ ID NO: 153953 - DNA, 164 bp, Homo sapiens
  misc_feature: GYAE6OF01AY3IJ.10.38.D05.1.454.CMB.1.raw
  modified_base (164)..(164): a, c, t, g, unknown or other
  misc_feature (164)..(164): n is a, c, g, or t
tcagcatagtagtgcacgaccggtgctcgatttagtatctgatagttgggtttggggtgtggtggtctccactcccgccttgacgggctgctatctgccccctcggtcactctgttcccaccctcctccactactatgctgagcgggctggcaaggcgcatagn

SEQ ID NO: 153954 - DNA, 226 bp, Homo sapiens
  misc_feature: GYAE6OF01DIJRR.10.38.D05.1.454.CMB.1.raw
  modified_base (222)..(226): a, c, t, g, unknown or other
  misc_feature (222)..(226): n is a, c, g, or t
tcagcatagtagtgcacgaccggtgctcgatttagtatctgatagttgggtttgggtgccgaagttgctggaggtcaccgtctccccagcctccaccaaggcccatcggtcttcccctggcgccctgctccaggagcacctcagagagcacagcggccctgggctgcctggtcaaggactacttcccactactatgctgagcgggctggcaaggcgcatagnnnnn

SEQ ID NO: 153955 - DNA, 469 bp, Homo sapiens
  misc_feature: GYAE6OF01B9FIH.10.38.D05.1.454.CMB.1.raw
  modified_base (267)..(267): a, c, t, g, unknown or other
  misc_feature (267)..(267): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (444)..(445): a, c, t, g, unknown or other
  misc_feature (444)..(445): n is a, c, g, or t
  modified_base (447)..(469): a, c, t, g, unknown or other
  misc_feature (447)..(469): n is a, c, g, or t
tcagcatagtagtgcacgaccggtgctcgatttagtatctgataggttgggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtntctgggctccaggctgaggatgaggctgattactactgcagcgcatattcaggccccaanagggtgttggcggngggactaaggtgaccgtctgggtcagccaaggctgccccctggtcactctcgttcccaccctcctccactactatgctgacgcgggctggcaaggcgcatagnngnnnnnnnnnnnnnnnnnnnnnnn

SEQ ID NO: 153956 - DNA, 224 bp, Homo sapiens
  misc_feature: GYAE6OF01DE5LD.10.38.D05.1.454.CMB.1.raw
  modified_base (223)..(224): a, c, t, g, unknown or other
  misc_feature (223)..(224): n is a, c, g, or t
tcagcatagtagtgcacgaccggtgctcgatttagtatctgatagttgggtttgggtgccgaagttgctggaggtcaccgtctccccagcctccaccaagggcccatcggtcttccccctggcgccctgctccaggagcacctcagagagcacagcggccctgggctgcctggtcaaggactacttccactactatgctgagcgggctggcaaggcgcatagnn

SEQ ID NO: 153957 - DNA, 627 bp, Homo sapiens
  misc_feature: GYAE6OF01B7QXE.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttaataactatgtctcctggtaccagccaccacccaggcaaaacgcccccaaaactcctttgtttttgaggtcagtaagcggcctcaggagtccctgatcggtctctgcctccaagtctggacaacacggcttccctgaccgtctcgtgggctccgaggcctggaggatggaaggtctgtattactactgcagtcgctaattacttcgacggtaccccctaaagtacggggttggtttacgggccgggtacggggaacttaaggggtcgtaacccgggttccgttacggggtccaacggtccccgaaagggtcccttccggaccccccctttggggtaccctacccgttacccgttccggtttccccccaacccctttcccccg

SEQ ID NO: 153958 - DNA, 472 bp, Homo sapiens
  misc_feature: GYAE6OF01DSVXM.10.38.D05.1.454.CMB.1.raw
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (464)..(472): a, c, t, g, unknown or other
  misc_feature (464)..(472): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgttttgaggtcagtaagcggccctcaggagtccctgatcggttctctgcctccaagtctggcaacacggcctccctgaccgtctctgggctccaggctgagtngagcgtgtatactactgngacngcatattcagacccgacccaaggtggtttggtcgggcgggacggtaaagtaggacgtccgtcggtcgacgccgaacgacgtcgccccgtcccggtcgtactctcgtccctaccctcctccactactaatgcgtcgagcggcgtgcganacggctanagnnnnnnnnn

SEQ ID NO: 153959 - DNA, 515 bp, Homo sapiens
  misc_feature: GYAE6OF01ECR0V.10.38.D05.1.454.CMB.1.raw
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagcatagtagtgcacgaccggtgctcgatttagtatctgatagttgggtttggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacaggggtgtttggcggcgggactaagggtgaccgtcctgggtcagcccaaggctcgcccctcggtcactctcgttcccaccctcctccactactatgctgagcgggctggcaaggcganatgn

SEQ ID NO: 153960 - DNA, 536 bp, Homo sapiens
  misc_feature: GYAE6OF01AFOK8.10.38.D05.1.454.CMB.1.raw
  modified_base (530)..(530): a, c, t, g, unknown or other
  misc_feature (530)..(530): n is a, c, g, or t
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactccttgttttgagtcagtaagcggccctcaggacgtccctgatcggttctctgcctcaagtctggcaacacggcctccctgaccgtctctgggctccaggctgaggatgaggctgattactactgcagcgcatactcgacggaccccaagagggttgttcgggcggtacgggactaagggtcgaccgtccgtgggtccagcccgaaggcctcgccccctggtccactctcgttccccncctccc

SEQ ID NO: 153961 - DNA, 450 bp, Homo sapiens
  misc_feature: GYAE6OF01EGU2S.10.38.D05.1.454.CMB.1.raw
  modified_base (442)..(450): a, c, t, g, unknown or other
  misc_feature (442)..(450): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctccttgtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagcccaaggctcgcccctcggtcactctcgttcccgccctcctccactactatgctgagcgggctggcaggcgcatagnnnnnnnnn

SEQ ID NO: 153962 - DNA, 462 bp, Homo sapiens
  misc_feature: GYAE6OF01BVIFJ.10.38.D05.1.454.CMB.1.raw
  modified_base (442)..(442): a, c, t, g, unknown or other
  misc_feature (442)..(442): n is a, c, g, or t
  modified_base (448)..(462): a, c, t, g, unknown or other
  misc_feature (448)..(462): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccaacaacacccaggcaaagcccccaaactcatgatttttgatgtcagtaatcggccctcaggggtttctaatcgcttctctggctccaagtctggcaacacggcctcctgaccatctctgggctccaggctgaggacgaggctgattattactgcagctcatatacaaccagcagcacttctgtattcggcggagggaccaagctgaccgtcctaggtcagcccaaggctcgcccctcggtcactctcgttccccaccctcctccactactatgctgacgcggctggcaaggcncatagnnnnnnnnnnnnnnn

SEQ ID NO: 153963 - DNA, 448 bp, Homo sapiens
  misc_feature: GYAE6OF01ASBQC.10.38.D05.1.454.CMB.1.raw
  modified_base (440)..(448): a, c, t, g, unknown or other
  misc_feature (440)..(448): n is a, c, g, or t
tcagcatagtagtgcacgaccggtgctcgatttagtatctgatagttggggtttggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctggtcactctgttcccgcctcctccactactatgctgagcgggctggcaaggcgcatagnnnnnnnnn

SEQ ID NO: 153964 - DNA, 533 bp, Homo sapiens
  misc_feature: GYAE6OF01DRTAZ.10.38.D05.1.454.CMB.1.raw
  modified_base (245)..(245): a, c, t, g, unknown or other
  misc_feature (245)..(245): n is a, c, g, or t
  modified_base (419)..(419): a, c, t, g, unknown or other
  misc_feature (419)..(419): n is a, c, g, or t
tcagcatagtagtgcacgaccggtgctcgatttagtatctgatagttgggttgggggggtcgtcaggaggcagcgctctcaggacgtcaccaccatggcctgggctctgctcctcctcaccctcctcactcagggcacaggtcctgggcccagtctgccctgactcagcctccctccgcgtccgggtctcctggacagtcagtcaccatctcctgcactggaaccagcagtgactttgtgcttanaactatgtctcctggtaccagcaccacccaggcaaagcccccaaactccttgttttgaggtcagtaagcggccctcaggagtccctgatcggttctctgcctccaagtctggcaacacggccctccctgaccgtctctgggctccaggctgaggatgaggctgattactatgcngcgcatacttcaacggccccaagaggggttgtttgggcggcgggataaggtcgaccgtccgtgggccagcccaaggcctcgccccctcggtcactcctcgttccccaccctccc

SEQ ID NO: 153965 - DNA, 324 bp, Homo sapiens
  misc_feature: GYAE6OF01ERIH8.10.38.D05.1.454.CMB.1.raw
  modified_base (321)..(324): a, c, t, g, unknown or other
  misc_feature (321)..(324): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctggtcactctgttccccaccctcctccactactatgctgagcgggctggcaaggcgcatagnnnn

SEQ ID NO: 153966 - DNA, 515 bp, Homo sapiens
  misc_feature: GYAE6OF01AL0MT.10.38.D05.1.454.CMB.1.raw
  modified_base (345)..(345): a, c, t, g, unknown or other
  misc_feature (345)..(345): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (502)..(502): a, c, t, g, unknown or other
  misc_feature (502)..(502): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcagttattgaaacngatggcactacatattattctgactccgtgaacgggccggttcaccctctccagacgacacttcccaaacaacatcttgtatcttcacatgcacaatctagagagtcgacgacacggccacctattntgtgcgcganatcgactacgctcaattcgnggggccagggacc

SEQ ID NO: 153967 - DNA, 550 bp, Homo sapiens
  misc_feature: GYAE6OF01E4XTH.10.38.D05.1.454.CMB.1.raw
  modified_base (381)..(381): a, c, t, g, unknown or other
  misc_feature (381)..(381): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagcggccctcagggtttctagtcgcttctctgcctcaagtctggcaacacggcctccctgacatcnctggctcaggctgacgacgaggctagaatattactgcagctcatatgtagtagttggtcgtccttcgtttacgtaacgggtttttcgggccggggtaagggacccggtcggtcgtaccggtcccgtaccgtacgacgtaccgaccggacgtccgtcccgtcccgtcccg

SEQ ID NO: 153968 - DNA, 591 bp, Homo sapiens
  misc_feature: GYAE6OF01C3IR5.10.38.D05.1.454.CMB.1.raw
  modified_base (268)..(268): a, c, t, g, unknown or other
  misc_feature (268)..(268): n is a, c, g, or t
tcagcatagtagtgcacgaccggtgctcgatttagtatctgatagttgggtttggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaanagagcccagacaaagccccaaaattatcatttctgctgtcagtaatcggcctcgtagggtttctagtcgtcttctcgtggctacaagtctggcaacgacggcctccctgaccatctcgtcgggctcaggctggaggacgagctgattattatgcagctacataataacaaaacaccaaagtactttagaacttagttacgggacggaacgggtaaccctaaacgtaccggtaacccgttaccgtttaccgtacgaaccgccccgtaaacgggtcccgtaccgtaccccccgtcggttaccacccgtccgttccgttccccccg

SEQ ID NO: 153969 - DNA, 616 bp, Homo sapiens
  misc_feature: GYAE6OF01ANBIX.10.38.D05.1.454.CMB.1.raw
  modified_base (363)..(363): a, c, t, g, unknown or other
  misc_feature (363)..(363): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagccaccacccaggccaaacgcccccaaactccttgttttgagtcagtagcggcctcagcgtcctgattcggttctctcgcctcaagtctggcaacncggccctcctgaccgtctcgtcgggcctccgaggtctggaggatgacggtctagtactttacgtacgtcgaccgtagccgtctaattacgttcgaaccggtacccccaaaggtaggggttcggtttcgggacgggtacgggtaacgtaagggtcgtacccggttccgtcgggtaccacggcccgaacgggtcctcccggtcccccgttcggtccctaccgttccgttcccggttcccccgtcccgttaccccg

SEQ ID NO: 153970 - DNA, 452 bp, Homo sapiens
  misc_feature: GYAE6OF01C1UHU.10.38.D05.1.454.CMB.1.raw
  modified_base (444)..(452): a, c, t, g, unknown or other
  misc_feature (444)..(452): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgttttgaggtcagtaagcggccctcaggagtccctgatcggttctctgcctccaagtctggcaacacggcctccctgaccgtctctgggctccaggctgaggatgaggctgattactactgcagcgcatattcacggccccaacgagggtgttgggcggcgggactaaggtgaccgtcgtgggtcacgccaaggctcgcccctggtcactctcgtcccaccctcctccactactatgctggagcgggctggcaaggcgcatagnnnnnnnnn

SEQ ID NO: 153971 - DNA, 493 bp, Homo sapiens
  misc_feature: GYAE6OF01CDEX6.10.38.D05.1.454.CMB.1.raw
  modified_base (466)..(493): a, c, t, g, unknown or other
  misc_feature (466)..(493): n is a, c, g, or t
tcagcatagtagtgcacgaccggtgctcgatttagtatctgataggttggggtttgggggctttgcctgggtctcctggacagtcagtcaccatctcctgcacctggaaccagcagtgactttgttgcttataactatgtctccctggtaccagcaccacccaggcaaagcccccaaaactccttgtttttgaggtcagtaagcggccctcaggagtcccctggatcggttctctgcctccaagtctggcaacacggcctcctgaccgtctctgggctccaggctgagatgaggctgacttactactgcagcgcgatattcacggccccaacgagggtgtttgggcggcgggactaaggtgaccgtcctgggtcacggcccgaaggccgtagccccccgtggtcaccttctcgttccccaccctccctccactactatcgctgacgcgggctggcaaggcacatgnnnnnnnnnnnnnnnnnnnnnnnnnnnn

SEQ ID NO: 153972 - DNA, 566 bp, Homo sapiens
  misc_feature: GYAE6OF01C4D0O.10.38.D05.1.454.CMB.1.raw
  modified_base (227)..(227): a, c, t, g, unknown or other
  misc_feature (227)..(227): n is a, c, g, or t
  modified_base (320)..(320): a, c, t, g, unknown or other
  misc_feature (320)..(320): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccngcagtgacttttgtgcttaataactatgtctcctggtaccagcaccaccaggcaaacgccccaaactccttgttttgagtcagtaagcgcctnaggatccctgatcggttctctcgcctacaagtctggacaacgacggcctccctgaccgtctcgtgggctccgaggctgaggatggacggtctgtaattactacgtgcgagtcgactagtacttcgacggaccccaaggtaggggttgttggggcggacgggactaaagggtcgacccgtccgtgggtaccacggacccaaggcctccggccccctcggtccactccttcgtcccccgcccttaccc

SEQ ID NO: 153973 - DNA, 323 bp, Homo sapiens
  misc_feature: GYAE6OF01D2AS9.10.38.D05.1.454.CMB.1.raw
  modified_base (318)..(323): a, c, t, g, unknown or other
  misc_feature (318)..(323): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctggtcactctgttcccaccctcctccactatatgctgagcgggctggcaaggcgcatagnnnnnn

SEQ ID NO: 153974 - DNA, 301 bp, Homo sapiens
  misc_feature: GYAE6OF01E4F3J.10.38.D05.1.454.CMB.1.raw
  modified_base (291)..(301): a, c, t, g, unknown or other
  misc_feature (291)..(301): n is a, c, g, or t
tcagcatagtagtgcacgaccggtgctcgatttagtatctgatagttgggtttgggtgccgaagttgctggaggtcacggtcaccacgctgctgagggagtagagtcctgaggaccttgacttctggggccagggaaccctggtcaccgtctcctcagcctccaccaagggcccatcggtcttccccctggcgccctgctccaggagcacctccgagagcacagcggccctgggctgcctggtcaaggctacttcccatactatgctgagcgggctggcaaggcgcatagnnnnnnnnnnn

SEQ ID NO: 153975 - DNA, 445 bp, Homo sapiens
  misc_feature: GYAE6OF01C3I77.10.38.D05.1.454.CMB.1.raw
  modified_base (357)..(357): a, c, t, g, unknown or other
  misc_feature (357)..(357): n is a, c, g, or t
  modified_base (433)..(433): a, c, t, g, unknown or other
  misc_feature (433)..(433): n is a, c, g, or t
  modified_base (439)..(445): a, c, t, g, unknown or other
  misc_feature (439)..(445): n is a, c, g, or t
tcagcatagtagtgcacgaccggtgctcgatttagtatctgatagttggggtttggggctttgcctgggtctcctggacagtcagtcaccatctcctgcactggaaccagcagtgactttgtgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtccnggtcagcccaaggctgccccctggtcactctcgtcccaccctctccactacatcgctgagcgggctggcaaggtcncatagnnnnnnn

SEQ ID NO: 153976 - DNA, 219 bp, Homo sapiens
  misc_feature: GYAE6OF01D7HSK.10.38.D05.1.454.CMB.1.raw
  modified_base (60)..(60): a, c, t, g, unknown or other
  misc_feature (60)..(60): n is a, c, g, or t
  modified_base (163)..(219): a, c, t, g, unknown or other
  misc_feature (163)..(219): n is a, c, g, or t
tcagcatagtagtgcacgaccggtgctcgatttagtatctgatagttgggtttgggggtntggtggtctccactcccgccttgacgggctgctatctgccccctggtcactctgttcccaccctctccactactatgctgagcgggctggcaaggcgcatagnnnnnnnnnnnnnnnnnnnnnnnnnnnnnnnnnnnnnnnnnnnnnnnnnnnnnnnnn

SEQ ID NO: 153977 - DNA, 457 bp, Homo sapiens
  misc_feature: GYAE6OF01A94SN.10.38.D05.1.454.CMB.1.raw
  modified_base (386)..(386): a, c, t, g, unknown or other
  misc_feature (386)..(386): n is a, c, g, or t
  modified_base (445)..(445): a, c, t, g, unknown or other
  misc_feature (445)..(445): n is a, c, g, or t
  modified_base (450)..(457): a, c, t, g, unknown or other
  misc_feature (450)..(457): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggggtccctgaccgattctctggctccaagtctggcacctcagcctccctggccatcagtgggctccggtccgaggatgacgctgattatactgtgtagcatgggatgacagcctgagtgcttatgtcttcggaactgggaccaaggtcaccgtctacgtcagcccaaggcccaacccntcgtcacctctcgttccccgcccttcctccactactatcgctgagcggctggcagggcncatgnnnnnnnn

SEQ ID NO: 153978 - DNA, 559 bp, Homo sapiens
  misc_feature: GYAE6OF01C956P.10.38.D05.1.454.CMB.1.raw
  modified_base (326)..(326): a, c, t, g, unknown or other
  misc_feature (326)..(326): n is a, c, g, or t
  modified_base (406)..(406): a, c, t, g, unknown or other
  misc_feature (406)..(406): n is a, c, g, or t
  modified_base (546)..(546): a, c, t, g, unknown or other
  misc_feature (546)..(546): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgttcttataactatgtctcctggtaccagccaccacccaggccaaacgcccccaaactccttgttttgaggtcagtaagcggccctnaggatccctgatcggttctctgcctccaagtctggcaacgaccggcctccctgaccgtctctgggctccgaggctgaggntggaggctgattactactgcagcgcatacttcgacggccccaagtagggtgttggcggcggaacgtagggtcgaccgtcgtgggtcacggcccgaaggcctccggcccccgttcggtccctaccttccttccgttccccncccttccctaccc

SEQ ID NO: 153979 - DNA, 609 bp, Homo sapiens
  misc_feature: GYAE6OF01E1417.10.38.D05.1.454.CMB.1.raw
  modified_base (324)..(324): a, c, t, g, unknown or other
  misc_feature (324)..(324): n is a, c, g, or t
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccaccaggccaaacgcccccaaactccttgttttgaggtcagtaagcggccctnagacgtccctgatcggttctctcgcctcaagtctggcaacncgcctccctgtaccgtctcgtcgggctccgaggctggagtntgaggtctgattactactgacagtcgactatacgtccgacggacccaaggtcggggttcgtttcgggcgggtacggtacgtaaggtcggtaccggttccggtagggtaccgaccggtacccgaacgggtcccgttacccggtaccccccggttcggtaccctaccgttcccgttccggtttaccccccgtcccgtttaccccg

SEQ ID NO: 153980 - DNA, 454 bp, Homo sapiens
  misc_feature: GYAE6OF01EDABG.10.38.D05.1.454.CMB.1.raw
  modified_base (439)..(439): a, c, t, g, unknown or other
  misc_feature (439)..(439): n is a, c, g, or t
  modified_base (445)..(454): a, c, t, g, unknown or other
  misc_feature (445)..(454): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctcctgaccgtctctgggctccaggctgaggatgaggctgattactactgcagcgcatattcaggccccaacagggtgtttgggcggcgggactaaggtgaccgtccgtgggtcagcccaaggctcgccccctggtcactctcgttcccgccctcctccactactatcgctgagcgggctggcaggcncatagnnnnnnnnnn

SEQ ID NO: 153981 - DNA, 451 bp, Homo sapiens
  misc_feature: GYAE6OF01C9U5K.10.38.D05.1.454.CMB.1.raw
  modified_base (361)..(361): a, c, t, g, unknown or other
  misc_feature (361)..(361): n is a, c, g, or t
  modified_base (443)..(451): a, c, t, g, unknown or other
  misc_feature (443)..(451): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatacttcacggccccaagagggtgtttgggcggcgggactaaggtgaccgtcngggtcacgccaaggctcgcccctggtcactctcgtcccaccctcctccactactatgctgagcgggctggcaggcgcatagnnnnnnnnn

SEQ ID NO: 153982 - DNA, 527 bp, Homo sapiens
  misc_feature: GYAE6OF01AT2CU.10.38.D05.1.454.CMB.1.raw
  modified_base (401)..(401): a, c, t, g, unknown or other
  misc_feature (401)..(401): n is a, c, g, or t
  modified_base (525)..(526): a, c, t, g, unknown or other
  misc_feature (525)..(526): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggccaaacgcccccaaactccttgtttttgaggtcagtaagcggccctcaggagtccctgatcggttctctgcctccaagtctggcacacggcctccctgaccgtctcgtgggctccaggctgaggatggaggctgattactactgcagcgcatattcacggcccaacgngggtgtttgggcggcgggactagggtcgaccgtcgtgggtcagccgaggctcgcccctcgtcactctcgtcccaccctcctccactctactcgcgtgacggcgggctggcgaacggcgcagtgnng

SEQ ID NO: 153983 - DNA, 165 bp, Homo sapiens
  misc_feature: GYAE6OF01EU7IY.10.38.D05.1.454.CMB.1.raw
  modified_base (165)..(165): a, c, t, g, unknown or other
  misc_feature (165)..(165): n is a, c, g, or t
tcagcatagtagtgcacgaccggtgctcgatttagtatctgatagttgggtttgggggtgtggtggtctccactcccgccttgacgggctgctatctgccccctcggtcactctgttcccaccctcctccactactatgctgagcgggctggcaaggcgcatagn

SEQ ID NO: 153984 - DNA, 445 bp, Homo sapiens
  misc_feature: GYAE6OF01C9HBQ.10.38.D05.1.454.CMB.1.raw
  modified_base (440)..(445): a, c, t, g, unknown or other
  misc_feature (440)..(445): n is a, c, g, or t
tcagcatagtagtgcacgaccggtgctcgatttagtatctgatagttggggtttggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattacactgcagcgcatattcaggccccaacgagggtgttggcggcgggactaaaggtgaccgtctgggtcagcccaaggctcgccccctggtcactctcgtcccgccctcctccactactatgctgagcgggctggcaagcgcatagnnnnnn

SEQ ID NO: 153985 - DNA, 234 bp, Homo sapiens
  misc_feature: GYAE6OF01B1OM9.10.38.D05.1.454.CMB.1.raw
  modified_base (142)..(142): a, c, t, g, unknown or other
  misc_feature (142)..(142): n is a, c, g, or t
  modified_base (221)..(234): a, c, t, g, unknown or other
  misc_feature (221)..(234): n is a, c, g, or t
tcagcatagtagtgcacgaccggtgctcgatttagtatctgataggttgggtttgggtgccgaagttgctggaggtcaccgtctcccagcctccaccaaggcccatcggtcttcccctggcgccctgctccaggagcacctnagagagcacagcggccctgggctgcctggtcaaggactacttcccatactatgctgagcgggctggcaaggcgcatagnnnnnnnnnnnnnn

SEQ ID NO: 153986 - DNA, 599 bp, Homo sapiens
  misc_feature: GYAE6OF01DGJE1.10.38.D05.1.454.CMB.1.raw
  modified_base (275)..(275): a, c, t, g, unknown or other
  misc_feature (275)..(275): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctacactggaaccagcagtgactttgttgcttataactatgtctcctggtaccagcaccaccaggcaaagccccaaactccttgttttgaggtcagtaagcggccctnaggagtccctgatcggttctctgcctccaagtctggcaacacggcctccctgaccgtctctggctccaggctgaggatgaggctgattactactgcaggcgcattacttcgacggaccccaagtaggggttgtttcgggcgggtcgggtaacgtaacgggtcggaacccggttccgtgggtccacggtccccgaagggtcctcggccccccgttcgggtcccaccgttcccgtcgtttcccccgacccccgttccctcccgtaccttacctacttcgccgttggacggccgggcgtacgggcgaacgggtccgacagtagncgn

SEQ ID NO: 153987 - DNA, 513 bp, Homo sapiens
  misc_feature: GYAE6OF01EJ1HS.10.38.D05.1.454.CMB.1.raw
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagcctggggggtccctgagactctcctgtgcagcctctgggttcagcatcagtaacgactacatgacctgggcccgcaggctccgagggaaggggctgggagtgggtctcagttattgaaacagatggacactacatattatctgactccgtgaagggccgttcaccctctcccagacgacacttaccaacaacatcttgtactcttcacatgcacaatctagagagtcgacgacacggccactattatgtcgcgnacntcgactacgctacaattcgtgggccaaggg

SEQ ID NO: 153988 - DNA, 508 bp, Homo sapiens
  misc_feature: GYAE6OF01E05YI.10.38.D05.1.454.CMB.1.raw
  modified_base (345)..(345): a, c, t, g, unknown or other
  misc_feature (345)..(345): n is a, c, g, or t
  modified_base (440)..(440): a, c, t, g, unknown or other
  misc_feature (440)..(440): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatgaagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaggggctggagtgggtctcagttatgaaacngatggcactacatattatctgactccgtgaagggccgttcaccctctccagacgacacttccaacaacatcttgtatcttcacatcgcacaatcngagagtcgacgacacggccactattatgtgcgngacntcgactacgctcaattcgnggggccacgggg

SEQ ID NO: 153989 - DNA, 581 bp, Homo sapiens
  misc_feature: GYAE6OF01BK55V.10.38.D05.1.454.CMB.1.raw
  modified_base (431)..(431): a, c, t, g, unknown or other
  misc_feature (431)..(431): n is a, c, g, or t
  modified_base (572)..(572): a, c, t, g, unknown or other
  misc_feature (572)..(572): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagccaccacccaggaccaaacgccccctaaacttcctttgtttttacgaggtcagtaacgcggccctcaggacgtccctgtactcggttctctcgccctacgaagtctggaccaaacgaccggccctcccgtgacccgtctcgtcgggctccgaggctggacggntggagtctagtattactacgtgcagcgactatacttcgacgcccaagtagggttcgttagggcggacggtacgtaaggtcgaccgtcgtgggtcacggcccgaggcctccggcccctcggtccacgttcctccgttccccncccgttccc

SEQ ID NO: 153990 - DNA, 165 bp, Homo sapiens; identical to SEQ ID NO: 153983
  misc_feature: GYAE6OF01B8HQU.10.38.D05.1.454.CMB.1.raw
  modified_base (165)..(165): a, c, t, g, unknown or other
  misc_feature (165)..(165): n is a, c, g, or t

SEQ ID NO: 153991 - DNA, 522 bp, Homo sapiens
  misc_feature: GYAE6OF01C4K27.10.38.D05.1.454.CMB.1.raw
  modified_base (329)..(329): a, c, t, g, unknown or other
  misc_feature (329)..(329): n is a, c, g, or t
  modified_base (517)..(522): a, c, t, g, unknown or other
  misc_feature (517)..(522): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccaggggaagggctggagtgggtctcagttattgaaacagatggcactacatattattctgactccgtgaagggccggttcaccctctccagagacacttccaacaacatcttgtatcttcacatgcacaatctgagagtcgacgacacggccactattatgtgcgcgacatgactacgctcaattctggggccagggacncccgaggtccacccgtcctccccagccctccaaccaacgggccccatccggtccttcccccgtggcccgcccctgcctccgaggacgccacctccgagcgcacgacgccgccctgggcctcgcctggtacaacggtactacctcccgactactatcgctgacgcgggcgtcggcaaggcgacatagcnnnnnn

SEQ ID NO: 153992 - DNA, 473 bp, Homo sapiens
  misc_feature: GYAE6OF01D4Z2T.10.38.D05.1.454.CMB.1.raw
  modified_base (205)..(205): a, c, t, g, unknown or other
  misc_feature (205)..(205): n is a, c, g, or t
  modified_base (446)..(446): a, c, t, g, unknown or other
  misc_feature (446)..(446): n is a, c, g, or t
  modified_base (449)..(473): a, c, t, g, unknown or other
  misc_feature (449)..(473): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgtgcttataactatgtctcctggtaccagcaccacccaggcaaagcccccaaactccttgttttgaggtcagtaagcggccctnaggagtccctgatcggttctctgcctcaagtctggcaacacggcctcctgaccgtctctgggctccaggctgagatgaggctgattactactgcagcgcatatcacgccccaagagggtgttggcggcggactaaggtgaccgtcgtggtcacgcccaaggctacgcccctggtcactcgtcgttccccacccttccctccgactactatcgctgacgcgggctggcgaaggcgacatagngcnnnnnnnnnnnnnnnnnnnnnnnnn

SEQ ID NO: 153993 - DNA, 690 bp, Homo sapiens
  misc_feature: GYAE6OF01C4VRV.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgaggttcaactggtggagactggaggaggctggatccagccgtggggggtccctgagactctcctgtgcacgcctcgtgggttcagcatcaagtaacgactacatcgaccgtcgggccccgccaggcctccggaggggaaggggctgggagtgggtctacgtagttatagaaacagagtggactaacgtactattaatttattctagaccttccggtaggaacgggtcccggttaccacccctctaccgagaacgacctaccttacccaaacaactacttcttagttacttcctttacactacttacgacctaaactaacttactaggaacggtaacgtaccggaaccgaacccgtaacccgggtacccctaaacccgtttaagtttaacgttcggttacggacccggtaccgtaaacctaagttacccggtaaaccgttacccgaccttaaccgtaaacgtttccgggtaaccggggggcccgtaacggggggtaaccccg

SEQ ID NO: 153994 - DNA, 612 bp, Homo sapiens
  misc_feature: GYAE6OF01C1HPI.10.38.D05.1.454.CMB.1.raw
  modified_base (227)..(227): a, c, t, g, unknown or other
  misc_feature (227)..(227): n is a, c, g, or t
  modified_base (330)..(330): a, c, t, g, unknown or other
  misc_feature (330)..(330): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgtacttttgtgctttaataactatgtctcctggtaccagcaccaccaggacaaacgccccaaacttcctttgttttgaggtcaagtaacgcggccctnaggacgtccctgatcggttctctcgcctacaaagtctaggacaaaccgaccggtccctccctacgaccgtctcgtcgggcctccgaggtctggaggattggagtctagtaacttactactgcagcgactatactcgacggaccccaagtagggttgttggcgggtacggacgtaaggtcgaccggtccgtgggtaccacggtaccccaagggtcccgtaccggtccccccgttacgggtacctacccgttcccgttccgtttacccccccacccgttacccc

SEQ ID NO: 153995 - DNA, 537 bp, Homo sapiens
  misc_feature: GYAE6OF01BEG9J.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaagcccccaaactccttgttttgaggtcagtaagcggccctcaggagtccctgatcggttctctgcctccaagtctggcaacacggcctccctgacccgtctcgtgggctccaggctgaggatgaggctgacttactactgcagcgcatattcacggccccaagagggtgtttggcggcgggacgtaggtcgaccgtccgtgggtcaggcccgaaggcctcgccccctcggtccacgtctcgttcccacccgtccc

SEQ ID NO: 153996 - DNA, 227 bp, Homo sapiens
  misc_feature: GYAE6OF01CFRAZ.10.38.D05.1.454.CMB.1.raw
  modified_base (223)..(227): a, c, t, g, unknown or other
  misc_feature (223)..(227): n is a, c, g, or t
tcagcatagtagtgcacgaccggtgctcgatttagtatctgatagttgggtttgggtgccgaagttgctggaggtcaccgtctccccagcctccaccaagggcccatcggtcttcccctggcgccctgctccaggagcacctcagagagcacagcggccctgggctgcctggtcaaggactacttcccactactatgctgagcgggctggcaaggcgcatagnnnnn

SEQ ID NO: 153997 - DNA, 599 bp, Homo sapiens
  misc_feature: GYAE6OF01CROT6.10.38.D05.1.454.CMB.1.raw
  modified_base (265)..(265): a, c, t, g, unknown or other
  misc_feature (265)..(265): n is a, c, g, or t
tcagcatagtagtgcacgaccggtgctcgatttagtatctgatagttggttttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttatactatgtctcctggtaccngcaccacccaggcaaacgccccaactcttgttttgagtcagtagcggcctgagacgtcctgattcggtctctgcctcagtctgacaacacggcctcctgaccgtctcgtgggcctcgaggctgaggtatggagctagtacttactactgcagcgactatactcgaacgaccccaagtaggggttggtttacgggcgggtacggggtataacgggtcgtacccggttccgtaggggttacccaaccggtaccccgaaagggtcccgtaccggtcccccccgttcggtaccctaacccgttccgtcccggtttccccccgcccccgtttacccccg

SEQ ID NO: 153998 - DNA, 458 bp, Homo sapiens
  misc_feature: GYAE6OF01BGPH9.10.38.D05.1.454.CMB.1.raw
  modified_base (445)..(458): a, c, t, g, unknown or other
  misc_feature (445)..(458): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaagagggtgttggcggcgggactaaggtgaccgtcgtgggtcagcccaaggctcgccccctggtcactctcgtccccaccctcctccactactatcgctgagcgggctcggcaaggcgcatagnnnnnnnnnnnnnn

SEQ ID NO: 153999 - DNA, 323 bp, Homo sapiens
  misc_feature: GYAE6OF01CCEND.10.38.D05.1.454.CMB.1.raw
  modified_base (319)..(323): a, c, t, g, unknown or other
  misc_feature (319)..(323): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctcggtcactctgttcccgccctcctccactactatgctgagcggctggcaaggcgcatagnnnnn

SEQ ID NO: 154000 - DNA, 642 bp, Homo sapiens
  misc_feature: GYAE6OF01BIQ1V.10.38.D05.1.454.CMB.1.raw
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgactttgtgcttataactatgtctcctggtaccagccaccaccaggcaaacgcccccaactccttgttttgagtcagtagcgcctnagactcctgatcgttctctgcctcagtctgcacncgcctcctgaccgtctcgtggctccgaggctgagatgagctagtattactacgtcgcacgcgactattacttcgaccggacccctaaggtaggggtttcggtttcgggccgggtacggggtaacgttaaacggggtccggtaccccggttccggtacggggttacccaaccgggtacccccgtaaacgggtccccgttacccgggtcccccccccggtttacgggttacccctaaccccgtttcccggtttccccgggtttcccccccgtccccccgtttaccccccg

SEQ ID NO: 154001 - DNA, 519 bp, Homo sapiens
  misc_feature: GYAE6OF01ESEVZ.10.38.D05.1.454.CMB.1.raw
  modified_base (374)..(374): a, c, t, g, unknown or other
  misc_feature (374)..(374): n is a, c, g, or t
  modified_base (485)..(485): a, c, t, g, unknown or other
  misc_feature (485)..(485): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaagggctggagtgggtctcagttatgaaacagatggcactacatattatctgactccgngaagggccgttcaccctctccagagacacttaccaacaacattcttgtaatcttacactatcgcaacaatctgagtagtcgacgacacggccacgtattactgtgcgcacntgacctacgctactaagttcgtgggccctagggg

SEQ ID NO: 154002 - DNA, 453 bp, Homo sapiens
  misc_feature: GYAE6OF01D1F2Z.10.38.D05.1.454.CMB.1.raw
  modified_base (325)..(325): a, c, t, g, unknown or other
  misc_feature (325)..(325): n is a, c, g, or t
  modified_base (444)..(453): a, c, t, g, unknown or other
  misc_feature (444)..(453): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaanaggggtgtttgggcggcgggactaaggtgaccgtctgggtcagcccaaggctgcccctcggcactctcgttcccgccctccctccactactatgctgagcgggctggcaggcgcatagnnnnnnnnnn

SEQ ID NO: 154003 - DNA, 540 bp, Homo sapiens
  misc_feature: GYAE6OF01BWAS3.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcagttattgaaacagatggcactacatattatctgactcgtgacgggccgttcaccctctccagagacacttaccaacaactatcttgtatcttacacatgacacaatctagacgagtaccgacgaaccacggaccctaccttatttacttggtcgcgcgtacatcgactaccgctacaactttccggcggggcccgagggacccg

SEQ ID NO: 154004 - DNA, 551 bp, Homo sapiens
  misc_feature: GYAE6OF01AIU7A.10.38.D05.1.454.CMB.1.raw
  modified_base (402)..(402): a, c, t, g, unknown or other
  misc_feature (402)..(402): n is a, c, g, or t
  modified_base (444)..(444): a, c, t, g, unknown or other
  misc_feature (444)..(444): n is a, c, g, or t
  modified_base (495)..(495): a, c, t, g, unknown or other
  misc_feature (495)..(495): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctcaagtctggcaacacggcctccctgaccgtctctcgggctccgaggctgaggntgaggctgattactactgcagcgcatattcacggccccaagnggggttgtttgggcggtcgggacgtaagggtcgaccgttccgtgggtaccncggcccgaagggcctcggccccctcggtcaccgttcctcgttccccgcccttcccg

SEQ ID NO: 154005 - DNA, 523 bp, Homo sapiens
  misc_feature: GYAE6OF01DJMW1.10.38.D05.1.454.CMB.1.raw
  modified_base (522)..(523): a, c, t, g, unknown or other
  misc_feature (522)..(523): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggcaaagcccccaaactccttgtttttgaggtcagtaagcggccctcaggagtccctgatcggttctctgcctccaagtctggcaacacggcctccctgaccgtctctcgggctcaggctgaggatgaggctgattactactgcagcgcatattcaggccccaacgagggtgtttggcggcgggacgtaagggtgaccggtcctgggtccagcccaaggctcgcccctcggtcactctcgttcccgcctcctccactctatcgctgacggcgggctggacacggcgcagtgnn

SEQ ID NO: 154006 - DNA, 586 bp, Homo sapiens
  misc_feature: GYAE6OF01BZVP5.10.38.D05.1.454.CMB.1.raw
  modified_base (418)..(418): a, c, t, g, unknown or other
  misc_feature (418)..(418): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctcccgagggaaggggctgggagtgggtctcgagttattgaaacagatggcactacatattatctgactcgtgaagggccggttcaccctctccagacgacacttccaacaacntcttagtactcttcactatcgacaacaatctgaagtacgtcgaaccgaccaccgggtacccaacccttattagttcggtacggccgtaccggaacctaagttcggaaacccttaacggccctttaccgaaaacgttttccggtacgggggggaccccctaaagggggg

SEQ ID NO: 154007 - DNA, 636 bp, Homo sapiens
  misc_feature: GYAE6OF01C0UOL.10.38.D05.1.454.CMB.1.raw
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttanaactatgtctcctggtaccagcaccaccagaacaacgcccccaaacttcctttgttttgaggtcagtaacgccggcctnacggacgtccctgacttcggttctctcgcctaccaagtcctggacaacgaccggtccctcccgtgacccgtctcgtcgggcctccgaggtctaggaggatggacggtctagtacttactacgtgcagcgactatacttcgaccggaccccaaggtaggggttcggtttcgggcgggtaccgggtacgtaacgggtccggtacccggttccgtcggggtaccgacggtccccgtaaagggtcccgtcccggtccccccgttacgggtccctaaccgttcccgttacccgttcccccgtaccccgttacccc

SEQ ID NO: 154008 - DNA, 644 bp, Homo sapiens
  misc_feature: GYAE6OF01D64SR.10.38.D05.1.454.CMB.1.raw
  modified_base (330)..(330): a, c, t, g, unknown or other
  misc_feature (330)..(330): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgttgcttataactatgtctcctggtaccagccaccaccaggaccaaacgccccctaaacttcctttgttttgaggtcagtacgcgcctnaggactcctgacttcggttctctcgcctacaagtctggacaacgtaccggcccttccctcggtacccgttctccgtcgggcctccggaggtcgtggaggagttggaggtctagtaacttactacgtcgacacgcgtactattacgttcgaaccggtacccgaaggtacggggttcggtttcgggcgggtacgggacggtaacgggtcggtaccgttccggtacgggtaccgaccggacccgaacggtcccgtacccgtcccccgttcggtaccctaccgttcccgttcccggttcccccgtccccgttaccccg

SEQ ID NO: 154009 - DNA, 454 bp, Homo sapiens
  misc_feature: GYAE6OF01EDWHU.10.38.D05.1.454.CMB.1.raw
  modified_base (442)..(454): a, c, t, g, unknown or other
  misc_feature (442)..(454): n is a, c, g, or t
tcagcatagtagtgcacgaccggtgctcgatttagtatctgatagtggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctggtcagcccaaggctcgccccctggtcactctcgttcccaccctcctccactactatgctgacgcgggctggcgaggcgcatagnnnnnnnnnnnnn

SEQ ID NO: 154010 - DNA, 646 bp, Homo sapiens
  misc_feature: GYAE6OF01ARSR6.10.38.D05.1.454.CMB.1.raw
  modified_base (320)..(320): a, c, t, g, unknown or other
  misc_feature (320)..(320): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagccaccaccaggacaaacgcccccaaactcttgttttgagtcagtagcggcctnaggacgtcctgatcggttctcgtcgcctccaagtctggcaacgaccggtccctccctcgacccgtctcgtcgggcctccgaggtctggaggattggaggtctagtactttacctactgaccagccgactaattacgttaccgaaccggtacccccaaaggtacgggggtttggtttcggggaccgggtacggggtaaccgttaagggtccggtaacccggttccggtcggggttacccgacggtaccccgaagggtcccgttcccggccccccgttcggtaccctaccgttacccgttccggtttccccccgtccccgttaccccg

SEQ ID NO: 154011 - DNA, 467 bp, Homo sapiens
  misc_feature: GYAE6OF01EV0XF.10.38.D05.1.454.CMB.1.raw
  modified_base (248)..(248): a, c, t, g, unknown or other
  misc_feature (248)..(248): n is a, c, g, or t
  modified_base (333)..(333): a, c, t, g, unknown or other
  misc_feature (333)..(333): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (456)..(467): a, c, t, g, unknown or other
  misc_feature (456)..(467): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaactccttgttttgaggtcagtaagcggccctcaggagtccctgatcggttctctgcctccaagtctggcaacncggcctccctgaccgtctctgggctccaggctgaggatgaggctgtaatatactactgcagcgccatattcaagggcccccaaanacggggtgtttggcggcggggactaagggtgaccgtcctgggtcagcccaaggctgccccctggtccactctgttcccaccctcctccactactatgcntgagcggcnggcaaggcgcatagnnnnnnnnnnnn

SEQ ID NO: 154012 - DNA, 640 bp, Homo sapiens
  misc_feature: GYAE6OF01C3VYQ.10.38.D05.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctccngcactggaaccngcagtgtacttttgtgctttaataactatcgtctcgtggtaccagccaccaccaggaccaaacgccccctaaaacttccgtttgtttttacgaggttacaaggttaacggccggtaccctcgaacggtacgtcccgtgtacgttcggttctcgtcgcctacgaagtctcggaccaacgaccggccctcctcgaccgtctcgtcggctccgaggctggaggatggacggtctagtaacttactactgcagcactatactcgaaccggacccctaaggtggggttcgttcgggcggtacgggtacgtaacgggtcgtacccggtcgttgggacctacggacccgaagggtccctacccggtcccccgttcgggtaccctaccttcccgttacccgttccccaccccgttcccg

SEQ ID NO: 154013 - DNA, 550 bp, Homo sapiens
  misc_feature: GYAE6OF01BECYK.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctgtaccagcaccaccaggcaaacgcccccaaactccttgtttttgaggtcagtaagcggcctcaggagtccctgatcggttctctcgcctccaagtctggcaacacggcctccctgaccgtctcgtcgggctccgaggtctggaggatggaggctgattactactgcagcgctatactcgacggaccccaagagggttggttgggcggcgggtacgtaaggtcgtaccgtccgtgggtcacggcccgaaggccctcgcccccgtggtccacttctccgttccccacccgtccc

SEQ ID NO: 154014 - DNA, 557 bp, Homo sapiens
  misc_feature: GYAE6OF01BES0S.10.38.D05.1.454.CMB.1.raw
  modified_base (363)..(363): a, c, t, g, unknown or other
  misc_feature (363)..(363): n is a, c, g, or t
  modified_base (451)..(451): a, c, t, g, unknown or other
  misc_feature (451)..(451): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccaccaggcaaacgcccccaaactccttgttttgagtcagtaagcggccctcaggacgtccctgactcggttctctgcctcaagtctggcaacncggcctccctgaccgtctcgtgggctccgaggctgaggtatgaggtctgattactactgcagcgactattagtcgacggaccccaagnggggttcgtttgggcggtcgggacgtaagggtcgaccgtcgtcgggtcacggcccgaaggcctccgcccccgtcggtaccaccgttctccgttccccgccctcccg

SEQ ID NO: 154015 - DNA, 517 bp, Homo sapiens
  misc_feature: GYAE6OF01DK9BZ.10.38.D05.1.454.CMB.1.raw
  modified_base (270)..(270): a, c, t, g, unknown or other
  misc_feature (270)..(270): n is a, c, g, or t
  modified_base (333)..(333): a, c, t, g, unknown or other
  misc_feature (333)..(333): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
  modified_base (516)..(517): a, c, t, g, unknown or other
  misc_feature (516)..(517): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgcttataactatgtctcctggtacagcaccaccagcaaacgccccaaatccttgttttgagtcagtagcgcctnaggactcctgatcggttctctcgcctcaagtctggaccaacacggccctcccgtgacccgttntcgtgggcctccgaggctggaggtagtgaggctgaattactactgcagcacatactcacggcccaagagggtgttggcggcggataggtgaccgtcgtggcacgcagctcgccccgtcgtcctactcctcgttcccacccgtcctcctactactntcgctgacgcggcgngcgacgcgnatgnn

SEQ ID NO: 154016 - DNA, 527 bp, Homo sapiens
  misc_feature: GYAE6OF01DX9OM.10.38.D05.1.454.CMB.1.raw
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgactttgtgcttataactatgtctcctgtaccagcaccaccaggcaaacgcccccaaactcctttgttttgagtcagtaacgcggccctnaggactccctgattcggttctctgcctcaagtctgcaacncggcctcctgacctcncgtggctccgagctgagntgagctgtattacatgcagcnatactcaacgacccaagtgggttgttcggcggcggataggtcgaccgtcgtgggcacggccgaaggtcctccgaccccctggtccacgttcctccgtccccgcctccc

SEQ ID NO: 154017 - DNA, 496 bp, Homo sapiens
  misc_feature: GYAE6OF01DZ5DD.10.38.D05.1.454.CMB.1.raw
  modified_base (485)..(485): a, c, t, g, unknown or other
  misc_feature (485)..(485): n is a, c, g, or t
  modified_base (491)..(496): a, c, t, g, unknown or other
  misc_feature (491)..(496): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattaattgtgcgcgacatgactacgctcaattctggggccagggagcccaggtcaccgtctccccagcctccaccaagggcccatcggtcttccccctggccgccctgcctccaggcgcaccctccgagagcacagccggccctgggctgcctggtcaaggactacttcccactactatgctgagcgggctggcaaggcncatagnnnnnn

SEQ ID NO: 154018 - DNA, 536 bp, Homo sapiens
  misc_feature: GYAE6OF01EWC60.10.38.D05.1.454.CMB.1.raw
  modified_base (535)..(536): a, c, t, g, unknown or other
  misc_feature (535)..(536): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtcctgatcggttctctgcctccaagtctggcaacacggcctccctgacccgtctctgggctccaggctgaggatgaggctgattactactgcagcgcatattcacggccccaagagggttgtttgggcgggcgggacgtaagggtgaccgtccgtgggtcacgcccgaaggctcgccccgtcgtcactctcgtcccgccctcctcctactactatcgctggacggcggcgttgggccgaagggcgacagtgnn

SEQ ID NO: 154019 - DNA, 562 bp, Homo sapiens
  misc_feature: GYAE6OF01ACZBJ.10.38.D05.1.454.CMB.1.raw
  modified_base (247)..(247): a, c, t, g, unknown or other
  misc_feature (247)..(247): n is a, c, g, or t
tcagcatagtagtgcacgaccggtgctcgatttagtatctgatagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcagttattgaaacngatggcactacatattattctgactccgtgaagggccggttcaccctctccagagacacttccaacaacatcttgtatcttcacatgcacaatctgagagtcgacgacacggccacctattattgtgcgcgacatgactacgctcaattcgtggggccagggacgcccgaggtccaccgtcctccccagccctccacccgaacgggccccagttccggtccttccccccgtcggcccgcccctcgccttcccgacgggacgccaccctccggacgacgccaccgacggccggaccccgtcggggcctcggtcccg

SEQ ID NO: 154020 - DNA, 485 bp, Homo sapiens
  misc_feature: GYAE6OF01CZVWQ.10.38.D05.1.454.CMB.1.raw
  modified_base (476)..(485): a, c, t, g, unknown or other
  misc_feature (476)..(485): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaaagcccccaaactccttgtttttgaggtcagtaagcggccctcaggagtccctgatcggttctctgcctccaagtctggcaacacggcctaccctgaccgtctctgggctccaggctgaggatgaggctgattactactgcagcgcaatattcgacggccccaaagtaggggtgtttcgggcgggcgggaactaagggtcgacccggtcgtggggtcacggaccccaaggcctcggccccctcggtccactctcgttccccaccctccctccactactatcgctgacggcgggctggcgaaggcgcatagnnnnnnnnnn

SEQ ID NO: 154021 - DNA, 320 bp, Homo sapiens
  misc_feature: GYAE6OF01B4ONF.10.38.D05.1.454.CMB.1.raw
  modified_base (320)..(320): a, c, t, g, unknown or other
  misc_feature (320)..(320): n is a, c, g, or t
tcagcatagtagtgcacgaccggtgctcgatttagtatctgatagttgggtttgggaacctatgaacattctgtagggaccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctcggtcactctgttcccaccctcctccactactatgtcgagcgggctggcaaggcgcatagn

SEQ ID NO: 154022 - DNA, 453 bp, Homo sapiens
  misc_feature: GYAE6OF01CG54E.10.38.D05.1.454.CMB.1.raw
  modified_base (442)..(453): a, c, t, g, unknown or other
  misc_feature (442)..(453): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacgagggtgttggcggcgggactaaggtgaccgtctgggtcagcccaaggctcgccccctggtcactctcgttcccgccctcctccactactatgctgagcgggctggcaggcgcatagnnnnnnnnnnnn

SEQ ID NO: 154023 - DNA, 324 bp, Homo sapiens
  misc_feature: GYAE6OF01BBUCJ.10.38.D05.1.454.CMB.1.raw
  modified_base (313)..(313): a, c, t, g, unknown or other
  misc_feature (313)..(313): n is a, c, g, or t
  modified_base (319)..(324): a, c, t, g, unknown or other
  misc_feature (319)..(324): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctggtcactctgttcccaccctcctccactactatgctgagcgggctggcaaggcncatagnnnnnn

SEQ ID NO: 154024 - DNA, 511 bp, Homo sapiens
  misc_feature: GYAE6OF01BWH6S.10.38.D05.1.454.CMB.1.raw
  modified_base (496)..(511): a, c, t, g, unknown or other
  misc_feature (496)..(511): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggacaaacgcccccaaactcctttgttttgaggtcagtaagccggccctcaggacgtccctgattcggttctctgcctcaagtctggacaacacggcctcccgtgacccgtctcgtgggcctccgaggctggaggacgaggctgattatactgcagctcatatacaaccagcagctacttctgtagtcggacggaggaccaagctcgacccgtcgtaggtcacgacccgaaggcctccgcccccgtggtcctacgtccttccgttccccctaccccttccctcctaaccttactactcgctggacggtccgggctcggacgaacggcgacagtagnnnnnnnnnnnnnnnn

SEQ ID NO: 154025 - DNA, 564 bp, Homo sapiens
  misc_feature: GYAE6OF01D3TIJ.10.38.D05.1.454.CMB.1.raw
tcagcatagtagtgcacgaccggtgctcgatttagtatctgatagctgggttttccttgttgctatttcaaaaggtgtccactgtgaggttcaactggtggagaccggaggaggctggatccagcctggggggtccctgagactctcctgtgcagcctctgggttcagcatcagtaacgactacatgacctgggcccgccaggctccagggaggggctggagtgggtctcagttatgaaacagatggcactacatattatctgactccgtgaagggccgttcaccctctccagagacacttccaacaacatcttgtatcttcacatgcacaatctgagagtcgacgacacggccactattatgtgcgcgacatcgactacgctcaattcgtggggccagggacgccccgaggtccacccgtcctcccccacgccctacccgaaccgaacgggccccacgtccgggttcccttcccccgtggcccgccctcgccctccgacggacgcccacccgtcacggacgacgccaaccgacggcccgggcccgtcggggcctcggtcccgg

SEQ ID NO: 154026 - DNA, 542 bp, Homo sapiens
  misc_feature: GYAE6OF01BF2GD.10.38.D05.1.454.CMB.1.raw
  modified_base (541)..(541): a, c, t, g, unknown or other
  misc_feature (541)..(541): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctcctgaccgtctctgggctccaggctgaggatgagctgattactactgcagcgcatacttcacggccccaacgagggttgtttgggcgggcgggacgtaagggtcgaccgtccgtgggtccacgcccaaggctcgccccgtcggtccactcctcgttccccaccctcctccacctactactgcctggacggccgggctcggcgtaacggcgacatgnc

SEQ ID NO: 154027 - DNA, 696 bp, Homo sapiens
  misc_feature: GYAE6OF01DRS8I.10.38.D05.1.454.CMB.1.raw
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (327)..(327): a, c, t, g, unknown or other
  misc_feature (327)..(327): n is a, c, g, or t
tcagcatagtagtgcacgaccggtgctcgatttagtatctgatagttgggtttggggggtctcaggaggcagcgctctcaggacgtcaccaccatggcctgggctctgctcctcctcaccctctcactcaggcacgaggtcctggcccagtctgccctgactcagcctccctccgcgtccggtctcctggacagtcagtccaccatctcctgcactggaaccagcagtgactttgtncttanaactatgtctctggtaccagcaccaccaggacaaacgccccctaaatcctttgtttagagtcagtaagccggcctgaggactccngtacgtcgttctctcgccctacgtacgtcgtcgacaaccgccgtccctcgtcgaccgttcgtcggtacggtcctaccggacgtcgtaggacggtaacgtgggtacgtacgtaagttaacctttacgaacgtcgacgtacggtacccgtaattaacgtttaccgtaaccggaacccccggtacccgtaaaggggtttcggggtttcgggttaccggggaccgggttaaccgggttaacggttaaaccgggtacccggttacccggtccgggttcggtaacccgaccggtaacccggacggtccctcccccggtccccggttacggacctttacccgttcggttaccccgttcccccgtccccgtaacccc

SEQ ID NO: 154028 - DNA, 324 bp, Homo sapiens
  misc_feature: GYAE6OF01BM55X.10.38.D05.1.454.CMB.1.raw
  modified_base (319)..(324): a, c, t, g, unknown or other
  misc_feature (319)..(324): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctggtcactctgttcccaccctcctccactactatgctgagcgggctggcaggcgcatagnnnnnn

SEQ ID NO: 154029 - DNA, 531 bp, Homo sapiens
  misc_feature: GYAE6OF01DIQO7.10.38.D05.1.454.CMB.1.raw
  modified_base (255)..(255): a, c, t, g, unknown or other
  misc_feature (255)..(255): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (518)..(518): a, c, t, g, unknown or other
  misc_feature (518)..(518): n is a, c, g, or t
tcagcatagtagtgcacgaccggtgctcgatttagtatctgatagttgggtttgggggctctgctcctcctcaccctcctcactcaggacacaggtcctgggccctgtctgccctgactcagcctgcctccgtgtctgggtctcctggacagtcggtcaccatctcctgcactggacccagcactgatgttgggcattataaccttgtctcctggtatcaacacgccagacaaacgccccacactcttgatttangaagtcagtaagcggcctgagggtttctagtcgcttctctgcctcaagtctggcaacacgcctcctgacaactctcgtgggctccgaaggtctggaggtatggaggcttagaacttactactgcagcacatattacacggacccaagtagggtagtttgggcggtacggacgtacggtcgaccgtcgtggtcacgccgaacggcctcgtcccctcgtctactcgtcctcccgccctccnctactactntgctgacgcgggacnggcacggcgtacg

SEQ ID NO: 154030 - DNA, 519 bp, Homo sapiens
  misc_feature: GYAE6OF01C77D6.10.38.D05.1.454.CMB.1.raw
  modified_base (375)..(375): a, c, t, g, unknown or other
  misc_feature (375)..(375): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgcaggctccgagggaaggggctggagtgggtctcagttattgaaacagatggcaactacatattatctgactccgngaagggccgttcaccctctccagagacacttccaacaacatcttgtatcttcacatgacacaatctgagagtcgacgacaccggcccaacttatattcgtgcgcgacatcgacttacgcttcaattcgcggggccaggggaccg

SEQ ID NO: 154031 - DNA, 545 bp, Homo sapiens
  misc_feature: GYAE6OF01DYSZY.10.38.D05.1.454.CMB.1.raw
  modified_base (543)..(544): a, c, t, g, unknown or other
  misc_feature (543)..(544): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaatcctgtttttgaggttcagtaagcggccctcaggagtccctgatcggttctctgcctccaagtctggcaacacggcctcctgacccgtctctgggctccaggctgaggatgaggctgattactactgcagcgcatattcaggccccaacagggtgtttggcggcgggactaagggtgaccggtccgtgggtccgagcccaagggcctcgccccctcggtccacttcctcgttccccaccctccctccctactacctattcgcttggacgtccgggcttgggaccaaggcgacactgnng

SEQ ID NO: 154032 - DNA, 610 bp, Homo sapiens
  misc_feature: GYAE6OF01AR14D.10.38.D05.1.454.CMB.1.raw
  modified_base (551)..(551): a, c, t, g, unknown or other
  misc_feature (551)..(551): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtgggtctcgtagttattagaaacaggatggacactacatattattctgactccgtaggaacgggtcccggttcacccttctaccgagacgacctacttacccaaacaacctattccttagttactcttaccaactatgaccaactaattcctaaggacggtagtaccggaacccaacgtacccggccctaaacgttatttacgtggtcggacgtccggaaacngttacggaccttaaccggcttaaccgtaagttcggtacgggggcccgaaggggtacccg

SEQ ID NO: 154033 - DNA, 439 bp, Homo sapiens
  misc_feature: GYAE6OF01EHE79.10.38.D05.1.454.CMB.1.raw
  modified_base (431)..(431): a, c, t, g, unknown or other
  misc_feature (431)..(431): n is a, c, g, or t
  modified_base (436)..(439): a, c, t, g, unknown or other
  misc_feature (436)..(439): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagcccaaggctgccccctggtcactctgttcccaccctcctccactctatgctgagcggctgcagcncatgnnnn

SEQ ID NO: 154034 - DNA, 547 bp, Homo sapiens
  misc_feature: GYAE6OF01A8GE5.10.38.D05.1.454.CMB.1.raw
  modified_base (317)..(317): a, c, t, g, unknown or other
  misc_feature (317)..(317): n is a, c, g, or t
  modified_base (350)..(350): a, c, t, g, unknown or other
  misc_feature (350)..(350): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagccagtcaccatctcctgcactggaaccagcagtgactttgtgcttataactatgtctctggtaccagcaccaccaggcaaacgcccccaaactccttgttttgagtcagtagcgcctnagatcctgatcgtctctgcctcagtctgcaacncggcctcctgacctctcgtgggctcgaggctgaggatgaggctagtattacgtactgctagcgctatacttcacggcccaagtagggttgttggcggcggtatacgggtcgacccgttcgtgggtccacggacccgaagggtccctccggtcccccgtacggtccctacgttccgttccgttccccgccccttcccg

SEQ ID NO: 154035 - DNA, 720 bp, Homo sapiens
  misc_feature: GYAE6OF01ADFIK.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctcctccgcgtccggtctcctggacagtcagtcaccatcctcctgcactggaaccagcagtgtacttttgtgcttataactatcgtctccgtggtaccagccacccaccaggaccaaaccgccccctaaacttccgttttggtttttacgacggttaccaaggtaacgccggtaccctcgaaggtacttcccgtagtacgttccggttcctcgtcgtccctaccgtaaggttccgtagggaccctaaaccgtccggtccctcccgtagtaacctaatccgtcgtcgggacctaccgaggtccgtacggacgtacggagtactagtaaacttacgttaactcggactacgtcctacgtaagttacgtaggtaacgtaacgttcggttaccgttcccgttacgttttacggtaacgggttttaccgggacggtaacgggtaccgtacgggtccgttaccggtaacccgtaccgttaacggtcccgtaaccgtaccccggtaagggtccccgttcccggtaccccccggttcggtccgtacccgtttccccg

SEQ ID NO: 154036 - DNA, 787 bp, Homo sapiens
  misc_feature: GYAE6OF01BRXQE.10.38.D05.1.454.CMB.1.raw
  modified_base (765)..(765): a, c, t, g, unknown or other
  misc_feature (765)..(765): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcacgtaccaacctatcctcctcgacctacgtaccggaccagcctacgtgtagttgggttcggacttaattaacttaaccttgtccttcgtggtactacaaccaccgaccaagaaccaacccgcccccaactacctttacttagttaactttagtaaggtaacgtaccgtaaggtaaccggtcccggtacccccttaggggtttaacggggttttacctaacgggttccgtttccgttttccgttaccgtccggtacccccttaacggtaacgtttccggtacggaaccctaaccggtacccggtccccttaccgttaacggaaaccttacgtttccgttccggtaccgggtcctaccggtacggtacgtacggaaccggaacggtacgtacgttaacgtaattacgtttacgtcgacgtattccgtataattacgttaggtacgtaggttcgtaccgttactttacgttacgggtttacggggtttaccggacggggtacggaaccggtcggtacgtaccggtaccggttacgacggtaccgaaccgtaccggacggttacccnccccggttcccggtcgtacccg

SEQ ID NO: 154037 - DNA, 575 bp, Homo sapiens
  misc_feature: GYAE6OF01B46FJ.10.38.D05.1.454.CMB.1.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcactgatggttggctattataaccttgtctctggtatcaacacgccagacaacgcccccanactctgtatttangaagtcagtaacgccgcctcgtagggttctagtcgcttctctcgcctcagtctggcaacgcgcctcctgacatctcgtggcctccgaggctagacgacgaggctagtaattacttacgcgtcagtctacagttacgtggtagtagttcgggttctcccgtttacgtttacgtaacgggtttcgggacgggtacggaccgtggtcgttacggtacccgttactaacgtccgaacggtcccgaaggtccctccggtcccccgttcggtacccg

SEQ ID NO: 154038 - DNA, 655 bp, Homo sapiens
  misc_feature: GYAE6OF01DIVU9.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgtactttgtgcttaataactatgtctcctggtaccagccaccaccgaggaccaaacgccccaaacttcctttgttttgagtcagtaacgcggtccctgacgacgtccctgactcggttctcgtcgcctacgaagtctcggactaaccgaccggtcccttccctcggtacccgtctccgtcgggcctccgaggtctaggagtagtggaggtctaggtactttactacgtgtacagccgactaattacgttacgaccgggtaaccccctaaggtaccggggtttgttacggggaccggtaccggggtaacgtaacggggtcgtacccggtccggtagggtaccgacggtaccccgaagggtcctacccgggcccccttacggttcctacccgttccgttcccgtttcccccgccccttccccg

SEQ ID NO: 154039 - DNA, 568 bp, Homo sapiens
  misc_feature: GYAE6OF01DDH56.10.38.D05.1.454.CMB.1.raw
  modified_base (451)..(451): a, c, t, g, unknown or other
  misc_feature (451)..(451): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagccaccacccaggacaaacgcccccaaactcctttgttttgaggtcagtaagccggcctcaggagtccctgacttcggttctctcgtcctacctaacgtctggaccaaacgaccggtccctcccgtcgaccgtctcgtcgggctccgaggcctaggaggatgagctagtattacactgcagcgnatatcgacgacccaagtgggttgttggcggacggtactaggtcgaccggtccgtgggcacggcccgaaggtcctccggcccccgtcggtaccacgttcctccgtccccgcccttccc

SEQ ID NO: 154040 - DNA, 454 bp, Homo sapiens
  misc_feature: GYAE6OF01BQX73.10.38.D05.1.454.CMB.1.raw
  modified_base (446)..(454): a, c, t, g, unknown or other
  misc_feature (446)..(454): n is a, c, g, or t
tcagcatagtagtgcacgaccggtgctcgatttagtatctgatagttggggttttggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgacaatctctgggctccaggctgacgacgaggctgaatattactgcagctcatatgtagatggtgccttctttcaaggttttcggcggagggaccaagctgaccgtctaggtcagccaaggctcgcccctggtcactctcgtcccaccctcctccactactatgctgagcggctggcaagcgcatagnnnnnnnnn

SEQ ID NO: 154041 - DNA, 534 bp, Homo sapiens
  misc_feature: GYAE6OF01B2H8J.10.38.D05.1.454.CMB.1.raw
  modified_base (339)..(339): a, c, t, g, unknown or other
  misc_feature (339)..(339): n is a, c, g, or t
  modified_base (532)..(532): a, c, t, g, unknown or other
  misc_feature (532)..(532): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctcnggctcaggctgagatgaggctgattacactgcagcgcatattcgacggccccaacgagggtgtttggcgggcgggacgtaagggtcgaccgtcgtggtcacggcccaaggctcgccccgtcggtccactctcgttcccaccctcctccactacctatcgctggacggcgggcgtcggacgaacggcgacatgncg

SEQ ID NO: 154042 - DNA, 327 bp, Homo sapiens
  misc_feature: GYAE6OF01BI8E0.10.38.D05.1.454.CMB.1.raw
  modified_base (319)..(327): a, c, t, g, unknown or other
  misc_feature (319)..(327): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctggtcactctgttccccgccctcctccactacatgctgagcggctggcaaggcgcatagnnnnnnnnn

SEQ ID NO: 154043 - DNA, 466 bp, Homo sapiens
  misc_feature: GYAE6OF01EHVRP.10.38.D05.1.454.CMB.1.raw
  modified_base (446)..(466): a, c, t, g, unknown or other
  misc_feature (446)..(466): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgtttttgaggtcagtaagcggccctcaggagtccctgatcggttctctgcctcaagtctggcaacacggcctccctgaccgtctctgggctccagctgaggatgaggctgattactactgcagcgctatattcaggccccaagagggtgtttgggcggcgggactaaggtcgaccgtcctgggtcagcccaaggctcgcccctggtcactctcgtcccgccctccctccactactatgctgacgcgggcgtggcaaggcgcatagnnnnnnnnnnnnnnnnnnnnn

SEQ ID NO: 154044 - DNA, 529 bp, Homo sapiens
  misc_feature: GYAE6OF01A4MDC.10.38.D05.1.454.CMB.1.raw
  modified_base (260)..(260): a, c, t, g, unknown or other
  misc_feature (260)..(260): n is a, c, g, or t
  modified_base (494)..(494): a, c, t, g, unknown or other
  misc_feature (494)..(494): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctntgggttcagcatcagtaacgactacatgacctgggccccgccaggctccgaggggaaggggctgggagtgggtctcgagttatagaaacagatggcatacatattattctgactccgtagaacgggtccgttcaccctctacccagacgacaccttacccaaacaacatcttgtactcttcacatgacactatctgagagtcgacacacggcctaacctattatgtcgcgcganagtgacctacgctacaattcgcgggcaggggaccg

SEQ ID NO: 154045 - DNA, 550 bp, Homo sapiens
  misc_feature: GYAE6OF01CEMNU.10.38.D05.1.454.CMB.1.raw
  modified_base (247)..(247): a, c, t, g, unknown or other
  misc_feature (247)..(247): n is a, c, g, or t
  modified_base (540)..(540): a, c, t, g, unknown or other
  misc_feature (540)..(540): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttanaactatgtctcctggtaccagcaccaccaggcaaacgcccccaaatccttgttttgaggtcagtaagcggcctcaggagtccctgatcggttctctgcctcaagtctggcaacacggcctcccgtgaccgtctcgtcgggctccgaggctgaggatgaggctgtattactactgcagcgcattactcgacggacccctaagagggtgtttgggcggcgggactaagggtcgaccgtccgtgggtcacggcccaagggctccgcccccgttcggtccacctcgtccgttccccncccttccccg

SEQ ID NO: 154046 - DNA, 535 bp, Homo sapiens
  misc_feature: GYAE6OF01CDGX2.10.38.D05.1.454.CMB.1.raw
  modified_base (355)..(355): a, c, t, g, unknown or other
  misc_feature (355)..(355): n is a, c, g, or t
  modified_base (529)..(529): a, c, t, g, unknown or other
  misc_feature (529)..(529): n is a, c, g, or t
  modified_base (533)..(534): a, c, t, g, unknown or other
  misc_feature (533)..(534): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaatccttgtttttgaggtcagtaagcggccctcaggagtccctgatcggttctctgcctccaagtctggcaacacggcctccctgaccgtctctgggctccgaggctgagntgaggctgattacactgcagcgcatattcacggcccaagagggtgtttggcggcgggacgtaagggtcgaccgtccgtcgggtcacgcccgaaggcgtcgcccccgtcggtccacctccttcgttccccgccctcctccactactatcgctgacggcggctggacgtacggcgnatgnng

SEQ ID NO: 154047 - DNA, 703 bp, Homo sapiens
  misc_feature: GYAE6OF01DHBNI.10.38.D05.1.454.CMB.1.raw
  modified_base (246)..(246): a, c, t, g, unknown or other
  misc_feature (246)..(246): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgactttgtgcttanaactatgtctctggtaccagccaccaccaggacaaacgcccccaaacttccttgttttcgaggtcagtaagcgcctcgagacgtccctgatcggttctctcgcctcaagtctgacaacgacggcctccctgacccgtctcgtcgggcctccgaggctggaggatggacggtctggtaactttacgtacttcgccgtagccgtactaattaccgtttccgaacccggtacccccgtaaacggtcgggggtttacgttttcgggggaccggggtaccggggtaacgttaaaaccggggtccgggtaaccccggttcccgggttaggggttaccccgtaaccgggtacccccggtaaacggggtcccgttaccccgggtccccccccggtttacgggttaccccttacccggtttccccgtttaccccgggtttcccccccgcccccgttttaccccccg

SEQ ID NO: 154048 - DNA, 567 bp, Homo sapiens
  misc_feature: GYAE6OF01BDVBE.10.38.D05.1.454.CMB.1.raw
  modified_base (514)..(514): a, c, t, g, unknown or other
  misc_feature (514)..(514): n is a, c, g, or t
  modified_base (560)..(560): a, c, t, g, unknown or other
  misc_feature (560)..(560): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgcccccaaactccttgttttgaggtcagtaagcggccctcgaggacgtccctgacttcggttctctgcctccaagtctggcaacgaccggcctccctgaccgtctcgtcgggcctccgaggcctgaggtatggacggtctgtacttactactcgcagccgctatacttcgacggccccaaggtagggttgtttgggcggcgggactaagggtcgacccgtccgtgggtcncggcccgaggcctcggccccctcggtccacttccttccgttccccnccctccc

SEQ ID NO: 154049 - DNA, 537 bp, Homo sapiens
  misc_feature: GYAE6OF01DO3IU.10.38.D05.1.454.CMB.1.raw
  modified_base (246)..(246): a, c, t, g, unknown or other
  misc_feature (246)..(246): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtgttanactatgtctcctggtaccaacaacacccaggcaaacgccccaaactcatgattttgatgtcagtatcggcctnagggtttcatcgcttctctgctcaagtctgcaacacgctcctgaccatctctggctccgngctgaggcgagctgatttatactgcagtctacatatacaacagacagtcctacttctacgttagttccggacgggtaacggaccaaggccgtacgtacccgttccgttaacggtaccacgaccccgtaaggcctaccggcccccgtcggtctaccccg

SEQ ID NO: 154050 - DNA, 556 bp, Homo sapiens
  misc_feature: GYAE6OF01DYFW7.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccgaggctccgagggaggggctggagtgggtctcagttatagaacagatggcatacatattatctgactcgtagacggccgttcaccctctccagacgacactaccaacaacatcttgtattcttcactatcgacaacaatctagagtagtccgaacgaccaccggaccaacttattagttcggtgccgtcggaactagtcgtaacctacgaccttacctaagttaccggtcgggggacccgaggggtaaccccg

SEQ ID NO: 154051 - DNA, 782 bp, Homo sapiens
  misc_feature: GYAE6OF01DF3EA.10.38.D05.1.454.CMB.1.raw
  modified_base (461)..(461): a, c, t, g, unknown or other
  misc_feature (461)..(461): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgtactttgtgacttataactatcgtctccgtggtaccagccaccaccgaggaccaaacgccccctaaacgttccgtttgttttgacggttctaaggtaacgccggtaccctgaggtacgtccctgactcggttctcgtcgtcctacgtaagtccgtggaccaaaccgtccggtccctacccgtcgacccgttctcggtcgggtcctccggaggtcgtacggaggtntggacgtctaggtactttaaccgtcgtcgaccgtaggccgtactacgtttaaccttaccggaacccggtaacccccgtaaagggttaccgggggtttacgggtttaccgggggacccggggttaaccggggtaaccggttaaacgggggttcccgtacccggggttacccggtttacggggtaacccgaaccgggtaacccccgggtaaaccggggttccccgttaccccccggggttaccccccccgttacggggttacccttacccccggtttaccggtttcccccgggtttaccccccccctccccgtttaccccccg

SEQ ID NO: 154052 - DNA, 350 bp, Homo sapiens
  misc_feature: GYAE6OF01DTQLX.10.38.D05.1.454.CMB.1.raw
  modified_base (293)..(293): a, c, t, g, unknown or other
  misc_feature (293)..(293): n is a, c, g, or t
  modified_base (337)..(350): a, c, t, g, unknown or other
  misc_feature (337)..(350): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaaggtgaccgtcctgggtcagcccaaggcctccgccccgtcggtccactctcgttccccacccttcccnccactactatcgctgacggcggctggacgaacggcgcaagtagnnnnnnnnnnnnnn

SEQ ID NO: 154053 - DNA, 607 bp, Homo sapiens
  misc_feature: GYAE6OF01A26ZW.10.38.D05.1.454.CMB.1.raw
tcagcatagtagtgcacgaccggtgctcgatttagtatctgatagttggggtttgcgggggagaggagcccacgcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgaccgtgggccccgccaggcctccgaggggaagggctgggagtgggtctcgtagttattaggaaacagatggacactacattattattctgacttccggtaggaacgggtccggttaccacccttctccaagacacctaccttaccaactaactattcttagtataccttacactatcaccaactaatcctagaagtacgtcggaacgtaccaccggccctaacctttatttagttcggtacggccggtaccgtactaagttcgaacccttaccgccttacgtaaactttccgggccgggggcccctaaacggggg

SEQ ID NO: 154054 - DNA, 536 bp, Homo sapiens
  misc_feature: GYAE6OF01DLUIM.10.38.D05.1.454.CMB.1.raw
  modified_base (227)..(227): a, c, t, g, unknown or other
  misc_feature (227)..(227): n is a, c, g, or t
  modified_base (359)..(359): a, c, t, g, unknown or other
  misc_feature (359)..(359): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagcaccacccaggcaaacgcccccaaatcctttgttttgaggtcagtaagcggcctcagatcctgatcggttctctgcctcaagtctggcaacncggcctcctgaccgtctctgggcctcaggctgaggatgaggctgacttactactgcagcgcatattcgacggccccaagagggttgttcgggcgggcgggtactaagggtcgaccgttccgtgggtcacgcccaaggcctcgcccccttcggtcacttcctcgttccccaccctccc

SEQ ID NO: 154055 - DNA, 621 bp, Homo sapiens
  misc_feature: GYAE6OF01BDPO5.10.38.D05.1.454.CMB.1.raw
  modified_base (325)..(325): a, c, t, g, unknown or other
  misc_feature (325)..(325): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggaaccagcagttgtactttgttgcttaataactatgtctcctggtaccagccaccaccaggcaaacgcccccaaatcctttgttttgagtcagtaacgcgcctnaggtactcctgacttcggtctcgtcgcctacaagtctacggaccaacgacggccctcctcgtacccgtctcgtcgggtctaccaggctaggaggatgaggtctagtacttactacgtgctacgcgtactatactaccgaacggacccccgtaaggtacgggtttggttaccgggacgggtaccgggtaagtaccgggtccggtaccgttcggtacgggtaccaccggtcccggaacggtcctcccggcccccgttcggtaccctaccgttccgtacccgttccccaccccttcccg

SEQ ID NO: 154056 - DNA, 649 bp, Homo sapiens
  misc_feature: GYAE6OF01DJYGR.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcatcagtaacgactacatcgacctcgggccccgccaggcctccgaggggaaggggcgtgggagtgggtctcgagttatagaaacagatggacactactattaattatctgactccggtaggaacgggtccgttcaccctctccgagacgactaccttacccaaactaactattccttgtacttcttaccaactatcgactacaattctagagacgtacgaaccgaccaccgggtccctaaccgtttatttacgttcgggtacgacccggtaccaaccgtagttacccggaaaccctttaaccccggaccctttaaaccttaaacggttttcccggggtaccgggggggtaaccccgaacgggggggtaaacccccgg

SEQ ID NO: 154057 - DNA, 570 bp, Homo sapiens
  misc_feature: GYAE6OF01CD96W.10.38.D05.1.454.CMB.1.raw
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (401)..(401): a, c, t, g, unknown or other
  misc_feature (401)..(401): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcaggcacagggtcctgggcccaggtctaggccctgactcagcctccctccgcgtccgggtctcctggacagtcagtcaccatctcctgcactggaaccagcagtgacttttgtgcttataactatgtctcctgtaccagcaccaccaggcaaacgcccccaaatccttgttttgagtcagtaagcggcctnaggactccctgattcggttctctcgcctcaagtctggcaacncgccctcctgaccgtctctggctcgagctgagatgagntgacttactactgcagccgatattacttcgacggacccctaagtaggggttcgtttagggcgggtacgggacgtaacgggtcgacccggttccgtagggtccgaacgcccgaaggtcctccgtcccccgtacggtcctacgttccctccggttccccaccccgttcccg

SEQ ID NO: 154058 - DNA, 568 bp, Homo sapiens
  misc_feature: GYAE6OF01BPI20.10.38.D05.1.454.CMB.1.raw
  modified_base (234)..(234): a, c, t, g, unknown or other
  misc_feature (234)..(234): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtnactttgttgcttataactatgtctcctggtaccagcaccacccaggccaaacgcccccaaactccttgttttgaggtcagtaagcggccctcaggagtccctgactcggttctctgcctccaagtctggcaacgacggcctccctgaccgtctcgtgggcctccgaggctgaggatgaggctgacttactactgcagcgctatacttcgacggaccccaaggtaggggttgtttgggcgggtcgggactaagggtcgaccgttccgtcgggtcacggtacccaaggcctccgcccccgtcggtccaccttccgtccgttccccgcccttccccg

SEQ ID NO: 154059 - DNA, 747 bp, Homo sapiens
  misc_feature: GYAE6OF01DYXEI.10.38.D05.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtccaccatctcctgcactggaaccngcagtgacttttgtgcttataactatgtctccgtggtaccagccaccacccaggacaaacgccccctaaacttccttgtttgaggtcagtagccggcctcgaggtacgtcctgacgttcggttctctcgcctacaagtctcggacaaccgccgcctcccgtcgtaccgtctcgtcgggcctcccgaggtccgtaggacggtatcggaggtccttagtaacttttaccgtaacgttcggaccgtacggtacccgtactaacgtttaccttccggaacccgggtacccccttaaacgggttacggggggtttcggttttaccgggggacccggggttaccgggggtaaccgtttaaacgggggttcccggtaaacccccgggttccgggttacgggggtaacccgtacccggggtaccccgtaaacggggtccccttacccgggtccccccccgtttacggggtacccttacccgtttcccggtttcccccggttcccccgtccccccgtttacccccg

SEQ ID NO: 154060 - DNA, 524 bp, Homo sapiens
  misc_feature: GYAE6OF01C0B97.10.38.D05.1.454.CMB.1.raw
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
  modified_base (406)..(406): a, c, t, g, unknown or other
  misc_feature (406)..(406): n is a, c, g, or t
  modified_base (515)..(515): a, c, t, g, unknown or other
  misc_feature (515)..(515): n is a, c, g, or t
tcagcatagtagtgcacgaccggtgctcgatttagtatctgatagttgggtttggggggggtctcaggaggcagcgctctcgggacgtcaccaccatggcctgggctctgctcctcctcacctcctcactcaggcacgaggtcctgggcccagtctgccctgactcagcctccctccgcgtccgggtctcctggacagtcagtcaccatcctcctgcactggaaccagcagtgtacttttgtgactttataactatcgtctcctcggtaccagccacccaccaggacaaacgccccaacttctttgttttcgagtcagtacgcgcctgagacgtccngactcgtcnctcgctcagtcngacacgcgcctccncgtaccgtcgtcgtcggctcgagtctgacgtagngacgtctagtactactctgcagcatatctcgacgaccgagtggtgtcggcggtcgacgtagcgaccgtcgcgtcacgccgagctcccgccctgctacgtctccgtcccncctcgtacc

SEQ ID NO: 154061 - DNA, 798 bp, Homo sapiens
  misc_feature: GYAE6OF01AI6Y0.10.38.D05.1.454.CMB.1.raw
  modified_base (198)..(198): a, c, t, g, unknown or other
  misc_feature (198)..(198): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacngtcagtcaccatctcctgcactggaaccagcagtgtacttttgtgcttaataactatcgtctccgtggtaccagccaccacccgaggaccaaaccggaccccccaaacttccgttttggtttttacggacggttacaaggtaacggccggtccctgaacgggtacgtcccgtaggtacgtttcggttctcgtccggtcccttaccgaagttccgtacggaccaaacccggtaccggtccccttcccgtacggtaccccgttccgttcggtcggggtcccttaccgacgggtccgttaggaacgggtacgttacgggaacgggtcttacgggttaacttttacccgtacggttacggaccgtacggtacccgtactaagttaccgttaccggaacccgggtaacccccgtaagggttacgggggtttcgggtttaccggggaccggggtacggggtaaccttaacggggtaccgtaccccgggttccggtacgggtacccgacggtaccccggaaacgggtccccttaccccgggtacccccgtttacggtacccttacccggttcccttccccggtttaccccgcccccgtttacccccg

SEQ ID NO: 154062 - DNA, 341 bp, Homo sapiens
  misc_feature: GYAE6OF01CD44J.10.38.D05.1.454.CMB.1.raw
  modified_base (324)..(324): a, c, t, g, unknown or other
  misc_feature (324)..(324): n is a, c, g, or t
  modified_base (330)..(341): a, c, t, g, unknown or other
  misc_feature (330)..(341): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcacggcccaagtagggtgttggcggcgggactaaggtgaccgtcgtgggtcagcccgaaggctccgcccctcggtcactctcgttcccaccctcctccactactatgctggaggcggcgtggaccgaacggcncatagnnnnnnnnnnnn

SEQ ID NO: 154063 - DNA, 530 bp, Homo sapiens
  misc_feature: GYAE6OF01ADUTU.10.38.D05.1.454.CMB.1.raw
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
  modified_base (517)..(517): a, c, t, g, unknown or other
  misc_feature (517)..(517): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggtcagcatcagtaacgactacatgacctgggccccgccaggctccgagggaggggctggagtgggtctcagttattagaaacagatggacaatacattattattctagactccgtaggaacgggtccggttcacccctctcccagacgacaccttaccaaacaacattcttagtacttctcacatgacacaatctagagagtccgaacgaccacggccctactatattgncgtcanatgactagctacattcgngggccagggaccg

SEQ ID NO: 154064 - DNA, 735 bp, Homo sapiens
  misc_feature: GYAE6OF01DZNJR.10.38.D05.1.454.CMB.1.raw
  modified_base (277)..(277): a, c, t, g, unknown or other
  misc_feature (277)..(277): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggaccaaacgccccaaactccttgttttgagtcagtaacgcggcctnaggacgtcctgacttcggttctctcgccctcgaagtctggaccaacgccggtccctcccgtgacccgttctcgtcgggcctacgaggtctaggaggtatggacggtctaggtaactttaccgtacgtcgacgtacgtccgactaattacgttaccggaaccggtacccccgtaaacgggttacggggtttcggtttacggggaccggggtaccgggtaaaccggttaacggggtccggtaaccccggtccggttacggggtacccgaccggtaccccgaacgggtcccgtccccggtccccccgttacggtcccgtaccgtttcccgttacccggtttccccccgtccccgttaccccgttacccctaaccgttaccgtacgttccggtaccgtacgggtaccggtcccggggtccgtacgggaacccggtacgggtaccgaccgtaaggtcgcgtcg

SEQ ID NO: 154065 - DNA, 464 bp, Homo sapiens
  misc_feature: GYAE6OF01BW4LR.10.38.D05.1.454.CMB.1.raw
  modified_base (450)..(464): a, c, t, g, unknown or other
  misc_feature (450)..(464): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgttttgaggtcagtaagcggccctcaggagtccctgatcggttctctgcctccaagtctggcaacacggcctccctgaccgtctctgggctccaggctgaggatgaggctgattacactgcagcgcatattcacggccccaagtagggtgttgggcggcgggactaaggtcgaccgtcgtgggtcacggcccaaggctcgccccctggtccactctcgttccccgccctcctccactactatcgctgagcgggctcggcaggcgcatagnnnnnnnnnnnnnnn

SEQ ID NO: 154066 - DNA, 692 bp, Homo sapiens
  misc_feature: GYAE6OF01DD2AI.10.38.D05.1.454.CMB.1.raw
  modified_base (477)..(477): a, c, t, g, unknown or other
  misc_feature (477)..(477): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgacgactctcctgtcgcagcctcgtgggttcagcatcagtaacgactacatcgaccgtcgggccccgccacggcctaccggaggggaaggggctgggaggtggtctcgtagttatagaaacagagtggactaactactaattaattagttctacgtaccttccggtaggaacgggtcccggttcctaaccccgtctaccgaagaacgtaacctacccttaacccaaaactaacgtntttaccgttagttactcctttacaaccttaattcgaacctaactaattccgaggtaaccgtacggtaccgaaccggtaaccacccgggttacccaacctttaagtttacgtacggttcggacccgtacggtaacctagttaccggtaacccgtaaccgttaccctaagtaaacgtttccggggtacccgggggccgtaacggggggtaacccccg

SEQ ID NO: 154067 - DNA, 658 bp, Homo sapiens
  misc_feature: GYAE6OF01EAD9Q.10.38.D05.1.454.CMB.1.raw
  modified_base (245)..(245): a, c, t, g, unknown or other
  misc_feature (245)..(245): n is a, c, g, or t
  modified_base (432)..(432): a, c, t, g, unknown or other
  misc_feature (432)..(432): n is a, c, g, or t
tcagcatagtagtgcacgaccggtgctcgatttagtatctgatagttgggtttggggggggtctcagggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctcctgcactggaaccagcagtgactttgtncttataactatgtctctggtacagccaccaccagacaaacgccccctaaattcctttgttttgacgtcagtaacgccggccctcaggacgtccctgtacttcggttctcgtcgcctacaagtctacgacaacgaccggccctcccgcggtacccgtctcgtcgggcctaccgaggtcctaggaggtntggagcttaggtaactttactacgtgcctagccgatattacgtacgaccggacccctaaggtggggttcgttcggggacgggtaccgggtaacgtaacgggtccgtacccggttccggtcgggttaccgaccggtaccccggaagggtccccgtaccccggtccccccggttcgggttacccacccgtttcccggttacccgttccccccggtccccttacccccg

SEQ ID NO: 154068 - DNA, 710 bp, Homo sapiens
  misc_feature: GYAE6OF01D7UF8.10.38.D05.1.454.CMB.1.raw
  modified_base (696)..(696): a, c, t, g, unknown or other
  misc_feature (696)..(696): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctcctgcacgtggaaccagcagtgtacttttgtgactttaataactatcgtctccgtggtaccagccaaccacccaggaccaaacgcccccctaaacttccttttggttttcgaggtctaaggtaacggccggtccctgaggtctcccgtgacttcggttctctcgcctacagtcgcggacaacgccggtccctcccgtcggtacccgttctcgtcgggtcctccgagggtcctgggtaaggagttaggacggtcctaggtaacctttaccgtacgttggacctaggccgtacttaagtacgttaccgaccggtaacccccgtaaggtcggggtttcggttacggggcgggtaccggggtaaacgttacgggtccgtacccggttaccggttggggtacccgacgggtaccccgaaacgggttcccgtacccggtccccccggtcggttacctacccgtttcccgttcccgtttaccccccnccccgttacccccg

SEQ ID NO: 154069 - DNA, 779 bp, Homo sapiens
  misc_feature: GYAE6OF01AI6OX.10.38.D05.1.454.CMB.1.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacttttgtgcttanaactatgtctctggtaccagccaccaccaggccaaacgcccccaaacttcctttgttttcgaggtcagtaacgcgtccctcgaggacgtccctgacgttcggttctctcgtcctacctaagtccgtaggacctaacgaccggtcccttcccgtcgaccccgttctaccggttcgggcctaccgacgggtccttagggaacgggtagttcggaacgggttccttaggtaactttaaccgtacgttcggaccgtacggccgtaacgtactttacgtttacccgaaccgggtaccccccgtaaacgggttcgggggtttacgggttttaccggggacccgggggttaaccggggtaaaccgttaaaccgggggttaccggtaaccccgggtttcccggttagggggttaaccccgacgggtaacccccggtaaacggggtccccgtttaccccggtcccccccggttttaccggggtacccttaacccgtttccccgtttaccccggtttaaccccccgtccccctttacccccg

SEQ ID NO: 154070 - DNA, 688 bp, Homo sapiens
  misc_feature: GYAE6OF01CXY9Q.10.38.D05.1.454.CMB.1.raw
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (321)..(321): a, c, t, g, unknown or other
  misc_feature (321)..(321): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgactttgtncttaanaactatgtctcctggtaccagcaccaccaggacaaacgccccaaactccttgttttgagtcagtaagcgcctnagacgtcctgattcggttctctcgcctacaagtctaggacaacgacggccctccctgacccgtctcgtgggcctccgaggtctggaggatggaggtctagtaattacctacgtgcgagccgactaagttacttccgaaccgggacccccctaaagggtacggggtttacggtttcggggaccggggtaccggggtaaccgttaaacggggtccggtaaccccgggttcccggttacgggggttacccaaccgggacccccggaaacgggtcccccgttacccgggtcccccccccgttacggggttacccctaacccggtttcccggtttccccggttttcccccccggcccccttttaccccccgg

SEQ ID NO: 154071 - DNA, 621 bp, Homo sapiens
  misc_feature: GYAE6OF01A16V8.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagccaccacccaggcaaacgcccccaaactcctttgttttgaggtcagtaagcggcctcaggagtccctgatcggttctctgcctccaagtctggcaacgacggcctccctgaccgtctcgtcgggctccgaggctgaggatggaggctgaactttactacgtgcagcgactatacttcgaacggcccccaaagtaggggttgtttgggccgggcggggtacttaaagggtcggtaacccggttccgttacggggtcctacggaccccgaaaggggtcccttacccggccccccccgtttcgggtaccctaacccgttcccgttaccgggtttcccccccaccccgtttacccccg

SEQ ID NO: 154072 - DNA, 164 bp, Homo sapiens
  misc_feature: GYAE6OF01D27VU.10.38.D05.1.454.CMB.1.raw
  modified_base (164)..(164): a, c, t, g, unknown or other
  misc_feature (164)..(164): n is a, c, g, or t
tcagcatagtagtgcacgaccggtgctcgatttagtatctgatagttgggtttgggggtgtggtggtctccactcccgccttgacgggctgctatctgccccctggtcactctgttcccaccctcctccactactatgctgagcgggctggcaaggcgcatagn

SEQ ID NO: 154073 - DNA, 631 bp, Homo sapiens
  misc_feature: GYAE6OF01B37LV.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctctggtaccagccaccaccaggaccaaacgcccccaactctttgttttgaggtcagtacgcgcctgaggactcctgacgttcggttctctcgcctacaagtctggaccaacgaccggtccctcccgtcgaccgtctcgtcgggcctccgaggcgtaggaggatggacggtctgtacttactctgcagcgcattacgttcgacggaccccaaggtcgggttcggtttacgggcggtacgggtacgtaacgggtccggtacccggttccggtacgggtaccgacggtaccccgtaacgggcccgttcccgggtcccccgttaccgggttccctaccgttcccgtttccccggttcccccctaccccgttacccccg

SEQ ID NO: 154074 - DNA, 533 bp, Homo sapiens
  misc_feature: GYAE6OF01CGDIN.10.38.D05.1.454.CMB.1.raw
  modified_base (280)..(280): a, c, t, g, unknown or other
  misc_feature (280)..(280): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagccctccctccgcgtccgggtctcctggacagtcagtcaccatctcctgcactggaaccagcagtgactttgttgcttataactatgtctcctggtaccagcaccacccaggcaaacgcccccaaactccttgttttgaggttcagtaagcggccctnaggagtccctgatcggttctctgcctccaagtctggccaacaccggcctccctgacccgtctcgtgggctccgaggctgaggatgaggctgattactactgcagcgacatatcacgacccaagtaggtgttggcggcggacgtaggtcgaccgtccgtggtcacgccaagctccgccctcgtcnctctcttcccnccctcctccactactatcgctggacggccgggcgtggaccgaaggccganactagcng

SEQ ID NO: 154075 - DNA, 570 bp, Homo sapiens
  misc_feature: GYAE6OF01A0UUQ.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggtttcgtgtagctattacaaaggtgtcactgtgaggttcaactggtggagactggaggaggctggatccagcctggggggtccctgagactctcctgtgcagcctctgggttcagcatcagtaacgactacatgacctgggccccgccaggctccgaggggaggggctgggagtgggtctcgagttagttgaaacagatggcactacatattattctgtactccggtgaacgggccggttaccacccgtctaccgagcgacaccttccaaacactacttcttagtattcttacacatgcactaatcctaggacgtacgtcgaaccgacacggccctaaccttattacgttcaccggtcggccgaactagtcgaccctaacggccttactaactttcggcggggcccgtaagggaccccg

SEQ ID NO: 154076 - DNA, 590 bp, Homo sapiens
  misc_feature: GYAE6OF01EX6FU.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctgcctccgtgtctgggtctcctggacagtcgatcaccatctcctgcaatggaagcgaaagtgactatttggttacttttaaattttgtcttcttggtaccaacagagccagacaaacgaccccctaaaattactctatttctgctgtcagtaatccggcctcgtagggtttctagtcgtcttctctgctcaagtctgcaacgcggcctcctgacctatctcgtgggcctccaggtctaggacggacgaggtctagtatttagttatttcgactagtcctacaataactaaaccaaaactacccgtaaagttctttagaattacggtacgggacggaacgggaacctaaacgtcgtacccgttccttacgtacacgacccgaaggcctccggacccctcggtcctaccgttcgtcccgg

SEQ ID NO: 154077 - DNA, 473 bp, Homo sapiens
  misc_feature: GYAE6OF01A3G2W.10.38.D05.1.454.CMB.1.raw
  modified_base (460)..(473): a, c, t, g, unknown or other
  misc_feature (460)..(473): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacaccggcctccctgaccgtctctgggctccaggctgaggatgaggctgattacactgcagcgcatattcacggccccaagaggggttgtttgggcggcgggaactaaggtcgacccgtcgtgggtcaggcccaaggcctcgccccctggtccacgtctcgttccccgcccttcctccactactatcgctgacggcgggcgtggcgaggcgcatgnnnnnnnnnnnnnn

SEQ ID NO: 154078 - DNA, 627 bp, Homo sapiens
  misc_feature: GYAE6OF01ADLY3.10.38.D05.1.454.CMB.1.raw
  modified_base (388)..(388): a, c, t, g, unknown or other
  misc_feature (388)..(388): n is a, c, g, or t
  modified_base (457)..(457): a, c, t, g, unknown or other
  misc_feature (457)..(457): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgaggccgtggggggtccctgagactctcctgtgcagcctctgggttcagcatcagtaacgactacagtcgacccgtcggggccccgccgaggccgtcccggaaggggaacggggtctgggaggtcgggtctcgtagttatgaaacagatggcaactacattattnttcgtagaccgtcggtcgaacgggtcccgttaccacccgtcaccgagacgtacctacctaccaacactnttcgttgtactccttacactatcaccaatactccgtagaacgtacgtaccgacgaacccaccggtaccctaacttgttaacgtcgacggccgaccggaactagtcccggtaaacccttaccggtaccttaccgtaaaggtttcccgggtcggggaacccgtaaccggggg

SEQ ID NO: 154079 - DNA, 689 bp, Homo sapiens
  misc_feature: GYAE6OF01C1Z71.10.38.D05.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccaccatctcctgcactggaaccngcagtgactttgtncttataactatgtctcctggtaccagccaccaccaggacaaacgccccctaaactccgtttgttttgaggtcagtaacgccggtccctcgacggacgtccctgacttccggttctctcgccctctaagtctggacaaccgaccggtccctccgtcgacccgtctccgtcgggtcctccgaggctaggaggatggaggcttaggtaacttaccgtacgtcgcgagccgactaattacttacgaaccggacccctaacggtacggggtttcggtttcgggaccgggtacggggtacgttaaacggggtccggtaccccggttccggttacggggtacccgtaaccggaccccggtaaacgggtccccgttacccggtcccccccgttacggggttaccccaaccgtttcccgtttaccccggttcccccctaacccccgttcccccg

SEQ ID NO: 154080 - DNA, 542 bp, Homo sapiens
  misc_feature: GYAE6OF01EQEN3.10.38.D05.1.454.CMB.1.raw
  modified_base (335)..(335): a, c, t, g, unknown or other
  misc_feature (335)..(335): n is a, c, g, or t
  modified_base (446)..(446): a, c, t, g, unknown or other
  misc_feature (446)..(446): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacttttgttgcttataactatgtctcctggtaccagcaccacccaggcaaacgcccccaaactccttgttttgagtcagtaagcggcctcaggagtcctgntcggttctctgcctcaagtctggcaacacggcctcctgaccgtctctgggcctccgaggctgaggactgacggctgacttactactgcagcgcatattcacggccccaagngggttgttggcggtcgggactaagggtcaccgtcgtggtcgagcccgaaggcctccgcccccgtcggtccacgttctccgttccccgcccttcccg

SEQ ID NO: 154081 - DNA, 652 bp, Homo sapiens
  misc_feature: GYAE6OF01DGYFQ.10.38.D05.1.454.CMB.1.raw
  modified_base (214)..(214): a, c, t, g, unknown or other
  misc_feature (214)..(214): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcngcactggaaccagcagtgtactttgtgctttaataactatcgtctcctggtaccagccaccaccaggccaaaaccgcccctaaacttcctttgttttgacgtacagtaacgccggtccctacgagtacgtcccctgtacttccggttctcgtcgtcctactaagtctcggacaaccgaccggtcctcccgtgtacccgtctcgtcgggcctccgaggtctaggagagtggacgtctagtaacttacctacgtcgacgagctctaatacgtcgaaccggtaccccaaggtcgggtttcgttacgggacgggtacggtacgtaacggttcgtaccggtcgttacgggtaccgacggtaccccgaaggtcccgtccccggtacccccgttgggtacccctacccgttccgttccccggttcccccaacccccgtttccccg

SEQ ID NO: 154082 - DNA, 562 bp, Homo sapiens
  misc_feature: GYAE6OF01A28SU.10.38.D05.1.454.CMB.1.raw
  modified_base (227)..(227): a, c, t, g, unknown or other
  misc_feature (227)..(227): n is a, c, g, or t
  modified_base (490)..(490): a, c, t, g, unknown or other
  misc_feature (490)..(490): n is a, c, g, or t
  modified_base (499)..(499): a, c, t, g, unknown or other
  misc_feature (499)..(499): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctctggtaccagcaccaccaggcaaacgcccccaaactcctttgttttgaggtcagtaagcgcctcaggactcctgatcggttctctcgcctccaagtctggacaacaccggcctccctgacccgtctcgtgggcctccgaggctggaggatgaggctgtattacactgcagcgcatacttcgacggccccaagtgggttgttcgggcggtcgggactaagggtcgacccgttcgnggggtaccncggacccgaggccctccgcccccgttcggtaccaccttccgtccgttcccccacccgttcccc

SEQ ID NO: 154083 - DNA, 536 bp, Homo sapiens
  misc_feature: GYAE6OF01BRKFL.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctgactccgtgtctgggtctcctggacagtcgatcactatctcctgcactggcaccagcagtgacagtaggtgcttataactatgtctcctggtaccaacaacacccaggccacggcccccagactcatcatttctgatgtcagtgatccggtccctttgggtattttctaattccgtctttctctcgtcctccaagtctggaccaacgacggtcttccctgaccctatccgtcccgggtctccgacgcgtgacggacggagtctctattactactgcagctatattataccaccgacgggcactcgtcgtagtatcgttcggcggtacgggccgtggcgtcgacccgtctacgtcgcgtacccg

SEQ ID NO: 154084 - DNA, 624 bp, Homo sapiens
  misc_feature: GYAE6OF01EEDJA.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccagccgtggggggtccctgagactctcctgtgcagcctctgggttcagcatcagtaacgactacatcgacctcggggccccgcgaggccgtccgaggggaaggggctgggagtgggtctcgagttattagaaacagatggcactacattattatctgacgtcgtggaacgggtccggttccaccctcgtaccagtacgacctaccttaccaaactaactattaccttagtaacttccgttacacagtttcgaacctaacaagttccaggtaaggacggttaccgaaaccgacccaaccgggacccctaacttaagtttaacttggtaccgccggaaccaatagtcgtaaacctacccggacttaccaaaggtttccggtacgggggcccagggggtaaccccg

SEQ ID NO: 154085 - DNA, 607 bp, Homo sapiens
  misc_feature: GYAE6OF01EOMD4.10.38.D05.1.454.CMB.1.raw
  modified_base (598)..(598): a, c, t, g, unknown or other
  misc_feature (598)..(598): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggaccaaacgcccccaaacttcctttgttttgaggtcagtaacgccggccctcgagacgtccctgacttcggttctctcgcctccaagtctggaccaacgacggccctcccgtcgtacccgtctcgtcgggcctccgaggctggaggatgaggtctgacttactactgccagccgctattacttcgaccggtaccccaagtaggggttggtttcgggcgggaccgggtacgtaacgggtcggacccgttccgtgggtccgacggacccgaaggccctaccggccccccttcgggtcctaccgttccttcccgttcccccncccttcccc

SEQ ID NO: 154086 - DNA, 678 bp, Homo sapiens
  misc_feature: GYAE6OF01EJRUS.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgaccgtcgggccccgccgaggcctccgaggggaacggggctgggaggtgggtctcgagttatagaaacagatggctactacataattattctagtacgtccggtaggaaacgggtcccggtttccaacccctctaccgaagaacgaacctaacccgttacccaaactaacctattcctttacgtattcccttacactagtcgtaccaactaatccgtaggaacgtacggttaccggaaaccgacctaacccgggtacccctaaccgttaagtttagtttacgggtaccggtacccgggtaccgtaacctacggttaccggaaacccttaacccgtacccttacgtaaacgtttcccgggtacggggggtaccccgagggggtaaccccgg

SEQ ID NO: 154087 - DNA, 572 bp, Homo sapiens
  misc_feature: GYAE6OF01B7JCP.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggcctccgaggggaaggggctgggagtgggtctcagttattagaaaacagatggacaatacatattatctgactccgtagacgggccgttcaccctctccagagactacttaccaaacaacacttcttgtacttcttcactatcgacacaactctaggagtacgtcgaacgacaccgggacccaccgttaatttacttcgtagccggacgaacacgttcgaacctaccgacttacaaagtttccgacgggggcccaggggggtaacccg

SEQ ID NO: 154088 - DNA, 534 bp, Homo sapiens
  misc_feature: GYAE6OF01D8WSC.10.38.D05.1.454.CMB.1.raw
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (437)..(437): a, c, t, g, unknown or other
  misc_feature (437)..(437): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccaccagcaaacgccccctaatcctttgttttgaggtcagtagcgcctnagctcctgatcgtctctgcctcagtcngcaacncgcctcctgaccgtctcgtcgggctccgaggctgagatggagctgtacttactatgcagcgactatactcgacggaccccaagngggttgttcgggcggcggtactaaggcgaccgtcgtgggccacggccaggtccctacgcccccgtaggtccacgtccttccgttccccaccgttccc

SEQ ID NO: 154089 - DNA, 640 bp, Homo sapiens
  misc_feature: GYAE6OF01DUC1M.10.38.D05.1.454.CMB.1.raw
  modified_base (440)..(440): a, c, t, g, unknown or other
  misc_feature (440)..(440): n is a, c, g, or t
tcagcatagtagtgcacgaccggtgctcgatttagtatctgatagttgggttttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcaagtaacgactacatcgacctgggccccgccgaggcctccggagggaaggggctgggagtggtctcagttatagaaacagatcggactaactacatattatctgactcggtggaacgggtccgttacaccctctaccagtacgacctaccttacccaaacaactnttccgttagtactccttcaactagtcgaccaactaatccgtaggaacgtacggttaccgaaaccgacccaaccggtaccctaaccgtttaagtttacgttcggtcgacccggtaccgtaagtacgttacggaaacccttacgacccgtttaactaaacgtttcccgggtacggggggacccctaaggggggtaacccccg

SEQ ID NO: 154090 - DNA, 574 bp, Homo sapiens
  misc_feature: GYAE6OF01CXDST.10.38.D05.1.454.CMB.1.raw
  modified_base (543)..(543): a, c, t, g, unknown or other
  misc_feature (543)..(543): n is a, c, g, or t
  modified_base (546)..(551): a, c, t, g, unknown or other
  misc_feature (546)..(551): n is a, c, g, or t
  modified_base (553)..(574): a, c, t, g, unknown or other
  misc_feature (553)..(574): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccaccaggcaaacgcccccaaatcttgtttgagtcagtagcggcctcgaggacgtcctgattcggttctctcgcctaccaagtctggaccaacgaccggccctcccgtgaccgtctcgtcgggcctccgaggtctaggaggactggaggctgaatttacacgtgcagcgactattacttccgacggaccccaaggtagggttggttacgggcgggacgggtaacgtaagggtcgaccgttcggtcgggtcaacggcccgaaggtcccgtccgcccccgttggtcctaccgttccgtcccgttcccccgtacccctcccgtacctaaccttactacgttcggtacggacggtccgggcgtcgggaccgaacgggccgtacgtaagagcgancgnnnnnngnnnnnnnnnnnnnnnnnnnnnn

SEQ ID NO: 154091 - DNA, 610 bp, Homo sapiens
  misc_feature: GYAE6OF01B6C3W.10.38.D05.1.454.CMB.1.raw
  modified_base (419)..(419): a, c, t, g, unknown or other
  misc_feature (419)..(419): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctcgtgggttcagcatcagtaacgactacatcgacctgggccccgccaggctccgaggggagggcgtgggagtgggtctcgtagttagttagaaacagtagtggacaacgtacatatttatcgtagtacctccggtggaacgggtccggttaccacccttcnccaagacgacctaccgttacccaaactaactacttcgttagtaactccttacactatcgacaactaatcgtaggacgtacgtaccgaccgactaccggaccctaacttatttacgtcggtacggaccgtaccgactagtcgaacttacccgactacgtaacgttccgggtcggggacccgagggaccccgg

SEQ ID NO: 154092 - DNA, 694 bp, Homo sapiens
  misc_feature: GYAE6OF01DJG6M.10.38.D05.1.454.CMB.1.raw
  modified_base (248)..(248): a, c, t, g, unknown or other
  misc_feature (248)..(248): n is a, c, g, or t
tcagcatagtagtgcacgaccggtgctcgatttagtatctgatagttgggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttanaactatgtctcctggtaccagcaccaccaggacaaacgccccctaatcctttgttttgaggtcagtaacgcggcctcgaggacgtcctgactcggttctctcgcctcaagtctggacaacgccggtccctcccgtgtaccgtctcgtcgggtcctccgaggtcgtaggacggagtggacggtcttaggtactttacgtacgtcgcgtacgccgtactaacgttacgttaccgaaccggtaccccctaaagggtcgggggtttacggtttcgggggaccgggtacggggtaaccgttaacgggtacccggtaaccgggttcccggttaggggtacccgtaaaccgggtaccccgaaacggggttccccgttacccgggtcccccccggttacggggttcccttacccggttcccgtttaccccggttccccctacccccgttacccc

SEQ ID NO: 154093 - DNA, 323 bp, Homo sapiens
  misc_feature: GYAE6OF01EH7DD.10.38.D05.1.454.CMB.1.raw
  modified_base (319)..(323): a, c, t, g, unknown or other
  misc_feature (319)..(323): n is a, c, g, or t
tcagcatagtagtgcacgaccggtgctcgatttagtatctgatagttgggtttgggaacctatgaacattctgtaggggccactgtcttctccacggtgctccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctggtcactctgttcccgccctcctccactactatgctgagcgggctggcaaggcgcatagnnnnn

SEQ ID NO: 154094 - DNA, 546 bp, Homo sapiens
  misc_feature: GYAE6OF01A0VGB.10.38.D05.1.454.CMB.1.raw
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagcatagtagtgcacgaccggtgctcgatttagtatctgatagttgggttttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatcgacctgggccccgccaggctccgaggggaaggggctggagtgggtctcgagttatgaaacagatggcactacatattattctgactccgtgaacgggtccgttcaccctctccagacgacctacttacccaaacaactattcttgtacttccttccaactatcgactaacaattcctaggacgtacgtcgacgacaccggaccaacctnttatgngcgcanatcgacctcgctacaacttcgcgggccaggggaccg

SEQ ID NO: 154095 - DNA, 532 bp, Homo sapiens
  misc_feature: GYAE6OF01EKHU1.10.38.D05.1.454.CMB.1.raw
  modified_base (245)..(245): a, c, t, g, unknown or other
  misc_feature (245)..(245): n is a, c, g, or t
  modified_base (432)..(432): a, c, t, g, unknown or other
  misc_feature (432)..(432): n is a, c, g, or t
tcagcatagtagtgcacgaccggtgctcgatttagtatctgatagttgggtttggggggggtctcaggaggcagcgctctcaggacgtcaccaccatggcctgggctctgctccctcctcaccctcctcactcagggcacagggtcctgggcccagtctgccctgactcagcctccctccgcgtccggtctcctggacagtcagtcacatctctgcactggaaccagcagtgacgttggtgttanaactatgtctcctggtaccaacaacaccaggcaaagccccaaactcatgattttgatgtcagtaatccggccttcgaggggtttctaatcgtcttctctggctccaagtctggcaacacggcctccctgaccatctctgggcctccaggctgaggacgaggctgtaattattactgcagctacatanaccaacagacagtctacttcgtgtacgttcgggacggagggtaccaagtcgtcggaccgtcgtagcacgcccgtaaggcctacgcccctcggtcctaccg

SEQ ID NO: 154096 - DNA, 537 bp, Homo sapiens
  misc_feature: GYAE6OF01BHWXE.10.38.D05.1.454.CMB.1.raw
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggccaaacgcccccaaactccttgttttgaggtcagtagcggcctnaggagtccctgatcggttctctgcctcaagtctggcaacncggcctccctgacccgtctcgtgggcctccgaggtcctgaggatggaggctggattactactgcagcgcatattcacgcccaagtgggtgttggcggacgggacgtaaggcgtacccgtcgtgggtcgacgcccgaggcctcgccccctggtccactctcgttcccgccctcccg

SEQ ID NO: 154097 - DNA, 610 bp, Homo sapiens
  misc_feature: GYAE6OF01CLPBU.10.38.D05.1.454.CMB.1.raw
  modified_base (250)..(250): a, c, t, g, unknown or other
  misc_feature (250)..(250): n is a, c, g, or t
  modified_base (324)..(324): a, c, t, g, unknown or other
  misc_feature (324)..(324): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgtacttttgtgctttaanaactatgtctcctggtaccagcaccaccaggcaaacgccccaaactccttgttttgagtcagtaacgcggcctnaggactccctgatcggttctctgcctcaagtctggacaacgacggcctccctgacccgtntcgngggtcctccgaggctaggaggatggaggtctgtacttactactgccagcgactatacttcgaaccggaccccaacggtagggttcggtttcgggccgggtacggggtaaccgtaagggttccggaacccgttccggtagggtccgacggacccgaaacgggtcctacccggtccccccgttacggtccaccgttcccttccgttcccccaccccgttacccc

SEQ ID NO: 154098 - DNA, 904 bp, Homo sapiens
  misc_feature: GYAE6OF01AQDEP.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacagggtcctgggcccagtctgccctgactcagcctccctccgcgtccggtctcctggacagtcagtcaccatctcctgcactggaaccagcagtgactttgttgcttataactatgtctcctggtaccagccaccacccaggaccaaacgcccccctaaacttcccgttttgtttttacggaggttaccaaggttaaacggccggtcccctacgaacgggtacgttccccgtggtacgtttccgggtttccttaccgtcggtccccttaccgtaaacggttccgttacgggaccctaaaccggtacccggtcccctttaccccgtacgggtaacccccggtttcccgttcccggttcgggggtacccttaccccggtaacggggtcccgtttacggggaaacggggtacgttacgggaaccggggttaccgttacggttaacgttttaacccgttaccggttacgggtacccgaacgggtacccggtaacctaacgtttaaccgtttacccgggaacccggtaccccccgtaaacgggttacggggggtttaccggttttacgggggaccggggttaaccggggtaaccggttaacggggttccggtaaaccccgggttcccgggttacgggggttaccccgaaccgggtacccccggtaaacggggtccccgttcccccgggtaccccccccggtttcgggttaccccgtaacccgtttccccggttaccccggttttcccccccggtccccctttaaccccccgg

SEQ ID NO: 154099 - DNA, 633 bp, Homo sapiens
  misc_feature: GYAE6OF01DS54A.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcggaccgtcggggccccgccgacgggcctaccggaagggggaaggggccgtagggaggtgggtctacgtagttattagaaaacagatggactactaactattattattcgtagacctcggtaggacgggtcccgttcaccctctccaagacgacctaccttaccaaaactactattcttacgtacttcttacactatcgactaagaacttcgtaacgagtacgtaccggaaccgtaaccgaccggtaccctaaccgtttatttacgtaggtccaccggtccgtaactaaggtccgaacttaccgcctaactaacggttccggacggggtcccgaaggggtacccg

SEQ ID NO: 154100 - DNA, 724 bp, Homo sapiens
  misc_feature: GYAE6OF01CFQ6L.10.38.D05.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (249)..(249): a, c, t, g, unknown or other
  misc_feature (249)..(249): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttcctgttgctattcaagagtnccatgngtagtacagtggngangnggaggngngngactcgcgtcgggtcgggtccagacgtctctcgtgtgcnctcctcggttggtcagctatacaagtaacactcagtccgccggtccggcccacgacggcccgtacggggaaggggacggggtgtaggggtcggttcgggtctagttaaggttttaagaacgaaaacgtggtacgtacgacctaacctaatttaattacttattcgtaccggtaccgtcggtaacgggtaccgggtccccttaccctacccttacgaccgaagaccgtaaccttaccctaaccaaaactaccttactttacgttacttactttacctaacgaacttacgtaccaactaacgttaacctaggtaacgtaacgggtaccggtaaccgaacccgtaccgaacccgtacccttaactttacgtttacgaggttaccgggaaccgtaaccggtattaaccggttaccgtaaccgttacccgtactttaaccggtaccggtttaccggggccggggaccggtaaacccgggg

SEQ ID NO: 154101 - DNA, 702 bp, Homo sapiens
  misc_feature: GYAE6OF01BIOAL.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctccgtcgtacagaccaccaccgaggacaaaccgaccccctaaacttcctttgttttgacggtcaagtaacgccggtcctacgaggtactccgtgtacgttcggtctcgtcgcctacagtcgtacggaccaacgtaccggcccttccgtacgtaccgttcgtcggtcggtccctaccggaggtccgtagggagtagtacgggacggtctaggtaactttacgtacgtcgacgacgcgtactaacgttactacgacccggtaacccctaagggttacggggtttcggtttacgggaccggggtacggtaaccggttaagggccggtaaccccggttcggttacgggtaccgacccggtaacccggaacggtcccgtaccccggtcccccggtaccggttacctaccccgtttccgttaccccgtttaccccccgtccccgttacccccg

SEQ ID NO: 154102 - DNA, 625 bp, Homo sapiens
  misc_feature: GYAE6OF01DJO15.10.38.D05.1.454.CMB.1.raw
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (444)..(444): a, c, t, g, unknown or other
  misc_feature (444)..(444): n is a, c, g, or t
  modified_base (469)..(469): a, c, t, g, unknown or other
  misc_feature (469)..(469): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgacgactctcctgtgcacgtcctcgtgggttcagcatcaagtaacgactacatcgaccgtcgggccccgccgaggcctccgaggggaagggcgtggagtgggtctcgtagttatagaaacngatggactactanattattattctcgactccggtaggaacgggtccgtcaccctctaccagacacaccttaccaaactaactntcttgacttctacactatcactaanacttctaggacgtacgtaccgaaccgaaccgacggtacccctaactttagtttaacgttcggtcgacccggacgtaaccgattaccggaacccttaccggtcccttaacgttaacgttcccgggttaccgggggcccgtaaaggggggtacccccg

SEQ ID NO: 154103 - DNA, 700 bp, Homo sapiens
  misc_feature: GYAE6OF01DWOD8.10.38.D05.1.454.CMB.1.raw
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgtcttataactatgtctcctggtaccagccaccaccaggaccaaacgcccctaaattcctttgttttgaggtcagtaacgccggcctcgaggacgtcctgacgttcggttctcgtcgcctacagtctgacaacgcggtcctccgtgtaccgtcgtcgtcgggcctcgaggtcgtggagatcggagtctagtacttacgtacgtcgacgacgtcgactattaccgtaccgaaccggtaccccgtaagggttacggggttcggtttcggggacgggtacgggtaacgtacgggtcgtaccggttcggtacggaccgtacggaccgtacggtccgtcccggtcccccgttacggtacccttaccgttcccgttacccgttacccccgtaccccgttcccgttacccgtaaccttacccgtaacgttcccggtcggttacgggaccggggtccgggttccggtaaccggggaaccgtaaccgggaccggtacctaaacggtgtccgag

SEQ ID NO: 154104 - DNA, 552 bp, Homo sapiens
  misc_feature: GYAE6OF01AFSKO.10.38.D05.1.454.CMB.1.raw
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacttttgtgctttataactatgtctcctggtaccagccaccaccaggaccaaacgcccccaactcctttgttttgaggtcagtagcggccctnaggactccctgacttcggttctctcgcctcaagtctgccaacgacggcctccctgacccgtntcgtgggcctccgaggctgacggntggagtctagtacttactacgtcgcngcgtcatagttacacggcccaagtagggttgttggcggcggactaggcgaccgtcgtggtcgcgtcgaaggcctccgccccgtcggtccacgtcctcgttccccgaccctccc

SEQ ID NO: 154105 - DNA, 583 bp, Homo sapiens
  misc_feature: GYAE6OF01A69C5.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcacggtcccaggaaccggcccccaaactcctacatctaataacgattatccggccggccctcgacggggtccctgaccgtattctcgtggcctccgaagtctggccacctcacgtccctcccgtggcccatcgaggtcggcctcccgggtccgaggatcgacgtctagatttattactgtgtagcagtggatgacagcctgagtgcttagtcgttcgttacggtaacgtcggggaacctaacgggtccaacccggttcctaaccggtccaccggaccccgtaacgggacccccaaacccccgcttccgtccctaccg

SEQ ID NO: 154106 - DNA, 546 bp, Homo sapiens
  misc_feature: GYAE6OF01CFR8B.10.38.D05.1.454.CMB.1.raw
  modified_base (221)..(221): a, c, t, g, unknown or other
  misc_feature (221)..(221): n is a, c, g, or t
  modified_base (536)..(536): a, c, t, g, unknown or other
  misc_feature (536)..(536): n is a, c, g, or t
  modified_base (540)..(546): a, c, t, g, unknown or other
  misc_feature (540)..(546): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccgaggggaaggggctgggagtgggtctcagttattagaaaacagatggcactacatattattctgactccgtgaacgggccgttcaccctcnccagagactacttccaacaacatcttgtatcttcacatgcacaatctgagagtcgacgacacggccacctattattgtgcgcgacatgactacgctactaacttcgtggggccaggggacgcccgaggtccacccgtcctccccacgtccctccaaccgacggccccagtcccggtccttccccgtcggccgcccctcgcctccgaggacgcacccgtcgagacgcacgcgccgcccgtgggctgccgtggtacaacggaccttacctacccactactactcgcgtgcggccgggcgcgggacgaacggcacganacgnnnnnnn

SEQ ID NO: 154107 - DNA, 576 bp, Homo sapiens
  misc_feature: GYAE6OF01ADUB7.10.38.D05.1.454.CMB.1.raw
  modified_base (357)..(357): a, c, t, g, unknown or other
  misc_feature (357)..(357): n is a, c, g, or t
  modified_base (436)..(436): a, c, t, g, unknown or other
  misc_feature (436)..(436): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctctgggttcagcatcagtaacgactacatcgacctcggggccccgccgaggctaccgaggggaggggctgggagtgggtctcgagttattagaaacngatggacactacatattattctgacctccggtaggaacgggtccgttccaccctctccagacgaccaccttacccaaanaaccattccttagtacttcttcacatcgacaacaatctaggacgacgttaccgaaccgaccgaccggccctaacttattacttgtacgccgacgactagtcgaacctccgcttacaagttccggcggggccaggggaccc

SEQ ID NO: 154108 - DNA, 693 bp, Homo sapiens
  misc_feature: GYAE6OF01AV9WH.10.38.D05.1.454.CMB.1.raw
  modified_base (226)..(226): a, c, t, g, unknown or other
  misc_feature (226)..(226): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccngcagtgtactttgtgacttaataactatcgtctcgtggtaccagccaccaccaggaccaaaccgaccccctaaacttcctttgttttaggacggtcaaggtacgccggccctacgaggtactccctgtacttcggttctcgtcgtccctaccgtaagtccgtacggaccaaccgaccggtcccctaccgtcgtacccgttctcgtcgggcctaccgaggtcctagggacggtagtcggacggtccttagtaactttaccgtacgtcggactaggccgtactattaccgttacggaacccggtaacccgtaaggttaggggtttcggtttcggggaccgggtaccgggtaacgtaacgggttccggacccggttccggtacgggtaccgaccggtacccgaacgggtcctaccccggtcccccgttcggtacctcccgttcccgttcccgtccccctacccgttcccc

SEQ ID NO: 154109 - DNA, 322 bp, Homo sapiens
  misc_feature: GYAE6OF01BIH3A.10.38.D05.1.454.CMB.1.raw
  modified_base (319)..(322): a, c, t, g, unknown or other
  misc_feature (319)..(322): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctcggtcactctgttcccgccctcctccactactatgctgagcggctggcaaggcgcatagnnnn

SEQ ID NO: 154110 - DNA, 555 bp, Homo sapiens
  misc_feature: GYAE6OF01AEJRO.10.38.D05.1.454.CMB.1.raw
  modified_base (516)..(516): a, c, t, g, unknown or other
  misc_feature (516)..(516): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggcctccgaggggaggggctggagtgggtctcgagttattgaaacagatggcactacatattattctgacctccggtggaacgggtcccggttcaccctctccagacgaccacctttacccaaacaacattccttagtacttccttaccacatcgcaacaattctagagacgtcgaccgaccacggccctaccttattacttgtcgcgcganatcgacctacgcttcaagttcgcggggccaggggacccg

SEQ ID NO: 154111 - DNA, 737 bp, Homo sapiens
  misc_feature: GYAE6OF01B99XP.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacttttgtgctttaataactatgtctctggtaccagccaccacccaggacaaacgccccaaacttccgtttgttttgagtcagtacgcgccctagaggtactcctgacttccggttctcgtcgtccctacgaagtccgtacggaccaaaccgtaccggtcccttacccgtcggtaaccccgttccgtccggtacggggtcccttaccggacgggtccgttagggaacggtagtaggacggtcttaaggtacttacgtacgtcgacgtacgaccgtactaattaccgttaccggaaccggtaaccccccgtaaagggttacggggtttacgggtttacggggaccgggggtaaccgggtaaccggttaacggggttcggtaccccggttaccggtcggggtacctaacccgggacccggtaaacgggtccccgttcccggaccccccgtttacgggtccctaccgtttcccgttcccggtttccccccgacccctttacccccg

SEQ ID NO: 154112 - DNA, 649 bp, Homo sapiens
  misc_feature: GYAE6OF01C1CXH.10.38.D05.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (413)..(413): a, c, t, g, unknown or other
  misc_feature (413)..(413): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatctcctgcactggaaccagcagtnactttgtncttanaactatgtctctggtaccngccaccaccaggacaaacgccccaaactcctttgttttgagtcagtaagccgcctcaggacgtcctgatcgattctctcgcctacaagtctggcaacaccggcctccctcgaccgttctcgtcgggcctccgaggtcctaggaggnttggaggtcctagtactttacacgtgcgtagcgctaattacgttccgaaccggtaccccctaaagggtacggggttcggtttcgggaccggggtacggggtaaccgttaacggggttccgaccccggttccgggtacggggtccctaaccgggccccggtaacgggtcccgttcccggccccccccgttcgggtacccctacccggtttccgtccccgtttacccccgtacccccg

SEQ ID NO: 154113 - DNA, 531 bp, Homo sapiens
  misc_feature: GYAE6OF01DNNVR.10.38.D05.1.454.CMB.1.raw
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
  modified_base (485)..(485): a, c, t, g, unknown or other
  misc_feature (485)..(485): n is a, c, g, or t
  modified_base (522)..(522): a, c, t, g, unknown or other
  misc_feature (522)..(522): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctgggccccgccaggctccgaggggaaggggctggagtgggtctcagttatgaaacngatggcactanatattatctgactccgtgaacgggtccgttcaccctctaccagacgacacttacccaaacaactatcttgtatccttcacntgacacaatcngagagtcgacgacaccggccaccttattatgtnccgcgacatcgaactcgactacaacttcgcggggccnggggacccg

SEQ ID NO: 154114 - DNA, 616 bp, Homo sapiens
  misc_feature: GYAE6OF01AQ4RQ.10.38.D05.1.454.CMB.1.raw
  modified_base (472)..(472): a, c, t, g, unknown or other
  misc_feature (472)..(472): n is a, c, g, or t
  modified_base (557)..(557): a, c, t, g, unknown or other
  misc_feature (557)..(557): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggctggatccgagccgtggggggtccctgacgactctccgtgtgcagcctcgtgggttcagcatcagtaaccgactacagtcgacccgtcgggcccgccgacggcctaccggaggggacggggcgtgggaggtgggtctctagttattagaaacagagtggacactaactattattacttctacgtacgtcggtaggacgggtcccggttcaccccgttcgtaccagtacgaccctaaccttacccgaactaactntttccttagttactcctttacacgtatcgacctaactaactcgtaggaacgtcggtaccgaacgtaccgaccggccctaactttnttacgtgtcgcgtacactgtcaaccttaccgcttacgaagttcgggcgggacgaacggg

SEQ ID NO: 154115 - DNA, 627 bp, Homo sapiens
  misc_feature: GYAE6OF01DMPG5.10.38.D05.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (619)..(619): a, c, t, g, unknown or other
  misc_feature (619)..(619): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntcctcctgcactggaaccngcagtgacttttgtgcttataactatgtctcctggtaccagccaccaccaggcaaacgcccccaaatcctttgttttgaggtcagtaagccggcctcgaggacgtcctgactcggttctctcgcctcagtctggacaacgccggtccctccgtgacccgtctccgtcgggcctcccgaggtcctagggacggtatggacggtcttaggtactttaacctacgtcggacgaacggtccgtactaactttacgttcccgaaccggtaccccctaaaggttacggggttcggtttcggggccgggtacgggtacgtaacgggtccgtacccggtcgtcgggtacgacggcccgaggtccgtccgcccccgtgtccacttcgtccgttccccnccctcccg

SEQ ID NO: 154116 - DNA, 823 bp, Homo sapiens
  misc_feature: GYAE6OF01C0SAY.10.38.D05.1.454.CMB.1.raw
  modified_base (301)..(301): a, c, t, g, unknown or other
  misc_feature (301)..(301): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctgtgggttcagcatcaagtaacgactacatcgacctcgggcccncgaggctccgagggagggctggagtgggtctcagtttagttacgaaacgtagtacgtcggactaaacgtaactaagtttaactttaacgtttccgtacggtaacccgtttacccggtaacgggtaaaccgggggtccccggtttacccgtaaccccccgtttaccgttaaccccgaaacgggtaaccgttaaacccccgtaaacccgttttaaacccccgaaaaaccgtaaacccgttagttttacccccgttttagggttaaaccctttccccgtttaccgaaacccgtagtttacgaacccgtaaactaaacgtttccgaagggaacggttaccgggttacccgaaccgggtaacccgtaacccgggtacccctaaaccggttttaattttaacggtttccgggaacggtacccgggtaccctaaaccgtacgtttaccgggaacccccgttaaccgtccctttaaaccccgtaaggttttacccgggtaccggggggaccctaaggggggtaacccccg

SEQ ID NO: 154117 - DNA, 734 bp, Homo sapiens
  misc_feature: GYAE6OF01EW096.10.38.D05.1.454.CMB.1.raw
  modified_base (315)..(315): a, c, t, g, unknown or other
  misc_feature (315)..(315): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttatactatgtctcctggtaccagcaccaccagcaaacgccccaactcttgttttgagtcagtagcgccctnaggacgtcctgactcggttctctcgcctacaagtctggcaaccgaccggcccttcccgtgacccgttctcgtcggggtcctcccgacggtccgtaggacggtagttggaacgggtcgttggtaactttaccgttaaccgttcggaccgtaacggccgactaacgttacgttaccgaaccgggtaccccccgtaaacggtacgggggtttcggttttacgggggaccgggtacccgggggtaaacgttaaacggggttccggtaaccccgggtttccggtacgggggttacccgtaaccgggtacccccggtaaacggggtccccgtttccccgggaccccccccggtttaccggggttacccctaacccggtttcccgtttccccgggtttcccccccggtcccccgtttaccccccgg

SEQ ID NO: 154118 - DNA, 595 bp, Homo sapiens
  misc_feature: GYAE6OF01A9GJ9.10.38.D05.1.454.CMB.1.raw
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactccttgttttgagtcagtagcgcctnagactcctgatcggtctctgctcagtcngcacncgcctcctgaccatctctcggcctccacgtcctggacggtatcggacggctagtaactttattacgttgtttcgtcctactatagttcgcgtacgggtccggttacccgtcggtttggggttcgttccggggacgggaccgggtaccgaagggtcgtacggtaccgttccggtaggtccgacggacccgaacgggtccgtacccggtcccccgtacgggtcctacccgttcgttacccccgg

SEQ ID NO: 154119 - DNA, 609 bp, Homo sapiens
  misc_feature: GYAE6OF01BONB0.10.38.D05.1.454.CMB.1.raw
  modified_base (399)..(399): a, c, t, g, unknown or other
  misc_feature (399)..(399): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctcgggccccgccgaggctccgaggggaggggctgggagtgggtctcagttatagaaacagatggcactacatattatctgactcgtgacggccgttcaccctcncagagacctacttacccaaacaacattcttagtacttcttacactatgaccaactaatctaggacgtacggtaccgaacgaccgaccggtaccctaaccgttatttacgttcggtacggaccgtccgtaaacacgttacggaacccttacccgacgtttaaccgtaaacgttttcccgggacgggggtaccccgaagggggtacccccgg

SEQ ID NO: 154120 - DNA, 999 bp, Homo sapiens
  misc_feature: GYAE6OF01DYIFT.10.38.D05.1.454.CMB.1.raw
tcagcatagtagtgcacgaccggtgctcgatttagtatctgatagttgggtttgggggagaggagcccagcactgggattccgaggtgtttccattcggtgatcagcactgaacacagaggactcaccagtggtagttttggctgagtcgttgggttttccttgttgcttatttacgaaaaggtgtccactgtgtaggttcaacgtgggtggagacgtgggagggaggcgtggactcccgacggccggttcggggggtccctggaacgtaccgttccgtcccgttggtcgaccgacgtcccgttcggttcggggttaccacggacctaacgttaccgtaaacggttaaaaccgtaacccttaaccgtaacggttaccggaacccccgggttcccggggaccccccgtacccggaaccggggtaccccggtaacccggggaacgggggggaaacgggggtccggttggggtaacgggtttcgggtttacccgttaaggttaacggttttaaagttaacgggaaaaacgtaggtaacgttacgggaccctaaaccgtaacttaagtttaacttttaacgtttacgtacggttacccgttacccggtaaggggtaaacccggggtttccccgttacccgtaacccccgttccgtaacccgtaaagggaaccccgtaaccttaacccgtttaaccccaaaacgtaaactttaccgtttccgttttaacgttacctttaccttaacccaacgttacgtaccggtaactaaacccttaagtcccgttaaggaacggaccggttaccggaacccgtaacccgtaacccggtacccttaaaccgtttaagtttttacggtaccggtacgggaccccggttaacgaaacccggtttaagttcccggaaaccggttttaaccccgtaccccgttaaaccccgggttttaaaagggttccccgggggttaacccggggggaacccgttaaacccgggggaaaccccccgg

SEQ ID NO: 154121 - DNA, 657 bp, Homo sapiens
  misc_feature: GYAE6OF01A3UF8.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctggagactctcctgtgcagcctcgtgggttcagcatcagtaacgactacatcgaccgtcgggccccgccgacggtccgtccgaagggggaacgggggcgtgggacggtcggggtctcgtagtttaagttagaaaacgagatggacactaactattaagttacttctacgtaccgttccggtacggaaacggggtccccggtttacaccccgttctaccgagaacgacctacccttaacccaaacaacctacttctttacgtaactttcccttacacgtacttcgaccaaactaacttcgaggacgtaacgtccgaaccgtaccgacccgtaccctaacgttacgtttagttcggtacgccgtccgaacagttccgaacctccgactacttaacgtcggtacgggccgtaggggacccg

SEQ ID NO: 154122 - DNA, 606 bp, Homo sapiens
  misc_feature: GYAE6OF01CRTUH.10.38.D05.1.454.CMB.1.raw
  modified_base (227)..(227): a, c, t, g, unknown or other
  misc_feature (227)..(227): n is a, c, g, or t
  modified_base (412)..(412): a, c, t, g, unknown or other
  misc_feature (412)..(412): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagccaccaccaggacaaacgcccccaaactcctttgttttgaggtcagtaagccggcctcgaggacgtccctgactcggttctctgcctcaagtctggacaacgcggtccctccctgaccgtctcgtgggcctccgaggctggaggntggagctagtacttactactgcagcgcattacttcgacggacccctaaggtaggggttcgtttcgggccgggtacggggtacgttaacgggtcggtaacccggtccgtaggggtccgacggccccgaagggtccctcccgggtccccccgttcgggtcctaccgttcccgttccgttcccccacccgttccccg

SEQ ID NO: 154123 - DNA, 543 bp, Homo sapiens
  misc_feature: GYAE6OF01AIVFZ.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaggggctgggagtgggtctcgagttattagaaacagatggcactacattattattctgactccggtggaacgggcccggttcaccctctccagacgacacttacccaaacactatcttgtactcttacacatgcacaatctagagagtccgacgaccaccggcccaccttattacttggtcgcgcgacatcgacctaccgcttacaacttcgcggggccaggggcccg

SEQ ID NO: 154124 - DNA, 451 bp, Homo sapiens
  misc_feature: GYAE6OF01AZ9E0.10.38.D05.1.454.CMB.1.raw
  modified_base (248)..(248): a, c, t, g, unknown or other
  misc_feature (248)..(248): n is a, c, g, or t
  modified_base (399)..(399): a, c, t, g, unknown or other
  misc_feature (399)..(399): n is a, c, g, or t
  modified_base (443)..(451): a, c, t, g, unknown or other
  misc_feature (443)..(451): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacncggcctcctgaccgtctctgggctccaggctgaggatgaggctgattactactgcagcgcatattcaggccccaacgagggtgttggcggcgggactaaggtgaccgtctgggtcagcccaaggctcgccccctggtcactctcgttcccnccctcctccactactatgctgacgcgggctggcaggcgcatagnnnnnnnnn

SEQ ID NO: 154125 - DNA, 649 bp, Homo sapiens
  misc_feature: GYAE6OF01AQBBL.10.38.D05.1.454.CMB.1.raw
  modified_base (227)..(227): a, c, t, g, unknown or other
  misc_feature (227)..(227): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagccaccacccaggaccaaacgcccccaaactccttgttttgagtcagtaacgcggcctcgaggactccctgatcggtctctgcctcgaagtctggcaacgacggtccctccgtcgaccgtctctgggcctccgaggctgagtagtcgagtctagtacttacgtactgacaggccgactaattacgttcgaaccggtaccccgtaaacggtaggggttcggtttacgggccgggtaccggggtacgttaaacggggtccggtaacccgttcccggttaggggtccgacccgggtacccgaaacgggtcccttaccccgggtacccccgttcccgggtacctaacccgttcccgttcccgtttccccccgtaccccttacccccg

SEQ ID NO: 154126 - DNA, 653 bp, Homo sapiens
  misc_feature: GYAE6OF01E0HNF.10.38.D05.1.454.CMB.1.raw
  modified_base (243)..(243): a, c, t, g, unknown or other
  misc_feature (243)..(243): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttncttataactatgtctcctggtaccagcaccaccaggccaaacgcccccaaacttcctttgttttgaggtcagtaacgcggccctcaggagtccctgactcggttctctgcctcaagttctggcaacgacggccctcccgtgaccgtctcgtgggcctccgaggctgacggntgacggctgaacttactactgcagcnctaattacttacgaccggtaccccaacggtaggggttcggttttacggggccgggtacggggtaaccgtaaacggggtcggtaaccccggttccggtacggggttccgaacggacccccggtaaaggggtcccctacccgggcccccccgtttccggggtaccccttaccgttaccccgtttccggtttaccccccctccccgtttacccccg

SEQ ID NO: 154127 - DNA, 574 bp, Homo sapiens
  misc_feature: GYAE6OF01B6XCN.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcatcatctcctgcactggaaccagcagtgacttttgtgcttataactatgtctcctggtaccagccaccaccaggaccaaacgcccccaaacttcctttgttttgaggttcagtaacgccggccctcgacggacgtccctgacttcggttctctcgcctccaagtctcggacaacgccggccctcccgtgacccgtctcgtcgggctccgaggtctggaggatggaggctagactttactactgcagcgactatacttcgacggacccaagtgggttgtttacgggcgggtacggacgtaggtcgaccgtcgtcgggcacggcccgaggcctccgcccccgtcggtccacttcctccgtcccctacccg

SEQ ID NO: 154128 - DNA, 227 bp, Homo sapiens
  misc_feature: GYAE6OF01BTD2G.10.38.D05.1.454.CMB.1.raw
  modified_base (224)..(227): a, c, t, g, unknown or other
  misc_feature (224)..(227): n is a, c, g, or t
tcagcatagtagtgcacgaccggtgctcgatttagtatctgatagttgggtttgggtgccgaagttgctggaggtcaccgtctccccagcctccaccaagggcccatcggtcttccccctggcaccctgctccaggagcacctcagagagcacagcggccctgggctgcctggtcaaggactacttcccactactatgctgagcgggctggcaaggcgcatagnnnn

SEQ ID NO: 154129 - DNA, 702 bp, Homo sapiens
  misc_feature: GYAE6OF01CUDTV.10.38.D05.1.454.CMB.1.raw
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcacgccctcccgtccgcggtccgggtctccgtggacagtcagtcacatcctctgcactacggaaccngcagtgtactttgtgtacttaataactntcgtctccgtaggtaccagccaaccaccgaggaccaaaccgaccccctaaactttccgtttagttttaggacgtcgaaggtacggccgtacctagacggtctccgtagtacgttcggttctctcgcctacgagtctacggaccaaccgccgtcctaccgtcgtaccgttcgtcggtcgggtcctaccggtacggtcgtacgggaaggtacgtagggacgtacgttacgtaactttaccgtacgtcggaccgtaggaccgtacttagttaacccgttaccgaacccgggtaacccctaagggttacggggttcggttacgggacgggtacggtaacgtacgggtcgacccggttcgtgggtaccgaccggacccgaggtcccgtaccccggtcccgttcgtaccctccttcccgttccccgttcccctcccgttaccc

SEQ ID NO: 154130 - DNA, 673 bp, Homo sapiens
  misc_feature: GYAE6OF01CZDHY.10.38.D05.1.454.CMB.1.raw
  modified_base (632)..(632): a, c, t, g, unknown or other
  misc_feature (632)..(632): n is a, c, g, or t
  modified_base (662)..(662): a, c, t, g, unknown or other
  misc_feature (662)..(662): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttcaaaaggtgtccactgtgaggttcaacgtgggtggagacgtgggagggaggctggatccaggccgtggggggtccctggagactctcctgtgcagcctcgtgggttcagcatcaagtaacgactacatcgaccgtcggggccccgccgacgggccgtaccggaagggggaacgggggcgtaggggaggttcggggtcctacgtaaggtttaacttaggaaaactaggtaagtcgggacctaacttaactaatttaactttagttacctacggtaccgttccggtagggtaaccggggtcccggtttaccaaccccgttcctaccgaaggaacgaaccctaaccttaaccaaactaaactacttcgttagtacttaccttacaactactcgacaacgtaatcgtaaggaagtacggtaccgaaacgaccaccggtacctaacgttattacgttggacgccganactagtacgactacgtctactaagttcggngggccaagggg

SEQ ID NO: 154131 - DNA, 224 bp, Homo sapiens
  misc_feature: GYAE6OF01DFXUR.10.38.D05.1.454.CMB.1.raw
  modified_base (221)..(224): a, c, t, g, unknown or other
  misc_feature (221)..(224): n is a, c, g, or t
tcagcatagtagtgcacgaccggtgctcgatttagtatctgatagttgggtttgggtgccgaagttgctggaggtcaccgtctcccagcctccaccaagggcccatcggtcttcccctggcgccctgctccaggagcacctcagagagcacagcggccctgggctgcctggtcaaggactacttcccatactatgctgagcgggctggcaaggcgcatagnnnn

SEQ ID NO: 154132 - DNA, 665 bp, Homo sapiens
  misc_feature: GYAE6OF01E1LNW.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctcgtgggttcagcatcagtaacgactacatgacctgggcccgccgaggctccgagggaagggctggagtgggtctcgagttagtagaacagatggacacgtacatattattctgtacctccggtagaacgggtccgttaccacccttcgaccgagtacgacctacttacccaaactactattcttagtactcttacactatcgactaacaattccaggaacgtacgtaccggaaccgaaccgtaccggtaccccaaacccgtttaagtttacgtttacgggtacgtacccgggtacgaaacccgtttaagttaccgggaaacccttaacccggtaccgtttaaccgtaaaacgtttttccccggggtaaccggggggaccccggaaagggggggttaaaccccccgg

SEQ ID NO: 154133 - DNA, 537 bp, Homo sapiens
  misc_feature: GYAE6OF01CDRPD.10.38.D05.1.454.CMB.1.raw
  modified_base (228)..(228): a, c, t, g, unknown or other
  misc_feature (228)..(228): n is a, c, g, or t
  modified_base (386)..(386): a, c, t, g, unknown or other
  misc_feature (386)..(386): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacttttgtgcttataactatgtctcctggtaccagcaccaccaggcaaacgcccccaaatcctttgtttttgaggtcagttaacgccggcctcgaggacgtccctgatcggttctctgcctcaagtctggacaacacgccctcctgacctcncgtggctccgagctgaggatgagtctgtattacgtactgcagcacatactcacgacccagtagggttgttggcgacgggactaggtcgaccgtcgtggtcgcgccgaggtccgcgtccccgtcgtccactccgtccgttcccgccgtcccg

SEQ ID NO: 154134 - DNA, 560 bp, Homo sapiens
  misc_feature: GYAE6OF01ATMAC.10.38.D05.1.454.CMB.1.raw
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (550)..(550): a, c, t, g, unknown or other
  misc_feature (550)..(550): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctgtaccagcaccaccaggaccaaacgccccaactcttgtttgagtcagtacgcgcctnagacgtcctgactcgttctctcgcctcaagtctggacaacncgccctcctcgacctctcgtcgggctccgaggctgagatggacgctagtacttactacgtgcagcgctatacgtcacggaccctaaggtgggttggttcgggcggtacggtacgtaacggtcgtaccggtccgtgggacacgacccgaaggtccgtacccgtccccgtggtaccctctccgttccgttccccncccgttaccc

SEQ ID NO: 154135 - DNA, 723 bp, Homo sapiens
  misc_feature: GYAE6OF01EWDGO.10.38.D05.1.454.CMB.1.raw
  modified_base (253)..(253): a, c, t, g, unknown or other
  misc_feature (253)..(253): n is a, c, g, or t
  modified_base (710)..(710): a, c, t, g, unknown or other
  misc_feature (710)..(710): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtgcttataactntgtctccgtgtaccagccaccaccaggaccaaacgaccccctaactctttgtttgagtcagtacgccgcctagagctcctgacttcggttctcgtcgccctacgtacgtctacggacctaaccggccgtcccttacccgtacggtacccgttccgtccggtcgggtacctccggaggtccgtaggaggtacgtaggacggtctagttacttaccgtacgtcgacgtacggtccgtactaacgtacgttaccggaacccggtaaccccgtaacgggttaggggtttacgggttttacggggacccggggtaaccggggtaacgttaacggggtccgggttaaccccgggtttccgggttaccggggtaccgtacccgggtaccccggtaacgggtcccctccccgggtccccccgttcggtacccttacccgtttccccgttccccgtttaccccccnccccgttaccccg

SEQ ID NO: 154136 - DNA, 731 bp, Homo sapiens
  misc_feature: GYAE6OF01CRBK2.10.38.D05.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
tcagcatagtagtgcacgaccggtgctcgatttagtatctgatagttgggggtttgggggggtctcaggaggcagcgctctcaggacgtcaccaccatggcctgggctctgctcctcctcaccctcctcactcagggcacgagggtcctgggcccagtctcgccctgactcacgccctccctccgcgtccgggtctccgtggacagtcagtcaccatctccngcacgtggaaccngcagtgtactttgtncttaataactattgtctcgtggtaccagccaaccacccgaggaccaaacgaccccctaaacttccgtttagtttttgacggttcaagtaacggccggccctcgaggtacgtccgtagacttcggttctccgtcgcctacgaagtcgtacggaccaaccgaccggtcccttcccgtacgtacccgttctccgtcgggccttccgaggtcgtaggaggacgtaggacggtctaggtaacttaccgttacgtcgaccgaacggtccgtactaagttaccgttacccgaaccgggtacccccgtaaagggttacgggggtttcggtttaccggggacccggggtaacggggtaaccgttaacggggtccggtacccgggtccggtagggtacccgaaccggtacccggaacggtcccgtccccggtcccccgttacgggtccctaaccgttcccgttacccgttccccccgtaccccgttccccg

SEQ ID NO: 154137 - DNA, 665 bp, Homo sapiens
  misc_feature: GYAE6OF01CPTD2.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtctgggttttccttgttgctatttacaaaaggtgtcactgtgaggttcaagtggtggagagtgggaggaggcgtggactccgaggccggtcggggggtccctgacgactctccgtgcgcacgcctcgtgggtcagcatacaagtaacgactacacgtcggacccgtcggggccccgacgacggccgtaccggaaggggtaacggggcgtgggacggtgggtctacgtaagttattagaaaaccaggatggacctaactaactaattattattctacggtaccgtccggtaagggaaccgggtccggttaccacccgtctaccgaaggactaacctaaccttaccaaactaactattaccgttgtaacttctacacgtaatcgacaactaattcgagtacggaacgtaccgaacgacaacccggtacctaacttacttacgtcggacgaccggaacgactagtcgaaccttacgaccttaacgtaacgttaccgggcgggggtaaccgacgggtacccg

SEQ ID NO: 154138 - DNA, 738 bp, Homo sapiens
  misc_feature: GYAE6OF01BC6K7.10.38.D05.1.454.CMB.1.raw
  modified_base (317)..(317): a, c, t, g, unknown or other
  misc_feature (317)..(317): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttacaaaaggtgtccactgtgaggttcaactggtggagacgtgggagggaggcgtggactccaggccgtgggggtccctgagactctcctgtcgcagcctcgtgggttcagcatcaagtaaccgactacagtcggaccgtcggggccccnccgacgggccgtaccggaggggaacggggcgtgggacggtggggtctacgtagtttaattagaaacgtaggaagtcgggaccttaactaactaatttaatttaatttcgtacgaccgtttaccggtaaggtaaccgggtcccggtttacccacccgttcctacccgaagaccgtaacctaacccttaacccaaactaactactttcgtttagtaacctttccttaccgaactacttacgacctaaacctaactttacgtacgggaaccggtaaccggttacccggaaaccgtaacccggtaacccgggtaccccttaaacccgttagtttacgtttacggaccggttaccggacccgtaatacgtacgtaaccgtacggtctaccgtacgttttaccgggcgggtacccggagggtacccg

SEQ ID NO: 154139 - DNA, 579 bp, Homo sapiens
  misc_feature: GYAE6OF01CGLBH.10.38.D05.1.454.CMB.1.raw
  modified_base (241)..(241): a, c, t, g, unknown or other
  misc_feature (241)..(241): n is a, c, g, or t
  modified_base (378)..(378): a, c, t, g, unknown or other
  misc_feature (378)..(378): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggnggttataactatgtctcctggtaccaacaacacccaggcaaagcccccaaactcatgatttttgatgtcagtaactcggccctcgaggggtttctaatcgcttctctgctcaagtctgcaacacggcctcctgaccntctctgggctcgaggctgacggacgaggctagacttattactgcagcctacatactaacaaccagacacgtctacttctagtacgttacgggcggtacgggaccaaggtccgtacggtaccccggttaccgtacgggtacccaacggacccccgtaaacggtcccgttacccggcccccccgttagggtccctaaccccgg

SEQ ID NO: 154140 - DNA, 799 bp, Homo sapiens
  misc_feature: GYAE6OF01D2U54.10.38.D05.1.454.CMB.1.raw
  modified_base (370)..(370): a, c, t, g, unknown or other
  misc_feature (370)..(370): n is a, c, g, or t
tcagcatagtagtgcacgaccggtgctcgatttagtatctgatagttgggttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccaggccgtgggggtccctgacgactctcctgtgcacgcctcgtggttcagcatcaagtaacgactacatcgaccgtcgggcccgccgaggccgtaccggaaggggaggggcgtgggaggtcgggtctacgtagttaagtacgaaaacngtagtcggactaactactaagttatttaacttcgtacgtaccgttcggtacggaaccggggtcccggtttaccctaccccgttccgtacccgaacgtaaccggtaaccccttaacccgtttaaaccccaaaacctaaaccttaacttttaccccgttttaggttaacccttttacccttaccgtaaaccgtacgttaccgtaaccctaaacgtaaacctttcggtaagggtaaaccggtaccggttaacccgggaaacccggtaaccccaaacccggttaacccccctaaacccgttttagttttaaacgtttccggggtaccgtacccggtaaaccgtaccgtttaacggtaccggtaaacccttaccgttaaccctaccgttaaacgtttcccggggtaccgggggacccgtaagggggtacccccg

SEQ ID NO: 154141 - DNA, 598 bp, Homo sapiens
  misc_feature: GYAE6OF01D6GO2.10.38.D05.1.454.CMB.1.raw
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtgggttttccttgttgctatttacaaaaggtgtccactgtgaggttcaactggtggagactggaggaggctggatccagccgtgggggtccctgagactctcctgtgcacgcctctgggttcagcatcaagtaacgactacatcgaccgtcgggccccgccgacggccgtaccgaggggaaggggcgtgggaggtgggtctcgagttattagaaacngatggacactanatattatctgactcggtagacggtccgtacaccctctcagacactaccttccaaactacattctgtatctacgatatcgacacatcgtagacgtacggtcgaaccgaaccgacggaccctaacttattaacgttcggtacgccgtaccgtaacaggttccgaaacccgttcgacctttaccggtaactttccggggaccggggccctaacgggggtcccg

SEQ ID NO: 154142 - DNA, 228 bp, Homo sapiens
  misc_feature: GYAE6OF01C2YIE.10.38.D05.1.454.CMB.1.raw
  modified_base (224)..(228): a, c, t, g, unknown or other
  misc_feature (224)..(228): n is a, c, g, or t
tcagcatagtagtgcacgaccggtgctcgatttagtatctgatagttgggtttgggtgccgaagttgctggaggtcaccgtctccccagcctccaccaagggcccatcggtcttccccctggcgccctgctccaggagcacctcagagagcacagcggccctgggctgcctggtcaaggactacttcccactactatgctgagcgggctggcaaggcgcatagnnnnn

SEQ ID NO: 154143 - DNA, 680 bp, Homo sapiens
  misc_feature: GYAE6OF01ARR36.10.38.D05.1.454.CMB.1.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcacgcctccctcgcgtccggtctcctggacagtcagtcaccntctcctgcactgaaccngcagtgtactttgtncttaatactatcgtctcgtgtaccagccaccaccaggaccaaaccgaccccaacttcgtttgttttgacgtcagtacgccgcctacgagtctcctgtacgttcgttctctcgtcctacgtagtcgtcgaccaaccgaccggtccctacccgtcgtacccgtctccgtacgggtcctaccgacggtctaggaggtaacgtggaacggtcttacgtacgttaaccgtcgtcgaccgtacgtacgactaacgttaccgtccgaacccggaacccgtaacggtcggggttaccggtttcgggaccgggtacggtaacgttaacgggtccgtacccggttccggttacgggacccgtaaccggtccccggacggttccccgttcccggtacccccggttcgtaccctacccgttcccgttcccggttcccccgtccccttacccg

SEQ ID NO: 154144 - DNA, 469 bp, Homo sapiens
  misc_feature: GYAE6OF01CN64S.10.38.D05.1.454.CMB.1.raw
  modified_base (258)..(258): a, c, t, g, unknown or other
  misc_feature (258)..(258): n is a, c, g, or t
  modified_base (327)..(327): a, c, t, g, unknown or other
  misc_feature (327)..(327): n is a, c, g, or t
  modified_base (451)..(469): a, c, t, g, unknown or other
  misc_feature (451)..(469): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggccctcccngaccgtctctgggctccgaggctgaggatgaggctgattactactgcagcgcatatcacggccccaagngggttgttgggcggcgggactaaggtcgaccgtcgtggtcagcccaggcctcgcccctggtccactctcgtccccgccctcctccactactatcgctggacggcgggctcggcaggcgcagtannnnnnnnnnnnnnnnnnn

SEQ ID NO: 154145 - DNA, 632 bp, Homo sapiens
  misc_feature: GYAE6OF01EOXYP.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtacagcaccaccaggcaaacgcccccaaactccttgttttgagtcagtaacgcggcctgagacgtcctgacttcggttctctcgcctcgaagtctggacaacgacggtccctccgtcgaccgtctcgtcgggctccgagcgtggacggtatgacggcttagtaactttactacgtgcaggccgtactaagttactccgacggtaacccccaagggtacgggttggtttacgggccgggtacgggtaacgttaaggtcggtacccgttccggtcggggtaccaccggtacccggaacgggtccctcccgggtcccccttacgggttacctacccgttaccgttccccggttcccccgtccccgttaccccg

SEQ ID NO: 154146 - DNA, 754 bp, Homo sapiens
  misc_feature: GYAE6OF01CPWX1.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactcggaaccngcagtgtactttgtgcttaataactatgtctccgtggtaccagccaccaccagaaccaaacgacccctaaactcctttgttttgacgtcagtacgccgcctcgagtactccgtgtacttccggttctcgtcgcctacgaagtcgtacggaccaacgaccggtccctcccgtcgtacccgttccgtcgtcgggtccctaccggacggtccgtggaacgggtattacggacggtacttaggtactttaaccgtcgtcgaccgtaacggtccgaacttaagttaccgttaccggtaacccggtacccccgtaagggttacgggggtttcgggtttacccggggaccggggttaaccggggttaacggttaaacggggttcccggttaaccccgggttccgggttaccggggttaacccgaaccgggtaccccggtaacgggtcccgttacccccgggtccccccggttcggttaccccgtacccgttccccgtttaccccgttccccccgttaccccgtttacccccg

SEQ ID NO: 154147 - DNA, 743 bp, Homo sapiens
  misc_feature: GYAE6OF01ASX6M.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccagcagtgactttgtgcttaataactatgtctcctgtaccagccaccaccaggaccaaaccgcccccctaaacttccttttgttttcgacggttcaagtaacgccggtccctcgaggtacgttcccctagtacgttccggttctccgtcgtccccttaccgaagtccgtaggacccaaaccgtaccgggtccccttcccgtcggtaccccggttcgttccgtccggggtccttcccggagggtccgttacggggaacggtacgttacgggaacgggtccgttaggtaacgtttaacctacgttcggaccgtacggccgtactaagtttaccgttaccggaaccggtaccccgtaacgggtaggggtttcggtttcgggacgggtcgggtaacgtaacgggtccggtaacccggttcggacgggtaccgaccggtacccggtaacggtcccgttcccggtccccccgttcgggtaccctacccgttcccgttacccgttccccctaccccgttccccg

SEQ ID NO: 154148 - DNA, 545 bp, Homo sapiens
  misc_feature: GYAE6OF01DRUO9.10.38.D05.1.454.CMB.1.raw
  modified_base (320)..(320): a, c, t, g, unknown or other
  misc_feature (320)..(320): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccagcagtgtactttgtgcttataactatgtctcctggtaccagcaccaccaggacaaacgccccaaactccttgttttgagtcagtacgcgcctnagtactcctgatcggttctctgcctcaagtctgcaaccgccggccctccgtgacccgtctcgtcgggctccgaggctaggaggatgacggctgtaattactacgtgcagccatatactcgaccggaccctaggtagggttgttcggcggtcggaacgtaggtcgaccgtccgtaggtccacgccacggctccgcccctgtaccnctcctcgttcccncccgtccc

SEQ ID NO: 154149 - DNA, 577 bp, Homo sapiens
  misc_feature: GYAE6OF01B6KCI.10.38.D05.1.454.CMB.1.raw
  modified_base (366)..(366): a, c, t, g, unknown or other
  misc_feature (366)..(366): n is a, c, g, or t
  modified_base (475)..(475): a, c, t, g, unknown or other
  misc_feature (475)..(475): n is a, c, g, or t
  modified_base (514)..(514): a, c, t, g, unknown or other
  misc_feature (514)..(514): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctctgggttcagcatcagtaacgactacatcgaccgtcgggccccgccgacggctccgaggggaaggggcgtgggagtgggtttcatactatttactcctagtggtnataccatatactacgcagactctgtaggaacgggccgtattccaaccatcctaccgaaggggacaaccggaccaaagaaccctcactgtacctttgacaaatcgaaccncctgcgacgccggagaccacggtcctatacttacgtgtnacgacgaacttacccgtcggtccttagtttacttacgtnacncggttggacccgaggtacccg

SEQ ID NO: 154150 - DNA, 715 bp, Homo sapiens
  misc_feature: GYAE6OF01AI4FE.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagccaccacccaggaccaaacgccccctaaacttccctttgttttgaggtcaaggtaacgccggtccctcgaggtacgtcccctaggtacgttccggttctcgtcgtcccttaccgaagtcgtacggaccaaaccgccggtcccttcccgtacgtacccgttctccggtcgggtcctcccgagggtcctagggacgagtcggaggtccgtagtaacttacgtacgttggccgagtccgactactacgttccgaaccgggtaccccctaaggtcgggggttacggtttcggggaccgggtacggggtacgtaacggggtccggtacccggttaccgggtacggggttccgaaccggtaccccggaacggggtcccttacccgggtccccccgttacgggtaccccttacggttccccgtttaccccggttcccccgtccccttaccccgg

SEQ ID NO: 154151 - DNA, 543 bp, Homo sapiens
  misc_feature: GYAE6OF01BVKXY.10.38.D05.1.454.CMB.1.raw
  modified_base (277)..(277): a, c, t, g, unknown or other
  misc_feature (277)..(277): n is a, c, g, or t
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (490)..(490): a, c, t, g, unknown or other
  misc_feature (490)..(490): n is a, c, g, or t
  modified_base (541)..(541): a, c, t, g, unknown or other
  misc_feature (541)..(541): n is a, c, g, or t
tcagcatagtagtgcacgaccggtgctcgatttagtatctgatagttgggtttgggggctctgctcctcctcaccctcctcactcagggcacagggtcctgggcccagtctgccttgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctnaggagtcctgatcggttctctgcctcaagtctggcaacacggcctcctgacccgtctctgggcctccaggctgagntggaggctgacttactactgcngcgcatattcgacggaccccaagtagggttgtttcgggcggtacgggactaagggtcgaccgtccgtgggtccacgcccgaacggctcgccccgtcggtccactctccgttcccnccctcctccactctacgtcgctggcggcggcgtggacgtacggcacgatgncg

SEQ ID NO: 154152 - DNA, 584 bp, Homo sapiens
  misc_feature: GYAE6OF01BP17O.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactccttgttttgaggtcagtaagcggccctcgaggactccctgatccggttctctcgcctccaagtctggacaacgacggccctcccgtgtacccgtctcgtcgggcctccgaggtcctggaggtatggacggtctggatttacgtaacgtgcgaggccgcatacttcgaacggcccctaagacgggttgtttcgggcgggcgggtacgtagggtcgaccggtccgtgggtcgacgtcccgaaacgggcctcggccccctcggtcctacctcctccgttccccaccccgttccc

SEQ ID NO: 154153 - DNA, 327 bp, Homo sapiens
  misc_feature: GYAE6OF01CO6S8.10.38.D05.1.454.CMB.1.raw
  modified_base (320)..(327): a, c, t, g, unknown or other
  misc_feature (320)..(327): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctcggtcactctgttcccgccctcctccactactatgctgagcgggctggcaaggcgcatagnnnnnnnn

SEQ ID NO: 154154 - DNA, 760 bp, Homo sapiens
  misc_feature: GYAE6OF01CTDTZ.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattcaaaaggtgtccactgtgaggttcaactggtcggagactggaggaggcctggtataccaggtccgtggggggtccctggacgactcgtcctgtgcacgcctcgtggtcagctagtcaagtaacgtctacatcgaccgtcgggccccgaccgtaggtcctacggtaacggggaacgggtccgtagggtaggttcgggtacctcggttaacggttaacgttacggaaaccgtaggtacgttacggtacctaacgtaacgtaacgttaagttttaactcgttaacggtaccgtttcccgggtaaggtaaccgggtccccggttactaaccccgttcgtaccgaacgggtaacctacccgtaaccgtttacccgaaaacttaaccgtatttacccgttagtaaccttcccgttaaccgaaaccgtagttccgtaacgtaaaccttaacgtccgtaaggtaccgtaacgggtaccctaaccggaaccgtaccgtccgtaaacccgttagttttccgtacggtccgaaccgtccaaagttaacgtcggaacccttaccggtactaccgtaaggttcccgtggggaaccctcggggacc

SEQ ID NO: 154155 - DNA, 656 bp, Homo sapiens
  misc_feature: GYAE6OF01D2T36.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgtacttttgtgcttaataactatgtctcctgtaccagcaccaccagacaaacgccccaaacttcttgttttgagtcagtacgcgcctgaggacgtcctgtagtcgttctctcgcctacagtctgacaacgcgcctccctcgccgtctcgtcggcctccgaggtctaggaggtagtggagtcgtagtacttactacgtgacacgcactatacttccgaaccggtaccccgtaaggtggggttcggtttcggggaccgggtaccggggtacgttaacggggtccggtaccccggttccgggtaccgggttaccgaaccggaccccggtaaacgggtccccgttaccccgggtacccccccgttccgggttacccgtaccctttcccggtttaccccgtttcccccccgtacccccgttacccccg

SEQ ID NO: 154156 - DNA, 786 bp, Homo sapiens
  misc_feature: GYAE6OF01C2UXK.10.38.D05.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctcgcgtccggtctccgtggacngtcagtcaccatctcctgcactggaacccngctagtgtacttttgtacgcttaataactatcggtacctccgtggtaccagtccaaccaccaggacaaacgtccccctaaattcctttgttttacgacggttacagtaacgccggtcctcgacggtacgtcctgacttcggttctacgtcgtccctaccgtaagtccgtacggacctaaccgtacccggtccctcccgttagacccgttccgttaccggtacgggtccttacccggtacggtccgttacgggaacggtacgttacgggacggttccgttacgtaaccgttttaccgtaccggttcgacccgtagacccggtactaacgttccgttaccggaacccggaccccgttaaaggtcgggggtttacttaccgggggaccggttaaccgggtaacgtttaaccggggtccgtaaccccgggttccggtttacggggtacccgtaaccggtacccggtaaacggtccccggttacccggtaccccccgtttagggtccccttaacccggttccggtttaccccccggttaccccgttaaccccgtttacccccg

SEQ ID NO: 154157 - DNA, 670 bp, Homo sapiens
  misc_feature: GYAE6OF01CQCRP.10.38.D05.1.454.CMB.1.raw
  modified_base (272)..(272): a, c, t, g, unknown or other
  misc_feature (272)..(272): n is a, c, g, or t
  modified_base (458)..(458): a, c, t, g, unknown or other
  misc_feature (458)..(458): n is a, c, g, or t
  modified_base (499)..(499): a, c, t, g, unknown or other
  misc_feature (499)..(499): n is a, c, g, or t
  modified_base (595)..(595): a, c, t, g, unknown or other
  misc_feature (595)..(595): n is a, c, g, or t
  modified_base (610)..(610): a, c, t, g, unknown or other
  misc_feature (610)..(610): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcttgggttttccttgttgcttatttacaaaaggtgtccactgtgaggttcaacgtggtggagacgtggaggaggctggatccgaggccgtcgggggtccctgacgtcctcctccgtggtcgacncgtcctcgtcgggttcagcatacaagtaaccgactaacatacgaccgtcgggccccgaccgacggtccaccggaaggggaacgggtcgtgggacggtgggtcctagtagttaagtacgaaacagtagtcggactaactactagttaattacgtgtacgtaccgtcggtaggaacggtcccgtaccnccttacacgaagacgtacctacccgtaaccaaacgtacctnttacgttacttacttacctaccaactatacgtacaaacctagttaccgaagacggacgtacccgaacgaaccgaccgtacctaacctttattacgngtacgccgaccgtanacgtcgtaaaccgtactcttaacgtaacgtccgggacggggacccgtaagggtacccccg

SEQ ID NO: 154158 - DNA, 710 bp, Homo sapiens
  misc_feature: GYAE6OF01CK4O2.10.38.D05.1.454.CMB.1.raw
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
tcagcatagtagtgcacgaccggtgctcgatttagtatctgataggttgggttggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatcctcctgcactggaaccngcagtntactttgtgcttaanactatgtctctgtacngcaccaccagccaaacgccccctaactcctttgtttcgngtcagtacgccggtcctcaggtactcctgacttcgtctctcgcctacgagtccgtagaccaaccgaccggtccctcccgtacgtacccgttcgtcgtacgggtcctacccggaggtccgtacgggaacggttacgtcgggtaacggtcgttacgtaacgttttaaccgtacgttcggacctaacggtcccgtaattaacgtttaaccgtttaccccggaaccggtaaccccccgaaagggttacgggggtttcggttacggggaccgggtacggggtaccgttaacggggtccggtacccggttccggtcgggtacccgacggtaccccggaacggtcccgtccccggtacccccgtcggtccctacccttccgtaccccgtttcccccgacccctttacccg

SEQ ID NO: 154159 - DNA, 662 bp, Homo sapiens
  misc_feature: GYAE6OF01BJYGJ.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgtactttgtgcttaataactatgtctccgtggtaccagccaaccaccaggaccaaaccgaccccctaaacttcctttgttttgaggtcagtaacgccgcctagaggactcctgacttcggttctctcgcctacgtaacgtctacggaccaacgccggtccctcccgtcgacccgtctcgtcgggcctaccggaggtcgtaggaggtacgtggacggtctagtacttactacgtgactacgcgtactattaccgttcgaaccggtacccgtaaaggtcggggttcggtttacggggaccgggtacggggtaacgttaacgggtccgtaccgttcccggagggtaccacggtaccccgaagggtcccgtcccggtccccccgtaggttccctacccgtttccgttaccccgtccccctccccgttacccg

SEQ ID NO: 154160 - DNA, 714 bp, Homo sapiens
  misc_feature: GYAE6OF01BMH7R.10.38.D05.1.454.CMB.1.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctcgccctgactcacgcctccctcgccggtccgggtctccgtggacagtcagtccacnctctcctgcacgtacggaaccagctagtctactttgtatcttaataacttntcgtctactacggtaccagaccaaccaccgaggacctaaaccgaccccctaaacctttccgttttaggtttttacggacggttacctaaggttaaccgccggtaccctacgagggtaccgtcccgttgtacgtttccggttctccgtcgaccttacgtaacgtcgtacggaaccaaacggtccggcccctacgtcgtaccgtctacggtcggacctaccgaggtcgtaggacgtagtggtacgagttacgtaacgttaactacgtcgactacggtactacgtactactacggaaccgtaaccccgtaagggtcgggttcggttacggacgggaccggtaggtaacggtccgtaaccggtcgtacggccgaaccggtacccggacggtcccgtacccggccccgttacgtcccttaccgttcccttacccggtcccctcccgttacccg

SEQ ID NO: 154161 - DNA, 466 bp, Homo sapiens
  misc_feature: GYAE6OF01ELF7F.10.38.D05.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (447)..(466): a, c, t, g, unknown or other
  misc_feature (447)..(466): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctnaggagtccctgatcggttctctgcctccaagtctggcaacncggcctcctgaccgtctctgggctccaggctgaggatgaggctgattactactgcagcgcatatcaggccccaagagggtgtttggcggcggacgtaaggtcgaccgtcgtgggtcaggcccaaggctcgcccctcggtcactctcgttcccnccctcctccactactatcgctgacgcgggntcggcaaggcgcanagnnnnnnnnnnnnnnnnnnnn

SEQ ID NO: 154162 - DNA, 633 bp, Homo sapiens
  misc_feature: GYAE6OF01D6AAJ.10.38.D05.1.454.CMB.1.raw
  modified_base (360)..(360): a, c, t, g, unknown or other
  misc_feature (360)..(360): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatcgacctcgggcccgccgaggcctaccgaggggaacggggcgtgggaggtgggtctcgagttatagaaacngatggacacgtacatattattctgtactccggtaggaacgggcccggttacaccctcgtaccacgacgactaaccttacccaaccaaactacttcttacgttacttccttaccactactcgaccaactaactcgtagtaaggaacgtccggaaccgaaccgaccggtaccccgtaccttaattacgttcgtacggtaccgacggtaacagtacgtaaccgtaccgtaccgttctaaacgttcccggtacgggggcccgaacggggtaacccgg

SEQ ID NO: 154163 - DNA, 471 bp, Homo sapiens
  misc_feature: GYAE6OF01D1GBC.10.38.D05.1.454.CMB.1.raw
  modified_base (307)..(307): a, c, t, g, unknown or other
  misc_feature (307)..(307): n is a, c, g, or t
  modified_base (446)..(471): a, c, t, g, unknown or other
  misc_feature (446)..(471): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattacactgcagcncatattcaggccccaaagagggtgttggcggcgggactaaggtgaccgtctgggtcagcccaaggctcgcccctggtcactctcgttcccgccctcctccactactatgctggacgcgggctcggcgtaggcgcatagnnnnnnnnnnnnnnnnnnnnnnnnnn

SEQ ID NO: 154164 - DNA, 729 bp, Homo sapiens
  misc_feature: GYAE6OF01DCFQ5.10.38.D05.1.454.CMB.1.raw
  modified_base (249)..(249): a, c, t, g, unknown or other
  misc_feature (249)..(249): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacttttgtgcttanaactatgtctcctggtaccagcaccaccaggacaaacgcccccaaattccttgttttgacgtcagtaacgccgcctcgagtcgtcctgactcggttctcgtcgcctcctaacgtcgtggaccaaacgaccggtccctcccgtcgtacccgttcctcggtcgggtcctaccgagggtccgtagggaaggtacgtcggacgggtcttaaggacttttaaccgtacgtcggacgagtccggactaatttaacgttccgaaacccgggacccctaaacggttacggggtttacggtttcggggacggggtaaaggggtaccgttaacgggggttaccgtaacccgggttcccggttagggggtaccgtaaaccggaccccggtaaaacggggtccccgttccccgggttacccccccgttacggggtaccccttaacccggtttcccgtttacccgggttccccccgtcccccgtttacccccg

SEQ ID NO: 154165 - DNA, 583 bp, Homo sapiens
  misc_feature: GYAE6OF01AB3OX.10.38.D05.1.454.CMB.1.raw
  modified_base (227)..(227): a, c, t, g, unknown or other
  misc_feature (227)..(227): n is a, c, g, or t
  modified_base (411)..(411): a, c, t, g, unknown or other
  misc_feature (411)..(411): n is a, c, g, or t
  modified_base (439)..(439): a, c, t, g, unknown or other
  misc_feature (439)..(439): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttatactatgtctcctggtaccagccaccacccaggtccaaacgccccccaaacttcctttgtttttgaggtcagtaagcggaccctcgaggactccctgatcggttctctgcctcaagtctggacaacacggcctccctgacccgtctcgtgggctccgaggctgagntgaggtctgtattactacgtgcagccgnatactcgaacgccccaagtagggttcgttcgggcggtcgggactaacgggtcgacccgttccgtgggtaccgacgccccgtaaggcccttccggtaccccccgttcggtacctacccgttcgtccgttcccccgccccttcccg

SEQ ID NO: 154166 - DNA, 618 bp, Homo sapiens
  misc_feature: GYAE6OF01ARP7K.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcgtgggttttccgttgttaggctatttcaaaaggtgtccactgtgaggttcaactggtggagacgtggaggaggctggatccagccgtggggggtccctgagactctcctgtgcagcctctgggttcagcatcagtaacgactacatgacctcgggcccgccaggctccgaggggaacggggctgggagtgggtctcgagttagtagaaacagatggcactactattacttattctgtaccgtcgtaggaacgggtccgtccacccgtctaccgagacgaccctacttaccgaactaactactccgtttgtacttcgtttaccaactattcgaccaactagttcagggaataccggtccggaaaccaccgtaccggacccctaaccttagtttacgttcgtccggcgtaccggaactgtacccgtacttaaccgtcttaactaacgtttccgggtagggggaccctacgggg

SEQ ID NO: 154167 - DNA, 731 bp, Homo sapiens
  misc_feature: GYAE6OF01CS7V8.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcagtcaccatctcctgcactggaaccngcagtgtacttttgtgcttaataactatcgtctccgtggtaccacgccaccacccaggaccaaaccgacccccaaacttccgtttgttttagacggtcaagtaacgccggtcccgtcggggtccctgactcgtcttctcgtcgctaccgaagtcgtcggacaaccgaccggtccctcccgtgaacctacttccgtccgtacggcccttaccgacgtcccgtagggaacggtacgtacggtaacgggtcttaaggttaacttttaacgttaaccgtttggttacgtaccttactaagttacgtcggtacggtacgggtacccgggttacccggttcgggtttggggttcgggttaccgggacggggtacggaacccgtaaggtccgtaccgggtacccggttaccggtacggtacccgaccggaaccccggtaacggtcccgttaccccggtccccccggtttacgggtccctacccgttcccggttccccggttcccccccg

SEQ ID NO: 154168 - DNA, 329 bp, Homo sapiens
  misc_feature: GYAE6OF01D98TX.10.38.D05.1.454.CMB.1.raw
  modified_base (325)..(329): a, c, t, g, unknown or other
  misc_feature (325)..(329): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtcgaccgtccgtggtcagcccaaggcctcgcccctcggtcactctcgttccccgccctcctccactactatgctgagcgggctggcaaggcgcatagnnnnn

SEQ ID NO: 154169 - DNA, 584 bp, Homo sapiens
  misc_feature: GYAE6OF01C3KSV.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatgacccgtgggccccgccaggctccgaggggaaggggctgggagtgggtctcgtagttattagaaacagatggacactacattattatctagactcgtaggaacgggtccgttaccaccctctaccgagaacgacaccttacccaaacaactattccttagtacttcttacactatcgaccaactaatcgtagagacgtcgaaccgaccaccggccaaccttattacgtgtcgcgtacgactagtcgaacctaccgactacgtaactttcggcggggacccgaggggtacccgg

SEQ ID NO: 154170 - DNA, 870 bp, Homo sapiens
  misc_feature: GYAE6OF01D9OTR.10.38.D05.1.454.CMB.1.raw
  modified_base (230)..(230): a, c, t, g, unknown or other
  misc_feature (230)..(230): n is a, c, g, or t
  modified_base (857)..(857): a, c, t, g, unknown or other
  misc_feature (857)..(857): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcacgcctccctccgcgtccggtctcctggacagtcagtcaccatctcctgcactggaaccngcagtgtacttttgttgactttaataacttatcgtcctccgtacggtaccagccaacccaacccgacggaacctaaaaccgaccccccctaaaactttccgttttacggttttttacggaacgggttacctaacgggttaaaccggcccgggtacccccttacgtaacggggtaccgttaccccgttaggtaaccgtttcccgggttttcctccgttaccggtaccccttacccggtaaacggttcccgtaacggggaccctaaaacccggtacccgggtccccttacccccgtacgggttaacccccgtttcgtttacccggtccggggtacccttacccggtacggggtcccttaagggaacgggtacgttcgggtaacgggtacttacgggtaaacttttaccgtaacgttcgaccgtacggaccgtatacgttacgtacgaaccggtaccccgtaaggttacggggtttggtttacggggaccgggtacggggtaacgttaacggggtacccgtaccgggttaccggttacggggtaccgtaaccggaccccgtaacgggtccgttaccccggccccgttaacccgggtcccttaacccgttccgttcccccggtttaccccnccccgttaccccg

SEQ ID NO: 154171 - DNA, 669 bp, Homo sapiens
  misc_feature: GYAE6OF01BR9NA.10.38.D05.1.454.CMB.1.raw
  modified_base (665)..(665): a, c, t, g, unknown or other
  misc_feature (665)..(665): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctctggtaccagcaccacccaggcaaacgcccccaaactccttgttttgaggtcaagtaacgcggcccctcaggacgtccctgactcggttctctgcctccaagtctggcaacgacggcctcctcgaccgtctcgtgggcctccgaggctggaggatggaggtctggtaactttactacgtcgacacggccgctaattacgttaccgaccgggacccccgtaacggttacgggggtttcggtttacggggccggggtaccggggtaaccgttaacggggttacggtacccggtccggttcggggtaccgtaccggacccggtaaggtcccggtccgtccccccggttcgggtacccttaccgttccgttccgttaccccctaccccgttccctaccctaccgttacctacgtcgtcgtaggacggtccgggtcgtcggacgacggtcgacacgtgngtcg

SEQ ID NO: 154172 - DNA, 355 bp, Homo sapiens
  misc_feature: GYAE6OF01BR02Y.10.38.D05.1.454.CMB.1.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (326)..(326): a, c, t, g, unknown or other
  misc_feature (326)..(326): n is a, c, g, or t
  modified_base (330)..(355): a, c, t, g, unknown or other
  misc_feature (330)..(355): n is a, c, g, or t
tcagcatagtagtgcacgaccggtgctcgatttagtatctgataggttgggtttgggaacctagtgaacattctggtaggggccacgtgtcttcgtccacggtgctcccttcatgcgtgacctggcaacacggcctccctgacccgtctctgggctccaggctgaggtatgaggctgaattactactgcagcgcatattcaggcccaacngggtnttggcgcggactaaggngacgtctgggcagccaaggcctcgcccctggtcgactcctcgttcccgcctacctcctactactatcgctgaggcggctggcaacggcgcatancagnnnnnnnnnnnnnnnnnnnnnnnnnn

SEQ ID NO: 154173 - DNA, 761 bp, Homo sapiens
  misc_feature: GYAE6OF01CLSDI.10.38.D05.1.454.CMB.1.raw
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (569)..(569): a, c, t, g, unknown or other
  misc_feature (569)..(569): n is a, c, g, or t
tcagcatagtagtgcacgaccggtgctcgatttagtatctgatagttgggtttgggggggtctcaggaggcagcgctctcaggacgtcaccaccatcggcctgggctctgctcctcctcaccctcctcactcgagggccacgacgggtcctcgggccctagtctcgccctgacctcacgccctccgtccgcgtccggtctccgngacngtcacgtccactactcctcgtagcctacgtacggaaccngacgtaggtacgttacgtttcggtacgtacctttaaacgtaacgttacgtccgttccgtacgtacggtaaccacgtaacccacccgaccgtaacggacctaaccgtacccctaacgtttcgttttaggtttacggacgtacgtaacggtaccggccgtcccgtagacggtacccgttccgtaggttaccgttcggttctccgtaccgtccgtaacgtacgtcggtacgacccaaccggtccggtccctccgtacgtccgttgccgtgggccctacggacgtccgtaggacggtacgtcggacgttacgtaagtccgttaacnggtaccgagacccgtacgtacgttacgttaccgtacggaccccggttacggacggttaggggtccgttacggggaccggtaaggtacggtacggtccggaccggtccggttggaacccgtcggacccgtacggtcccggtcccgacccgttcggtaaccttcggtacccttaccgtcccccgtccgtacccg

SEQ ID NO: 154174 - DNA, 817 bp, Homo sapiens
  misc_feature: GYAE6OF01CHXEY.10.38.D05.1.454.CMB.1.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
tcagcatagtagtgcacgaccggtgctcgatttagtatctgatagttgggggtttggggggggtctcagggaggcagcgctctcaggacgtcaccaccatggcctgggctctgctcctcctcaccctcctcactcagggcacagggtcctgggcccagtcctgccctgactcacgccctcccgtccgccgtccgggtctccgtggacagtcagtcacntctcctgcacgtggaaccngcagtgtacttttgtcgtactttaataacttatcggttccttccgtcggtaaccagacccaacccgacccgaaggaccaaaaccgtacccccctaaaactttccgttttaggttttttacgaacggttaccgtaaagttaacggccggtccccgtacgaacgggtaaccgtcccttaggtacgttccggttctccgtcgaccctacgtaagtctcggtaaccaaaccgccggtcccttaccctcggtacccgttcctaccgggtcggtcccgttaccggacgggtcgttacggaacggttactacggggaaggttcttaaacggtaactttaaccgtaaccggttgacccgtaacgggtcctaacgttaatttaaccgtccggaaacccggtaacccccggtaaggttaacggggtttcgggtttaccggggaaccggggtaccgggttaacggttaaccggtcggttaaccccgttccgggtaggggtacccaccggggtaacccacgggttccctaccccggtacccccgttaggtcccttaacgtcccttaccccggttacccctccgttaaccccc

SEQ ID NO: 154175 - DNA, 469 bp, Homo sapiens
  misc_feature: GYAE6OF01CU7Y0.10.38.D05.1.454.CMB.1.raw
  modified_base (261)..(261): a, c, t, g, unknown or other
  misc_feature (261)..(261): n is a, c, g, or t
  modified_base (450)..(450): a, c, t, g, unknown or other
  misc_feature (450)..(450): n is a, c, g, or t
  modified_base (456)..(469): a, c, t, g, unknown or other
  misc_feature (456)..(469): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgttttgaggtcagtaagcggccctcaggatccctgatcggttctctgcctccaagtctggcaacacggcctcctgaccgtntctggctccaggctgaggatgaggctgattactactgcagcgcaatacttcacggacccctaacgagggttgttgggcggcgggtactaaggtcgaccgtccgtgggtcacgcccgaaggctcgcccctggtcacgtctcgtcccaccctcctccactactatcgctggacggcggcgtcggcacggcncatagnnnnnnnnnnnnnn

SEQ ID NO: 154176 - DNA, 666 bp, Homo sapiens
  misc_feature: GYAE6OF01AP53J.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtggggggtccctgagactctcctgtgcagcctcgtgggtcagcatcagtaacgactacatgaccgtcgggccccgccgaggcctccgaagggggaaggggcgtgggaggtgggtctacgtaggtttaattaggaaacaggaagtcggactaactactaattaatttattctagtaccgttccggtaggtacgggtcccggttccacccctctaccagacgacctaccttaccaaacaactattcttagtacttcttccactatcgacaactaattcgaggtaacgacgtaccgaaccgaccgaacccgggtccctaaacccgttagtttacgttacggtacggaccgtcccggtaactaaggttccggtaacccttacccggtccttaaccgttaacgtttccgggtacgggggacccgaagggggtaacccccgg

SEQ ID NO: 154177 - DNA, 757 bp, Homo sapiens
  misc_feature: GYAE6OF01CX80F.10.38.D05.1.454.CMB.1.raw
  modified_base (235)..(235): a, c, t, g, unknown or other
  misc_feature (235)..(235): n is a, c, g, or t
  modified_base (265)..(265): a, c, t, g, unknown or other
  misc_feature (265)..(265): n is a, c, g, or t
tcagcatagtagtgcacgaccggtgctcgatttagtatctgataggttggggtttggggggggtctcaggaggcagcgctctcaggacgtcaccaccatggcctgggctctgctcctcctcaccctcctcactcagggcacgagggtcctgggcccagtctgccctgactcacgccctccctccgcgtccggtctccgtggacagtcagtcaccatctcctgcacgtaggaaccngctagtgtactttgtcgtacttaataactntcgtctcgtaggtaccagccaaccaccgaggaccaaaccgcccctaaacttccgtttgttttacgacgtacaggtaacgccggtaccctagacggtacgtccctaggtacgttccggttctccgtcgtaccctacgaagtcctacggaccaaccgccgtccctaccgtcgtaccgtcctcggtcggtcctaccgaggtctaggagtacgtggacgtcgtagtaacttacgtacgtgacgtacgccgtactagttaccgttccggaacccggtacccgtaagggttacggggttcggttacggggaccggggtaaccgggtaaccggttaacgggtacccggttacccggtaccgggttacggggttacccgacccgggtaaccccggtaacgggttccccggttaacccccggttcccccgggtttacccggtacccgtttacccgttcccggtttaccccccggttccccccgtcccccgtttaacccccg

SEQ ID NO: 154178 - DNA, 599 bp, Homo sapiens
  misc_feature: GYAE6OF01BWEAD.10.38.D05.1.454.CMB.1.raw
  modified_base (355)..(355): a, c, t, g, unknown or other
  misc_feature (355)..(355): n is a, c, g, or t
  modified_base (469)..(469): a, c, t, g, unknown or other
  misc_feature (469)..(469): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaagtgtccactgtgaggttcaactggtggagactggaggaggctggatccagccgtgggggtccctgagactctcctgtgcagcctctgggttcagcatcagtaacgactacatcgacctcgggcccgccgaggcctaccggaggggaaggggctggaggtggtctcgagttagtagaaacngatggcactacatattatctgtactcgtaggaacgggtccgttacaccctctaccgagacgacctacttaccccaaactaacacttcttgtaattccttcactactgaccctanaacttctaggacgtagtccgaaccgtaccgaccggaccctaacttagttacgttacggtcgaccgtcgaacctagtacgtacctaccgtactacctaacgttccggacggggaccgtacgggggaacccg

SEQ ID NO: 154179 - DNA, 769 bp, Homo sapiens
  misc_feature: GYAE6OF01CJSKQ.10.38.D05.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatctcctgcactcggaacagcagtntactttgtnacttanaactatcgtctccgtggtaccagaccaccaccgagacaaacgcccctaaacttccgtttgttttgagtcaagtaacgccgcctgaggacgtccgtgacttcggttctcgtcgcctaccaagtctcggaccaaccgaccggtccctcccgtagacccgttcgtcgtcgggcctccgacggcgttaggacggtagtaggacgtccgttaagtacgttaacctacgttcgacgacgaccgtactaagttaccgttaccgaaaccgggtaaccccctaaacgggttacggggtttacggggtttacggggacccgggggttaacccgggtaacgttaaaaccggggttcccgtaaccccggggttacccggtttacgggggaccccgtaaaccggggtacccccgtaaaacggggtccccggttaccccgggtccccccccgttacggggttaaccccttaaccccggtttccccggttaccccccggttttccccccggtaccccccgtttaaccccccg

SEQ ID NO: 154180 - DNA, 783 bp, Homo sapiens
  misc_feature: GYAE6OF01D7P5T.10.38.D05.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
tcagcatagtagtgcacgaccggtgctcgatttagtatctgatagttggggtttggggggggtctcaggaggcagcgctctcaggacgtcaccaccatggcctgggctctgcctcctcctcaccctcctcactcgagggcacgacgggtcctgggcccagtctcgccctgactcacgtccctcccgtcgccgtccgggtctcgtggacngtcagtccaccntctctgccacgtggaaccagcgtagtcgtactttgtntacttaataacttatcgtcctccgtacggtaccagaccaaccaacccgaggaccaaaccgaccccctaaactttccgtttaggtttttacggacggttaccgaaggttaaccgccggtcccctaggaacggtcttcccgtaggtacgttccggttctacgtccgtcctacgtaacgtcgtcggacctaaccgaccggtcctcccgtcgaccgttcgtcggtcggtaccgtccgacggtctagggacgacgttggaacgtctacgtaacttacgtacgtcgacgtacgccgtacgtactttaccgtaccgtaaccggtaaccccgtaaacgggtcgggggttacggttaccggggacggggttaaccgggtaacggttaaaccgggtccgggtaccccgggttaccggtacggggttacccgacccgggtacccggtaaccgggtcccgttaccccgggttccccgtcggttaaccccgtaccgtttccccgtttcccggttaccccccctcccggtttaaccccc

SEQ ID NO: 154181 - DNA, 787 bp, Homo sapiens
  misc_feature: GYAE6OF01A6VG1.10.38.D05.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccntctcctgcactggaaccagcagtgtacttttgttgactttaataacttatcgtcctccgttacggtaccagaccaaccacccgaacggaccaaaaccgtacccccctaaaactttccgttttagtttttaggacggttacaaggtaacgccggtaccctcgacggtacgttcccgtgacgtttcggttcctcgtccgtcctaccgtaagttccgtacgggacctaaccggacccggtcccctttcccgtacggtaaccccgttcgtccgggtacgggcccttaccggacggtccgtagggtaacggtacttacgggaacggttcgttagttaacgtttaccgtaacgtcgaccgacgtccgtaacgttaacgttaccgttaccggaacccggtaccccgtaaaggggttacggggtttcggtttaccggggaccgggtaacggggtaacgttaacgggtccgtaacccggttccgggtacgggacccgaccggacccgtaacgggtccccttacccggtccccccgtggtacccgtccgtttacccgtaccccggttcccccgtcccttaccccg

SEQ ID NO: 154182 - DNA, 564 bp, Homo sapiens
  misc_feature: GYAE6OF01AQBKF.10.38.D05.1.454.CMB.1.raw
  modified_base (243)..(243): a, c, t, g, unknown or other
  misc_feature (243)..(243): n is a, c, g, or t
  modified_base (421)..(421): a, c, t, g, unknown or other
  misc_feature (421)..(421): n is a, c, g, or t
  modified_base (482)..(482): a, c, t, g, unknown or other
  misc_feature (482)..(482): n is a, c, g, or t
  modified_base (526)..(526): a, c, t, g, unknown or other
  misc_feature (526)..(526): n is a, c, g, or t
tcagcatagtagtgcacgaccggtgctcgatttagtatctgatagctgggttttccttgttgctatttcaaaaggtgtccactgtgaggttcaactggtggagaccggaggaggctggatccagcctggggggtccctgagactctcctgtgcagcctctgggttcagcatcagtaacgactacatgacctgggcccgccaggctccagggaaggggctggagtgggtctcagttatgaaacngatggcactacatattatctgactccgtgaacgggccgttcaccctctccagacgacacttaccaacaacattccttgtacttcttcaacatcgacacaatctagacgagtcgacgacaccggccacttattactgtcgcgcgacatcgactacgctacaattcgtgggccagggacncccgaggtccaccgtcctccccagcctaccaccgaacggcccagtccggtcccttccccgngcccgccctcgcctccgacggacgacctacccgtacgacggacnccgacgaccggtccggcccgtgggcctcggccgtacgg

SEQ ID NO: 154183 - DNA, 713 bp, Homo sapiens
  misc_feature: GYAE6OF01DH1BF.10.38.D05.1.454.CMB.1.raw
  modified_base (269)..(269): a, c, t, g, unknown or other
  misc_feature (269)..(269): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtcctgagactctcctgtgcagcctcgtgggttcngcatcaagtaacgactacatcgacccgtggggccccgccgacggcctaccgaagggggaacggggctggggaggtcgggttctcgaagtttagttagaaaacaggacgtaggctaaccgttaacatttaatttacttcgtaggtaccgttccggtacgggtaaacggggtccccggttacctacccccgttccgtaccaaggtaaccgaacctacccgtttaaccccaaaactaaacgtacttccgtttagtaacttcctttacaaacctgttacgacctaaactaacgttccgtagaacggttaccgtacggtaacccgaaccgtacccggaccctaaacccgtttaagtttacgtcggtacgacccgggtacaaccgttagtcgtaaacccttacggcccttataaacggttccgacggggggtcccgaacggggtaccccg

SEQ ID NO: 154184 - DNA, 748 bp, Homo sapiens
  misc_feature: GYAE6OF01DLGOC.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctctgcactcggaaccngcagtgtacttttgtgtacttaataactatgtcctccgtaggtaccagccaccacccgaggaccaaaccgcccccctaaaactttccgttttgtttttacggacggttacaaggttaacggcccgggtcccttacgaacgggtacgttcccgtagtaaccgttccggttccttccgtcgaccccttaccgaaaggttccgtacgggaaccaaccggacccggtcccctccccgttacggtacccgttcgttcggtcgggtccttaccgacggtcgttaggacggtagtcgggacgtctaggtacttaccgagttcgacgacgtcgtactaacgttactaccgaaccgtaccccgtaaaggttcgggggtttacggttacgggccgggtaccgggtaacgttacggggtaccgtacccggtccggttagggaccgtaccgggacccggtaacggcctccccgggtaccccctacgggttccctacgttcccgttaccccggtccccctcccgttaccccg

SEQ ID NO: 154185 - DNA, 654 bp, Homo sapiens
  misc_feature: GYAE6OF01BUEJ1.10.38.D05.1.454.CMB.1.raw
  modified_base (629)..(654): a, c, t, g, unknown or other
  misc_feature (629)..(654): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaacttccttgtttttgaggtcagtaacgccggccctcaggacgtccctgacttccggttctctgccctaccaagtctggaccaacgaccggccctaccctgacccgtctcgtcgggcctccgaggctaggaggagtggacggtctaggtaactttacctacgtggacaggccgactaactacttccgaaccggaccccctaaacggtagggggtttcggtttcgggggaccggggtacggggtaacgttaaacgggtcggtaaccccggttccggttcggggtaccaccgggacccggtaacgggtcccgtacccgggtcccccccgttcggttaccctaccgtttccccgttcccgtttacccccctacccccgttacccttaccctaaccttaccttacgtccgtacgtacgggacggtccgggcgtcgggacgacggccgacgtagtacgcnnnnnnnnnnnnnnnnnnnnnnnnnn

SEQ ID NO: 154186 - DNA, 655 bp, Homo sapiens
  misc_feature: GYAE6OF01C2Z7Q.10.38.D05.1.454.CMB.1.raw
  modified_base (175)..(175): a, c, t, g, unknown or other
  misc_feature (175)..(175): n is a, c, g, or t
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
  modified_base (484)..(484): a, c, t, g, unknown or other
  misc_feature (484)..(484): n is a, c, g, or t
  modified_base (498)..(498): a, c, t, g, unknown or other
  misc_feature (498)..(498): n is a, c, g, or t
tcagcatagtagtgcacgaccggtgctcgatttagtatctgataggttggggtttgggggggagaggagcccagcactgggattccgaggtgtttccattcggtgatcagcactgaacacagaggactcaccatggagtttggctgagcgtggtttctgtagctattacaaagtntcatgtgagttcatggtgagagnggaggaggctggactcgcggccggtcgggggtcctggacnctctcctggcacngcctgtggtacagcatacaaggtaacactacacgcgaccgtcgggccccacgacggtccgaccggagggggaacgggtgtgggaggttcggtctagtacgttagtaacggaaacaggatacggactaactanattattatcgtacgtaccgtccgtaggaccgggttccgtacctacccnccgttaaccgaggtaactcctaaacctaccctaaaacctactacttaccgttnttaactcccttaanactatacgataactacgtcgtaagacgtacgtacgaccgacccgaccgtaaccttacgttacgtttagacggtaccgacgaaccgtagaacgtaccgtaacgtaccgttacgttaccgtaacggttaccgggaccgggtaccggtaacgggtacccg

SEQ ID NO: 154187 - DNA, 584 bp, Homo sapiens
  misc_feature: GYAE6OF01DEPGM.10.38.D05.1.454.CMB.1.raw
  modified_base (575)..(575): a, c, t, g, unknown or other
  misc_feature (575)..(575): n is a, c, g, or t
  modified_base (579)..(581): a, c, t, g, unknown or other
  misc_feature (579)..(581): n is a, c, g, or t
  modified_base (583)..(584): a, c, t, g, unknown or other
  misc_feature (583)..(584): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccaggggaaggggctggagtgggtctcagttattgaaacagatggcactacatattattctgactccgtgaagggccgttcaccctctccagagacaccttccaaacaacatcttgtatcttcacatgcacaatctgagagtcgacgacacggccacctattatgtgcgcgacatcgactacgctcaattcgtggggccagggacgcccaggtcaccgtcctccccacgccctccaccgacgggcccacgtccggtccttcccccgtggcccgtcccctcgcctccgacggacgccacccgtccgagacgcaccgacggccggcccgtcgggcctcggccgttcgggtaccgaacgggtaccttacccgttaccccaacttaccgtacgtcggtccgttaggaccggtcggggaccgtcgggaccgaagggcccgacgtaagtacgnacgnnngnn

SEQ ID NO: 154188 - DNA, 449 bp, Homo sapiens
  misc_feature: GYAE6OF01CJSDK.10.38.D05.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (437)..(449): a, c, t, g, unknown or other
  misc_feature (437)..(449): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaatccttgttttgaggtcagtaagcggccctnaggagtccctgatcggttctctgcctcaagtctggcaacncggcctccngaccgtntctgggctccgaggctgagatgagctgattactactgcagcgcatactcgacgccccaagtgggtgttggcggcgggaactaggtcgaccgtcgtggtcacgccaaggctacgcccctggtcactctcgtcccncctcctcctactactatgctgcgcggntggcgagcnatagnnnnnnnnnnnnn

SEQ ID NO: 154189 - DNA, 511 bp, Homo sapiens
  misc_feature: GYAE6OF01AZ87U.10.38.D05.1.454.CMB.1.raw
  modified_base (348)..(348): a, c, t, g, unknown or other
  misc_feature (348)..(348): n is a, c, g, or t
  modified_base (477)..(477): a, c, t, g, unknown or other
  misc_feature (477)..(477): n is a, c, g, or t
tcagcatagtagtgcacgaccggtgctcgatttagtatctgatagttgggtttgtggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggcctccgagggaaggggctgggagtgggtctcagttattgaaacngatggcactacatattatctgactcgtgaacgggccgttcaccctctccagagacacttccaacaacatctgtatcttcacatgcacaatctagagagtcgacgacacgccactattatgcgcgcgacntcgactacgtctacgaattcgtggggccacgggg

SEQ ID NO: 154190 - DNA, 726 bp, Homo sapiens
  misc_feature: GYAE6OF01DX7BL.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccgagcaaacgccccctaaactcctttgttttgaggttcagtaacgccggccctcagggtacgtccctgtacttccggttctctcgtccctaccaaagtcctagggacaaaccgccggtaccctcccgtacgtacccgttcgtccgttcgggccctccgagggtcctagggaggtaagtggacggtactgtaactttacctacgtcgcgtaggccgtactaacgttacttaccgaaccgggtaccccctaaacggtacgggggtttacgggttttacggggccgggtaaccgggggtaccgttaaacggggttccggtaaccccggttcccgggttacgggttaccgaaccggtacccccgggtaaagggtccccgtacccgggtcccccccgttacgggttaccctacccgtttcccgttaccccggttccccccgtccccctttacccccg

SEQ ID NO: 154191 - DNA, 622 bp, Homo sapiens
  misc_feature: GYAE6OF01B6QH2.10.38.D05.1.454.CMB.1.raw
tcagcatagtagtgcacgaccggtgctcgatttagtatctgatagctgggttttccttgttgctatttcaaaaggtgtccactgtgaggttcaactggtggagaccggaggaggctggatccagcctggggggtccctgagactctcctgtgcagcctctgggttcagcatcagtaacgactacatgacctgggcccgcaggctccgaggggaagggctggagtgggtctcagttatagaaacagatggcactacatattatctgactcgtgaacgggccgttcaccctctccagacgacacttaccaacacactcttagtatcttcacatcgacactaatctaggagacgtacgacgacgaccggtacccaccttatttattgtcgccgcgtacatacgacctacgcctctaaacttcgtcgggccgagggacgcccgaggtccgacccgtcctaccccgacgccctacccgaaccgaaccgggcccctacgttcccggttccccgttaccccgtcgggacccgtccccgtcggtcccgtccgacggaccgccctacccggtaccgaacggacgccgaaccgccggccggccccgtggggacctccggccggttaaccggg

SEQ ID NO: 154192 - DNA, 692 bp, Homo sapiens
  misc_feature: GYAE6OF01DM6DK.10.38.D05.1.454.CMB.1.raw
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (493)..(493): a, c, t, g, unknown or other
  misc_feature (493)..(493): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcgagggcacgagggtcctgggcccagtctcgccctgactcacgccctcccgtccgccggtccgggtctccgtggacagtcagtccaccatcctcctgcacgtggaaccagtccagttgtacttttgtgtacttaataactntcgtctccgtgtaccngccaccaccgaggaccaaaccgtaccccctaaactttccgttttgttttacggacggtacaaggtaacggccggccctacggaggtaccgtccctaggtacgttccggtttctccgtcgtcccctaccgtaacgttcgtacgggacctaaccggccggtcccttcccgtcgtaccgtctcgtcgggcctccgaggctaggacgntggacggtctagtacttacgctgacagtcactatctcgaccgtacccaggtggggtttcgtaggggccggtacggtaacgtaacgggtccgtacccggttcggtacgggtaccaccgggtacccgtaaggtccccggttccccgcccccgggtttcggtaccctaccgttcccgttccccgtccccctcccgttccccg

SEQ ID NO: 154193 - DNA, 640 bp, Homo sapiens
  misc_feature: GYAE6OF01ARADD.10.38.D05.1.454.CMB.1.raw
  modified_base (588)..(588): a, c, t, g, unknown or other
  misc_feature (588)..(588): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctggggccccgccgaggccgtaccgaagggggaacggggcgtgggaggtgggtctcgtagttagttagaaacagagtggactaactaactattaattattctcgtaccgtccggtaggaacgggtccgttacacgttccctccgtaccgagacgtaaccctacccttaccaaactaactactttccgttacgttaacttccttaaccactagttcacctaactaattccgtagaacgtacgtaccgaacgtaccgaccgtaccctaaccttatttacgttcggtaggccgacgaactntacgaccttacgtaccttacgtaagtttccgggacggggtcccgtaacgggg

SEQ ID NO: 154194 - DNA, 703 bp, Homo sapiens
  misc_feature: GYAE6OF01BRENA.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcacgccctcccgtccggccgtccgggtctccgtggacagtcagtcaccatcctctgcacgtcggaaccagctagtctacttttgtgacttaataactattcgtcctccgtaggtaccacgccaaccaccgaggaaccaaaccgtaccccctaaactttccgttttaggttttacggacggtacctaaggtaaccggccggtaccctacgacggtaccgttcccgtagtacgttccggttcttccgtacgccctacgtaacgtcgtacggaccaaccgccgtccctccgtcgtaccgtcgtcggtcggcctcggaggtcgtagggagtagtggaacgtctaagtacttacacgtgaccgagctactatacgtaccgaaccgacccgtaaggtggggttcgtacgggacggtacgggtacgtagggtccgtaccggtccggtacggaccgacccggtaccgtaccggtccgtaccccggtcccccgttacggtacccttaccgttcccgttccccggtcccccgtcccctacccg

SEQ ID NO: 154195 - DNA, 617 bp, Homo sapiens
  misc_feature: GYAE6OF01CKWCR.10.38.D05.1.454.CMB.1.raw
  modified_base (389)..(389): a, c, t, g, unknown or other
  misc_feature (389)..(389): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacgagggtcctgggcccagtctcgccctgactcacgccctccctccgcgtccggtctccgtggacagtcagtcaccatctcctgcacgtggaaccagcagtgtacttttgtgtacttaataactatgtctcgtggtaccagccaaccaccaggaccaaaccgacccctaacttctttgttttgagtcaagtacgccgcctacgaggtactccgtgacttcgtctctcgcctacgagtctgacaacgcgcctcncgacctctcgtcggctcgagctgagagtgagtctagtacttactacgtgacgagcactagttactacgaccgtaccccgtaaggtgggttacggttcgggcgggtacggaacgttaacgggtcgtacccgtcggtacggacgaaccggacccggtaacggcccttaccccggtcccccgttcggtaccctacctttacccgttcccgtcccccgtaccccgttacccc

SEQ ID NO: 154196 - DNA, 767 bp, Homo sapiens
  misc_feature: GYAE6OF01AN4A8.10.38.D05.1.454.CMB.1.raw
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgcttataactatgtctcctggtaccagcaccaccaggacaaacgcccccaaactccttgttttgagtcagtaagccggccctcgaggacgtccctgatccggttctctcggcctccgaagtctcggacaaccgaccggccctccctgtacccgtctccgtgggcctccgaggcctggaacggtatggaacggtcttaggtaactttaccgtacgtggacgacggccgtactaacgtttacttacccggaaccgggtacccccctaaacgggtacgggggtttcgggttttaccggggccggggtaacccggggtaacgttaaacgggggtccgtaaccccgggttccggtacggggtacccaacggacccccggtaaacgggtccccgttcccgggtcccccccgttacgggttacccctaacccgtttccgttacccgtttcccccccgccccgttaccccttacccgtaacccttacctaaccggttcgtaccggttacgggaaccgggtcccggggtaccgtacgggtaccggtaacggggaccgtaacccgtacgttacggctacgg

SEQ ID NO: 154197 - DNA, 729 bp, Homo sapiens
  misc_feature: GYAE6OF01DGKYQ.10.38.D05.1.454.CMB.1.raw
  modified_base (337)..(337): a, c, t, g, unknown or other
  misc_feature (337)..(337): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcaagtgactttgttgcttaataactatgtctcctggtaccagccaccacccaggcaaacgccccaaatccttgttttgagtcagtaagccggcctcgaggactccctgatcggttctcgtgcctcaagtctggcaacgacggcctcctgaccgtntcgtgggctccgagctggagtatcggacggtctaggaactttaccgtacgtggtcaacggtccgactaagttaacgtttaccgaaccgggtaccccgtaaacggtacgggggtttacgggttttacgggaaccgggtaccggggtaaaccgttaacggggtcggttaaacccccgggttccgttaccgggggtacctaaccgggaccccgtaacgggtccccgttccggtacccccccggttacgggttaccctacccggtttacccgttccgtttaccccccggtacccttacccgttaccccgtaacgttacccgttagtccggaccgtttagggacggttcccggggacgttacgggaccgtaacggtaccggacgtaaatcggagtcg

SEQ ID NO: 154198 - DNA, 698 bp, Homo sapiens
  misc_feature: GYAE6OF01BR4R9.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccagccgtgggggtcctgagactctcctgtgcagcctcgtgggttcagcatacgaagtaaccgactacatcggaccgtcgggccccgccgaggcccgtaccggagggggaacggggtcgtgggaggtcgggtctacgtaggttaattagaaacaggtagtcggactaaccgtaacaagtttaattacttacgtacgtaaccgtcccgggttaggaacggggttccccgtttaccgtaaccccctttcgacccgaaagtaccgaacctaacccgttaaccccaaaacgtaacctatttacccgttagtttaaccttacctttaccgactaactcgaacctaactaacgtcgtaggtaacgacgtaccgaacgacctaccggtaccctaacttattacgtcgtacgcgaccgtaatacgtacgaccctactaccgtacttacggttacccgggcggggacccgtaacggggtaccccg

SEQ ID NO: 154199 - DNA, 463 bp, Homo sapiens
  misc_feature: GYAE6OF01E4ER7.10.38.D05.1.454.CMB.1.raw
  modified_base (348)..(348): a, c, t, g, unknown or other
  misc_feature (348)..(348): n is a, c, g, or t
  modified_base (447)..(463): a, c, t, g, unknown or other
  misc_feature (447)..(463): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgagatgaggctgattacactgcagcgcatattcaggccccaacgagggtgttggcggcgggactaaggngaccgtcgtggtcacgccaagctcgcccctcggtcactctcgttcccaccctcctccactactatcgctgaggcgggcgtcgggacaacggcgcatagnnnnnnnnnnnnnnnnn

SEQ ID NO: 154200 - DNA, 690 bp, Homo sapiens
  misc_feature: GYAE6OF01BPMM5.10.38.D05.1.454.CMB.1.raw
tcagcatagtagtgcacgaccggtgctcgatttagtatctgatagttgggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggttggctattataaccttgtctcctgtatcaacacgccagacaacgccccacactcttgattatgaagtcaagtaacgcggcctcgtagggtttctagtcgtcttctctcgcctcgaacgtcgtcggacaaaccgtacccgggtcccctacccgtacgaacctaacgttccgttacgtcggggtccctacccgacgggtcctacggaaccggaccggaaggtccgtagtaaacgttaactttacgtcggactacggtcctacgtaattaacgttaggtacgtaagttcgggttaccgtcccgtttacgttttaaccggttaaggggttttccggggaccgggtaacggggtacccgtacgggttaccgtaccggtaccccgttaccgttaaacggtccgtaacccggaccccgtaaaccgggtcccgtccccggtccccccgtttacccggg

SEQ ID NO: 154201 - DNA, 627 bp, Homo sapiens
  misc_feature: GYAE6OF01BBSJL.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccaccaggcaaacgcccccaactccttgttttgagtcagtaagcgcctgaggactcctgacttcggttctctcgcctcaagtctgacaacacggcctcctgaccgtctcgtcgggctccgaggctgaggtatggaggtctagtacttactacgtgacagtcgactaattacgttcgaaccggaccccgtaaaggtgggggttcgttacgggcgggtaaccgggtacgttaaagggtccggtaacccggtccggttacggggtaccaccggaccccgaacgggtccgtaccccggtaccccccgttcgggttacctacccgttcccgttcccggttcccccgtccccgttacccccg

SEQ ID NO: 154202 - DNA, 560 bp, Homo sapiens
  misc_feature: GYAE6OF01EB21H.10.38.D05.1.454.CMB.1.raw
  modified_base (286)..(286): a, c, t, g, unknown or other
  misc_feature (286)..(286): n is a, c, g, or t
  modified_base (533)..(545): a, c, t, g, unknown or other
  misc_feature (533)..(545): n is a, c, g, or t
  modified_base (547)..(560): a, c, t, g, unknown or other
  misc_feature (547)..(560): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaattccttgtttttgaggtcagtaagcggccctcaggagtccctgatcggttctctgcctccaagtctggcaacacggcctccctgaccgtctctgggctccgaggctgaggntgaggctgattactactgcagcgcgatattcgacggccccaacgtaggggttgtttggggcgggtcgggaacgtaaggtcggaccggtccgtggggtcacggccccaaagggcccttccggcccccgttcggtacctaccttccgttccgttccccaccccgttcccttacccacctaccttactacggccgttacggacggccggggtcgtacgggaccgaacggggccgactaagtcggactgcnnnnnnnnnnnnngnnnnnnnnnnnnnn

SEQ ID NO: 154203 - DNA, 634 bp, Homo sapiens
  misc_feature: GYAE6OF01CUF25.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccgagccgtggggggtccctgagactctcctgtgcacgcctctgggttcagcatcgaagtaacgactacacgtcgtaccgtcgggcccgcgacgccgtacgggaacggggacgggtcgtgggtacggtgggtactcgtagttagtaagaacgtagagtacggactaactaactatttattactcgtacgtacgtaccggtaagggtaccgggtcccgttacctaccctccgtaccgagactaacctacctacccaaactaactactctttacgtacttcctacgaactactcgaactaactaacgtcgtaggacgtacgtacgaacgaccggtacccactaccttattcgtgtacgccgtacatacgcgtacctactcgtaccgtacgttcggacggggcgacgggtacccg

SEQ ID NO: 154204 - DNA, 709 bp, Homo sapiens
  misc_feature: GYAE6OF01AT548.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcaggacacagggtcctgggcccagtctgccctgactcagcctccctccgcgtccgggtctcctggacagtcagtcaccatctcctgcacgtggaaccagcagtgtacttttgtgacttataactatgtcctccgtggtaccagccaccacccaggaccaaacgccccctaaacttccgtttgtttttcgaggtcaggtaacgccggtccctcgaggactcccgtgtacttcggttctcgtcgccctacgaagtcctggacctaaccgaccggccctacccgtgtacccgtccttcggtcgggtccttcccggaaggtcgttaggacgggtacgttggaacggtcgttacgtaactttaccgttaactcggaccgtacggcgtactattaacgtttccgaaccgggtacccctaaggtaggggttcggtttacgggccgggtacgggtaacgtaacgggtccgtaacccggtccggtcggggtacctaccggacccgtaacgggtcccgttacccggtaccccccgttcgggtaccctaccgttcccgttccccggttaccccccgtccccttacccccg

SEQ ID NO: 154205 - DNA, 735 bp, Homo sapiens
  misc_feature: GYAE6OF01DAJZH.10.38.D05.1.454.CMB.1.raw
  modified_base (722)..(722): a, c, t, g, unknown or other
  misc_feature (722)..(722): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggaaccagcagtgactttgtgcttataactatgtctcctggtaccagccaccaccaggaccaaacgcccccctaaaacttcccgtttagtttttacggacggttactaaggtaacggccggtcccctacgtaagggaccgttccctgtaacgttccggttcttccgtacgtccccttacgtaacgtcgtacggaccaaccgaccggtccctccccgtcggtacccgttcgttaccgtcgggtcctccggaacggtccgttaggaacgggtatacggtacggtacgttagtaacgtttaccgtaacgttcggaccgtacggtccgtactaattaaccgttaccgaaccggtacccccgtaagggttacggggttggtttacgggacggtacgggtacgtaacgggtcgtacccgtccgtagggacccgacgacccggaacggtccctaccccggtcccccgttacgggtaccctacccgttccgttacccgttaccccccncccctttaccccg

SEQ ID NO: 154206 - DNA, 769 bp, Homo sapiens
  misc_feature: GYAE6OF01DTVZ9.10.38.D05.1.454.CMB.1.raw
  modified_base (236)..(236): a, c, t, g, unknown or other
  misc_feature (236)..(236): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcacgccctcccgtccgcgtccgggtctccgtggacagtcagtcaccatctcctgcacgtggaaccngcgagtgtacttttgtcgactttaataacttatcgtcctccgtacggtaccacgaccaacccacccgacggaccaaaccgaccccctaaactttccgttttaggtttttacggacggttacgaacggttaacggcccggtaccctacgacggtacgtcccgtagtacgttccggttctccgtcgtacccgtacctaacggtcgttacggacccaaacccggtaccggttccctacccgtaccgtaacccggttcgttccggtcgggtccctaccggtagggtccgtacgggaaggtagtacgggtacggtcttaagtactttaccgtacgtcggactacggactactactttaccgtaccgaaccggtaacccctaagggttcggggttacggttcgggacggggtacgggtaacgtaagggtcccggtacccggttcggtacggtaaccgaccggtacccgaacgggtcccgtcccgcccccgttcggtaccttacccggttccgtttaccccgtcccccgtccccgtaccc

SEQ ID NO: 154207 - DNA, 595 bp, Homo sapiens
  misc_feature: GYAE6OF01CD3GK.10.38.D05.1.454.CMB.1.raw
  modified_base (352)..(352): a, c, t, g, unknown or other
  misc_feature (352)..(352): n is a, c, g, or t
  modified_base (454)..(454): a, c, t, g, unknown or other
  misc_feature (454)..(454): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctggggcccgccaggctccgaggggaaggggctggagtgggtctcgtagttattgaaacngatggacactacatattattctgactccgtaggaacgggtccggttacaccctctccagacgacacgttcccaaacaacatcttatactcttcacatgcaanactcgtagagtacgtcgaacgtaccaccggaccctaaccgttacttagttcgtacgccgtccgaactagttacgaaccttaaccgtccttaaccgtaaacgtttccgggtaccgggggacccggtaacggggtaaccccgg

SEQ ID NO: 154208 - DNA, 851 bp, Homo sapiens
  misc_feature: GYAE6OF01CDK92.10.38.D05.1.454.CMB.1.raw
  modified_base (845)..(845): a, c, t, g, unknown or other
  misc_feature (845)..(845): n is a, c, g, or t
tcagcatagtagtgcacgaccggtgctcgatttagtatctgataggttgggtttgggtccctgagactctccgtgtgcagcctcgtgggttcagcgactcagtaacgactacagtcgacctgggcccgccaggctccaggggaaggggctggaggtgggtctcagttattagaaacagatcggcactacatacttacttctgactccgtagacgggtccggttaccaccctctaccagacgactacttaccaaacacacttcttagtactcttacactattcgacaacctaattaccgtagtaagacgtacggaacgaaccgaccgggaccctaacccttaactttacgtttacgttcgggaccgtacggtaaactacgtacggtaaccttaccggaccttaccgtaaacgttttacggacgggggtacccggtaacggggtaccgtacccgtacgggtacccgtaaccgttccccgttacccccgaacggtacccccgttaacccggaaacccgggtaaccggggacccccggttaacgttccccgggtttaacccctttcccccccgggttacggtacccccggtcccccgttaccggtaccgtaccccgtaacggggtacccgtacccgtacccgtaccgggaacggtaaccgaccgtaaccgtaccggtcccgggtacccgttacgggtacccgtaccggtcccggttaacgggtaacccgtaaacgggtaacctttaccccgttaacccgtaacccgtaccgtacgtcgtaccggttacggagggtacccggacggttacgggaaccgaaacgggccgtaacgtagtacggacacatcgngctacg

SEQ ID NO: 154209 - DNA, 502 bp, Homo sapiens
  misc_feature: GYAE6OF01AK8L5.10.38.D05.1.454.CMB.1.raw
  modified_base (247)..(247): a, c, t, g, unknown or other
  misc_feature (247)..(247): n is a, c, g, or t
  modified_base (434)..(434): a, c, t, g, unknown or other
  misc_feature (434)..(434): n is a, c, g, or t
  modified_base (478)..(502): a, c, t, g, unknown or other
  misc_feature (478)..(502): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacncggccctccctgaccgtctctgggctccaggctgagatggaggctgattactactgcagcgcatatcacggccccaagagggttgttgggcgggcggactaaggtcgaccgtcgtgggtcaggcccaaggcctcgccccccttgggtccaccgtcgtccgttccccgccctcccgtccacttacctntcgcctggacggccgggtctcgggaccgagggtccgcagtagcnnnnnnnnnnnnnnnnnnnnnnnnn

SEQ ID NO: 154210 - DNA, 624 bp, Homo sapiens
  misc_feature: GYAE6OF01AKIQ3.10.38.D05.1.454.CMB.1.raw
  modified_base (384)..(384): a, c, t, g, unknown or other
  misc_feature (384)..(384): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggagggaggctggatccgagccgtggggggtccctgacgactcgtcctgtgcacgcctcgtgggttcagcatcagtaacgactacatcgaccgtcgggccccgccaggcctccggaggggaacggggctgggaggtcgggtctcgtagttagtagaaactaggatggacactaanattattattctgtacctcggtgacgggtccgttaccaccctctccgagacactaccttaccaacaactattcgttagtactccttacacctgtacaccaactaactcgtagacgtacggttacccgaacgtaacccgaccgggacccttaactacgtttacgttcggcggccggtacgaccgtaagtcgaacccttacgtaccttacgtaacgttcgggtccggggcccgtaaccggggg

SEQ ID NO: 154211 - DNA, 749 bp, Homo sapiens
  misc_feature: GYAE6OF01DDDJO.10.38.D05.1.454.CMB.1.raw
  modified_base (306)..(306): a, c, t, g, unknown or other
  misc_feature (306)..(306): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctggcccagtctgccctgactcacgcctccctcgccgtccggtctcctggacagtcagtcaccatctctgcactaggaaccagctactgatgtggctattataactgtactctgtatacaacaacgccaagaacaacgaccccacactacttgtaatttanagaatctaacgtaacgcgtaccctacgtacggttacgtacgtcgtcttactctcgtccctactacgtcgtcgggactaaccgaccggtccctacctagaacctaacgttcctacggtcggtaccgtaccgacggtacctacggtaccggaaaccggtaacggtaccgttagtaaacgtttaaccgtttaaccgtacgtaaccgtaaccgtaccgttaaccgttaacgttaagttaacggttaacggtaaacgggtttcgggttaacccgttcccgtttttaacccggttttaccggttaagggggttttttaaccccggacgggggtaaccgggtaacccggtagtacccggtacggtaaccccgttaccgttaaacgttccggaaacccggtaccccggtaaacggtccccttccccggtacccccgttccggttaaccccg

SEQ ID NO: 154212 - DNA, 559 bp, Homo sapiens
  misc_feature: GYAE6OF01EU41G.10.38.D05.1.454.CMB.1.raw
  modified_base (312)..(312): a, c, t, g, unknown or other
  misc_feature (312)..(312): n is a, c, g, or t
  modified_base (540)..(559): a, c, t, g, unknown or other
  misc_feature (540)..(559): n is a, c, g, or t
tcagcatagtagtgcacgaccggtgctcgatttagtatctgatagttggggtttgggggctttgcctgggtctcctggacagtcagtcacccatctcctgcactggaaccagcagtgactttgttgcttataactatgtctcctggtaccagcacccacccaggcaaacgccccccaaacttccttgtttttgaggtcagtaagccggccctcaggacgtccctgattccggttctctgccctccaagtctggccaacaccggccctccctcgacccgttctcctgggcctccaggctgaggatgaggctanaattattactgcagctcatatgtagatggtctccttctttacgtaagggttttccggacggagggaccagggtctgacccgttccgtaagtcgaccgacccaaggtccctccgccccccgttcggtacctacccgttcctcccgttcccccgcccccttccctaccccaaccttaccttactcgtctaggaccggccggtcgtgggaccaagggccgacgtatacgcnnnnnnnnnnnnnnnnnnnn

SEQ ID NO: 154213 - DNA, 728 bp, Homo sapiens
  misc_feature: GYAE6OF01D14TW.10.38.D05.1.454.CMB.1.raw
tcagcatagtagtgcacgaccggtgctcgatttagtatctgatagttggggtttggggggggtctcaggaggcagcgctctcaggacgtctccaccatggcctgggctctgctattcctcaccctcctcactcagggcacagggtcctgggcccagtctgccctgactcagccctccctccgcgtccggtctcctggacagtcagtcaccatctcctgcactggaaccagctagtgtacttttgttgacttaataactatcgttctccgtggtaccagccaccaccaggaccaaaaccgccccctaaactttccgtttgttttcggacggtcaaggtaacgccggccctagaggtactcctgacgttccggttctcgtcgcctacgaagttcgtcggacaaaccggtccggtccctcccgtacggtacccgttctcggtcgggtcctaccgacggtctagggacggtagtacggacggtcgtagttaacttactacgttcgacgtacgccgtactaacgttacgttaccgaaccggtaccccgtaaggttacggggttcgggtttcgggaccgggtaccgggtaacggttaacgggttaccggtacccggttccggttaccgggtaccggtaccggtacccgggaacgggtcccgttaccccgtcccccggttccgttacccgttacctttcccgtttccccggttccccccgtccccgttacccccg

SEQ ID NO: 154214 - DNA, 647 bp, Homo sapiens
  misc_feature: GYAE6OF01C1ATK.10.38.D05.1.454.CMB.1.raw
  modified_base (422)..(422): a, c, t, g, unknown or other
  misc_feature (422)..(422): n is a, c, g, or t
  modified_base (464)..(464): a, c, t, g, unknown or other
  misc_feature (464)..(464): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcacatctctgcactgaaccagcagtgtactttgtgacttataatatgtctcctggtaccagccaccaccgagacaaaccgaccccctaattccgtttagtttcgagtacaagtaacgccggtcctacaggtacgttccagacgttcgttctctcgtcctacgaagtctacggacaccgaccggtccctccgtcgaccgtcttcggcggtccaccgnggctacggagtgtacggagtcgtagtacttacgacgtgacgnggtacctactactacgttacgacccgtaacccgaaggttcggggttaggttcgggaccgggtacgggttaacgtacgggtaccggtacccggttccggtagggtcccgtaaccggtcccgtaaggtcccgtccccgaccccgttggtaccctaccgttcctcccgtacccctaccccttaccg

SEQ ID NO: 154215 - DNA, 710 bp, Homo sapiens
  misc_feature: GYAE6OF01DBYCF.10.38.D05.1.454.CMB.1.raw
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (465)..(465): a, c, t, g, unknown or other
  misc_feature (465)..(465): n is a, c, g, or t
  modified_base (482)..(482): a, c, t, g, unknown or other
  misc_feature (482)..(482): n is a, c, g, or t
tcagcatagtagtgcacgaccggtgctcgatttagtatctgatagtttggggtttggggggggtctcaggaggcagcgctctcaggacgtcaccaccatggcctgggctctgctcctcctcaccctcctcactcagggcacgngggtccngggcccagtctgccctgactcagccctccctccgcgtccggtctcctggacngtcagtccaaccntctcctgccacgtcgaaccngcagtgtactttgtgacttaataacttatcgtctccgnggtaccanccaaccaccgaaggaccaaaccgaccccctaaaactttccgtttaggtttttacgacgttacaagtaacgcggtccctgacggtacgtcccgtagtacttcggttctcgttacgcctactaacgtcgtaggaccaaccggtacggccctcccgtcgaccttcgtcgtcgggtacctccggacgngtaaggacgtagtaggngtaccgtagttacttaacgtcgtcggacacggacctactaactttaacgcccgttaaaccgggaccccctaaagggttgggttacggttcgggggaacccggttacggggtaacgtaaacgggtccggtaacccggttccggtacggtaccggaacccggaccggtaacggcccgtaccgtcccccgtaggtacccctcgtcccgtcccgttcccgaccccttccccg

SEQ ID NO: 154216 - DNA, 669 bp, Homo sapiens
  misc_feature: GYAE6OF01BG1QF.10.38.D05.1.454.CMB.1.raw
  modified_base (276)..(276): a, c, t, g, unknown or other
  misc_feature (276)..(276): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggatccgaggccgtgggggtccctgacgactctcctgtcgcgacgccttcgtggtcngcatcaagtaacgactacatcgaccgtcgggcccgcgacggccgtccggaggggacgggtgtagggaggtggtctacgtagttagtagaacgagagtaggtacactaactattacgttatcgtcgtacgtcggtaggacggtccgtcctacccgtctacgacgacgtacctacctaaccaactaactactttccgttatacctttcgtaccactacgtacgactaaccgtaacgttccgtaaggtaccgggtaacctaccgggaaccctacgaacccccggtacctaaccgtttagtttacgttccgggacgaccggtaacccgagttactaccggtaacctaccggtacctacggttaacgtcggggaccggggccgtaacgggggtacccc

SEQ ID NO: 154217 - DNA, 557 bp, Homo sapiens
  misc_feature: GYAE6OF01BLN1W.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacataggtgcttataactatgtctcctgtaccaacaacaccagccacggccccagactcatcatttctgatgtcagtgatccggtccgtttggtactttctaatcgtcttctctgcctctaagtctgacaacgaccggtcttccctgaccctatccgtccgggcctccgacgtcgtacggacggacgacggtctactactttacttactgcagctcatactaccacccgagggcctactctacgtgtacgtacgtcgggacggtacgggtccgtcggtcgtacgtacccgtcgtaccgtacaccggacccgaggcctcccgg

SEQ ID NO: 154218 - DNA, 658 bp, Homo sapiens
  misc_feature: GYAE6OF01D357V.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatgggagttttggctgagcttgggttttccttgttgctatttcaaaaggtgtccactgtgaggttcaactgggtggagactgggaggaggctggatccgagccgtggggggtccctgacgactctcctgtgcacgcctcgtggttcagcatcaagtaacgactacatcgacccgtcgggccccgccgacggccgtaccggaagggggaacggggcgtagggtagtcgggtctacgtagtttatacgaaacagagtggactaactactattaatttacttcgtacgaccgttccggtagggtaaccggggtcccggttacccacccgttctacccgaaggtaccgtaaccctaacccttccccaaaaacgtaacctcgtttacctttagtacctttccgttaccaactagttccgacctaaactaacgttcgtagacggtaccgtcgaacccgacgaccgaccctacttagttacgtgtcgcgtacgactagacgtactacgctacgtaagtccgggcgggcgtaacggg

SEQ ID NO: 154219 - DNA, 464 bp, Homo sapiens
  misc_feature: GYAE6OF01DYJ3A.10.38.D05.1.454.CMB.1.raw
  modified_base (450)..(464): a, c, t, g, unknown or other
  misc_feature (450)..(464): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttgggcggcgggaactaaggtcgaccgtcgtgggtcaggcccaaggcctcgccccctggtcactctcgtcccgccctcctccactactatgctgacgcgggtctggcaaggcgcatagnnnnnnnnnnnnnnn

SEQ ID NO: 154220 - DNA, 725 bp, Homo sapiens
  misc_feature: GYAE6OF01B53HP.10.38.D05.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (542)..(542): a, c, t, g, unknown or other
  misc_feature (542)..(542): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacgacgggtcctgggcccagtctgccctgactcagcctccctcgcgtccgggtctcctggacagtcagtccaccatcctccngcactggaaccngcagtgacttttgtncttaataactatgtctcctgtaccagccacctaccgaggaccaaaccgccccctaaattcctttaggtttttagacgtactacggtaacgccggccctagaggtacgtcccgtgtacgttccggttctccgtcgtaccctaccgtaaaggttccgtacggacctaaaaccgtccggtacccctaccccgttacggtaccccggttccgtaccggtccggggtacccttcccggaagggtccttacggggaggtacgtcggaacgggttctaacggttacttaccgtaactcggaacncggaccgtatactttactcgaaccggtccccgtaaggtcggggttcggttcgggacgggtaccgggtacgtaacgggttccgtaccggttccgtacgggtcgtaaccgacccggaacggtcccgtccggtcccccctcgggtacctacgttacccgtttcccgtccccctcccgttaaccccg

SEQ ID NO: 154221 - DNA, 758 bp, Homo sapiens
  misc_feature: GYAE6OF01DET97.10.38.D05.1.454.CMB.1.raw
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (562)..(562): a, c, t, g, unknown or other
  misc_feature (562)..(562): n is a, c, g, or t
tcagcatagtagtgcacgaccggtgctcgatttagtatctgatagttggggtttgggggggtctcaggaggcagcgctctcaggacgtcaccaccatggcctggctctgctcctcctcaccctcctcactcgagggcacgacgggtcctgggcccagtctcgccctgactcacgccctccctccggtccggtccggtctccgtaggacacgttcagtccaccatcctcctgcacgtacggaaccngtcagttgtactttgtcgtacttaataacttntcgttcctcgtacgtaccagcccaacccaccgaaggaccaaaaccggtaccccctaaactttccgttttggttttacgacggttacgaaggtaaccggtccggtacccttaggaacgggtacccgttcccgtagtacgttccggtttctccgttcgtccctaacgtacggtccgtaggaaccctaaccggtccggtcccttacccgtcgtaccggtcctcggttaccgggccctacggtggtcccttaggaaggtcgtgggacgttctagtaacttacgtacgtnacgacgtacgtctaagttcctaccgccggaaccccttagggtagggttttcggtaccgggcgggtaaccgggtaaccttacggggtccgtccggtaccggtcggggtacccacgggaacccgtacgggtcccttcccgggtacccccgttgtaccgtacccttcccggtttccccgttaacccccgctttaccccg

SEQ ID NO: 154222 - DNA, 714 bp, Homo sapiens
  misc_feature: GYAE6OF01DF3U6.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtccaccatcctcctgccactcggaaaccaggccagtcgtacttttgtgtctttaataactatgtctcctggtaccagccaccaccagacaaacgcccccaaacttcctttgttttcgacggtcagtaacgccgccctgacggactcccgtgacgttccggttctactcgtaccctaccgtaaacgtcgtacggaccaaaccgtccggtccccttcccgtcggtacccgttcgttccgtcggggtacctccgaggaccgtggaacggtagtgggtacggtcttaggtactttaacgtactcggtccacgtccgtactaattaccgttaccgaacccggtacccctaaagggttacggggttcggttacgggtccgggacgggtacgtaacgggtccgtacccggttccggtgggtacccgaacggtaccccgtaacgggccccttccccgggaccccgttcgggtacccttaccggtcccgttacccggttccccccgtccccttaccccgg

SEQ ID NO: 154223 - DNA, 627 bp, Homo sapiens
  misc_feature: GYAE6OF01ERR3H.10.38.D05.1.454.CMB.1.raw
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtggggggtccctgagacctctcctgtgcngcctntgggttcagcatcagtaacactacatcgacctgggccccgccacggcctccgaggggaggggctgggagttgggtctctagttatagaaacagagtggacactacattattattctgtacctcggtaggaacgggtccgttaccacccttctaccgagacgacctaccttaccgaaacctaactacttcctttagtacttaccttccgaactactcgaccactaacttcgtaggaacgtagttacccggaaccgtacgtacccggaccctaaccgttatttacgttgtacggccgtaccgatactcgtaaccgtccgtacttaccgtaaacgtttccggtcgggggcccgtaaggggaccccg

SEQ ID NO: 154224 - DNA, 747 bp, Homo sapiens
  misc_feature: GYAE6OF01CT7M5.10.38.D05.1.454.CMB.1.raw
  modified_base (215)..(215): a, c, t, g, unknown or other
  misc_feature (215)..(215): n is a, c, g, or t
  modified_base (448)..(448): a, c, t, g, unknown or other
  misc_feature (448)..(448): n is a, c, g, or t
  modified_base (740)..(740): a, c, t, g, unknown or other
  misc_feature (740)..(740): n is a, c, g, or t
  modified_base (745)..(745): a, c, t, g, unknown or other
  misc_feature (745)..(745): n is a, c, g, or t
tcagcatagtagtgcacgaccggtgctcgatttagtatctgatagttgggtttgggggctctgctcctcctcaccctcctcactcgagggcacgagggtcctgggcccagtctgccctgactcacgcctccctcgcgtccgggtctccgtggacagtcagtcaccatctctgcacgtacggaaccagcagtgtactttgttctacttaataactntcgtctccgtaggtaccagccaaccgaccgacggaccaaaccgtacccctaaacgtttccgttttaggttttacggaacggttacgtaacggtaacggcccggtaccctacggaacggtaccgttccgtaggtacgttccggttctcgtccgtaccgtaccgtaacggttccgtacggacccaaccgaccggtccctcccgtagtacccgtcgtacggtcgggtcctaccggnggtactagggacggtactaggacgacgttacgtatttaccgtagcgacgacgctataacgttacgtacgacggacctaaggtgggttcggtcgggacggtacggtacgtaacgggtcgtacgtccggtaggaccgacgtaccgacgtccgtaccgtaccccggtgtaccctccgttaccgtaccgtacccctacccgtaccctaacgttacctacggttccgacggttcggggaaccggtccgggtacgtacccggggtaacgaaacccgggtccgtaacggtaccgtaggngtacncg

SEQ ID NO: 154225 - DNA, 236 bp, Homo sapiens
  misc_feature: GYAE6OF01DFXGQ.10.38.D05.1.454.CMB.1.raw
  modified_base (225)..(236): a, c, t, g, unknown or other
  misc_feature (225)..(236): n is a, c, g, or t
tcagcatagtagtgcacgaccggtgctcgatttagtatctgatagttgggtttgggtgccgaagttgctggaggtcaccgtctccccagcctccaccaaggcccatcggtccttcccctggcgccctgctccaggagcacctccgagagcacagcggccctgggctgcctggtcaaggactacttcccactactatgctgagcgggctggcaaggcgacagtagnnnnnnnnnnnn

SEQ ID NO: 154226 - DNA, 602 bp, Homo sapiens
  misc_feature: GYAE6OF01AVH5L.10.38.D05.1.454.CMB.1.raw
  modified_base (342)..(342): a, c, t, g, unknown or other
  misc_feature (342)..(342): n is a, c, g, or t
  modified_base (541)..(541): a, c, t, g, unknown or other
  misc_feature (541)..(541): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
  modified_base (571)..(571): a, c, t, g, unknown or other
  misc_feature (571)..(571): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctcaagtctggcaacacggcctccctgaccgtctcgtgggcctccgaggctgacggatgaggctgattactactgcagcgctatatcgacgccccaagtgggttgttgggnggcggataaggtcgacccgtcgtgggtacacgtcccgaaggcctccggccccccgttggtccaccgttcgtacccgtttacccccaccccttacccgtaccctaaccgtttaccgttacgtccggtaccgttacgggaccggtccggggtaccgttacggggaacccgtaaacggggccgtaccgtaacgttacggacncgtacncgtcgtcncgtcgacagacgcacncgcgcgcgtncncncgcncncncngcngncg

SEQ ID NO: 154227 - DNA, 479 bp, Homo sapiens
  misc_feature: GYAE6OF01AK2Q9.10.38.D05.1.454.CMB.1.raw
  modified_base (457)..(457): a, c, t, g, unknown or other
  misc_feature (457)..(457): n is a, c, g, or t
  modified_base (463)..(479): a, c, t, g, unknown or other
  misc_feature (463)..(479): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcacggcccccaagagggtgtttgggcggcgggacgtaaggtcgaccgtccgtgggtcagcccgaaggctccgccccctcggtccacttcctcgttcccgccctcctccactctatcgctcggagcgggctcggacgaggccgnagtagnnnnnnnnnnnnnnnnn

SEQ ID NO: 154228 - DNA, 627 bp, Homo sapiens
  misc_feature: GYAE6OF01DSC0V.10.38.D05.1.454.CMB.1.raw
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (600)..(600): a, c, t, g, unknown or other
  misc_feature (600)..(600): n is a, c, g, or t
  modified_base (608)..(612): a, c, t, g, unknown or other
  misc_feature (608)..(612): n is a, c, g, or t
  modified_base (614)..(627): a, c, t, g, unknown or other
  misc_feature (614)..(627): n is a, c, g, or t
tcagcatagtagtgcacgaccggtgctcgatttagtatctgataggttgggggtttgggggctttgcctgggtctcctggacagtcagtcaccatctcctgcactggcaccagcagtgacataggtgcttataactatgtctctggtaaccaacaacacccaggccaggcccccagactcatctatttctgatgtcagtgactcggcccttttgggatttactaatcgtcttctctcgcctccaagtctggaccaaacgccggcctttccctgacctacttccgtccgggctacccacgcgtggaggaccggaggtcctactaactttataccgtncaagcctanattacaccgaaccgagggtcctaccgttcgtacggtagtacgttacggttaccggggcgggaaccgggtaaccttcgggaccgttacccgggtacccggtaacccctttaggtacccgaacgaccccgaaacgggtcctcccgggtccccccgtttacgggcctaccttccgttacccgtcccccgtcccttaccctaccccgtacttaccgtatcggcgttagaacggccgggtacctcgggacgaacgtccgngaagtgcnnnnngnnnnnnnnnnnnnn

SEQ ID NO: 154229 - DNA, 682 bp, Homo sapiens
  misc_feature: GYAE6OF01DOXMY.10.38.D05.1.454.CMB.1.raw
  modified_base (379)..(379): a, c, t, g, unknown or other
  misc_feature (379)..(379): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggtttttccttgttgctatttacaaaaggtgtccactgtgaggttcaactggtggagacgtggaggaggctggactccgaggtccgtggggggtccctggagacctctccgtgtgcacgtcctcgtcggttcgagcatacacgtaacgactacagtcgacgtcggcccgcacggccgaccgaggaacgggcgtggaggtcggtctcgtagttagttagaaacagagtnacggggtactaactaattattattacgtacgtacgtaccggtacggtaaccgggtccggttaccctacccctaccttaccgaacgtaacgaacctaccttaacccaaacctaaacctacttacttacgttactaccttactactactacgactaactacgtacgtagacgtacgtaccgaacgaccgtacccggacctaacccgttagttacgttacgtacgtaccgtacgtactaacgtacgtaacctaccgtaccgtaacgttacggttaccggacgggtacccggaagggaacccccggg

SEQ ID NO: 154230 - DNA, 953 bp, Homo sapiens
  misc_feature: GYAE6OF01DAV1N.10.38.D05.1.454.CMB.1.raw
tcagcatagtagtgcacgaccggtgctcgatttagtatctgatagttggggtttggggggagaggagcccagcactgggattccgaggtgtttccattcggtgatcagcactgaacacagaggactcaccatggtagttttggctgagtcgttgggttttccttgttgcttattacaaaggtgtccactgtgtagttcaacgtggtggagacgtgggaggaggcgtggactccgaggccggtcggggggtccctggacgtacctcctccgtggtcgcgtacggtccgttcggttcggggttccaggcctaatacgaacggtaaaccgaacctacgacgtcggaccggtccggggcccccgaccgacgggccctaccgggaaggggaacggggtcgtaggggtacggttcggggttactaccgttaaggtttaagttaacggaaaacgtaggtaacggtcggtaaccttaaactaacttaagtttaatttaccgttacgtacggttacccgttaccggggttaacgggtaaacccggggttccccggtttaccctaaccccccgtttacccgtaacccgtaaacggtaaacccggtaacccttaaaccccgtttaaaccccaaaacccgtaaaacttaccgttttaccgtttaacgtttaaccctttccctttaaaccaacccgttaagttacccggtaacctaaaaccgtttaaaccgttccggttaaagggtaacccgggtaaccgggttaaacccccgggaaaacccggtaacccggtaaaccccggttaacccccgtttaaacccgtttaaaggttttaccggttaccgggtaccgtaacccgggtacctaaaccgtaacgttcccgggaaacccttaaccggtaccctaaccggttaacgggttaccggggtaacccgggggtacccggaaccgggggtaaccccccgg

SEQ ID NO: 154231 - DNA, 653 bp, Homo sapiens
  misc_feature: GYAE6OF01CRCFB.10.38.D05.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
  modified_base (641)..(641): a, c, t, g, unknown or other
  misc_feature (641)..(641): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcacgccctccctcgcgtccggtctcctggacagtcagtcaccntctcctgcactggaaccngcagtcactttgtncttataactatcgtcctcgtagtaccagccaccaccaggaccaaacncccctaaacttccgtttgttttagacgtcagtaacgccgcctgacgactcctgactcggttcnctcgcctacgagtcgtggaccaacgccggtccctcccgtacgtaccgtcgtcgtcggtcctccgacggtcgtaggacggacgtcgggacgtacgttaggtactttaccgtacgtacggtacaggccgtactagttaacgttcccgaaccggaccccgtaaagggttacgggggttcgtttacggggccggttaacggggtacgtaacgggtacgtcccggtacggttcgggaccgacgcccgtaacggcccgtaccgtccccgtcgtcctacgttcctccgttccccnccccgttacccg

SEQ ID NO: 154232 - DNA, 796 bp, Homo sapiens
  misc_feature: GYAE6OF01DQSUN.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccacatctcctgcactggaaccagcagtgtacttttgtgtacttaataacttatcgtcctcgtcgtaccagccaccaccaggaccaaaccgccccaacttctttgtttgagtcagtacgcgcctgagctcctgacgttcgttactcgtcgtcctacgtaagtctacgggaccaaccgtacccggtcccttacccgtcgtaccccgttcgttccggtacggggtcccttacccggacgggtccgttaagggaagggtaacgttacgggtaacggggttccttaacgggttaacctttaaccgtacgttacggacccgtaacggtacccgtaacgttaacgtttacgtaacccggtaaacccgggtaacccccggtaacgggttaggggggtttccggttttacgggggaccgggggttaaccgggttaaccggttaacggggttaccggtccccgggttcgggttaccgggtaaccggtaccggtaaccccgggtaacgggtccccgttacccgggttcccccccgttaccgggttacccttaccggttcccgttttacccccggttccccccggttcccccttaccccgg

SEQ ID NO: 154233 - DNA, 727 bp, Homo sapiens
  misc_feature: GYAE6OF01CF1MG.10.38.D05.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatcctcctgcactggaaccngcagtgtactttgtncttataactatgtctctggtaccagccaccaccaggaccaaacgccccaaacttcctttgttttgacggtcaggtaacgccggtcctcgacggacgtcccgtgacgttccggttctcgtcgcctaccgaagttccgaggaccaaaccgaccggtccctcccgtacggtacccgttccgtcgtcgggtcctccgacggtcgtggaacggtagtggaaggtcttagtaactttacgtacgtcgacgtaacgccgtctaacttacgttacccggaaccggtacccccgaaaggttacgggggttcggttttccggggaccggggtaccggggtaaccgttaacggggtccgggtaaccccggttccggttacggggtaccgaaccgggtaccccgaaacggggttcccctaccccgggtacccccccgtttacgggtccctacccgtttcccgtttccccggttaccccctccccccgttacccc

SEQ ID NO: 154234 - DNA, 590 bp, Homo sapiens
  misc_feature: GYAE6OF01EYWO4.10.38.D05.1.454.CMB.1.raw
  modified_base (415)..(415): a, c, t, g, unknown or other
  misc_feature (415)..(415): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggacaaacgcccccaaacttccttgttttgaggtcagtaagcggcctcaggcgtccctgactcggttctctcgcctacagtcgtgcaacacggcctcccgtgaccgtctcgtcgggctccgaggtctggaggatggnggtctgattactacgtgcagcactatactcgacggaccccaagtacgggttgttcgggacggacgggtacgtaagggtcgtacccggttccgtacgggtacgaccggtacccgacgggtcctcccggcccccgttacggttccaccttccgtccggtttccccgcccttaccccg

SEQ ID NO: 154235 - DNA, 574 bp, Homo sapiens
  misc_feature: GYAE6OF01AYG78.10.38.D05.1.454.CMB.1.raw
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
  modified_base (554)..(554): a, c, t, g, unknown or other
  misc_feature (554)..(554): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggccccnccaggcctccgaggggaaggggctgggagtgggtctcagttatgaaacngatggcactacatattattctgtactccgtagaacgggtccggttcaccctctccaagacgacctactttacccaaactaactattccttagtaacttccttcaacattcgcaacctaatcctaaggagacgtcggaacgacacggaccctaaccgttattacttgcgccgcgaacatcgaaccttacgccttacaatttccggngggggacccaggggtacccg

SEQ ID NO: 154236 - DNA, 879 bp, Homo sapiens
  misc_feature: GYAE6OF01C2AU9.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagtttggctgagtcttgggttttccttgttgtcttatttacaaaaggtgtccactgtgtaggttacaacgtggtggagacgtgggagggaggtcgtggactccgacggtccgggtcggggggtccctggacgtacctcctccgtgtcgcgacgtccgttcgttcgggttacacggactaactacgtaacgtaaaccgtaacctaacgacgttccggaccccggtccggggacccccgccggtacgggtccgtaccgggaagggggaacggggtcggtagggtacgggttcgggtaccttacgtaaggtttaacgtaacggtaaaacgtaacgtaacgtacggtaacctaacttaaacgtaatttaacgtttacgtttccgtacggttaccgtaccgggttaacgggtaaccgggtccccggttacccgtaaccccgttccgtaacccgaagggtaacccctaaccttaacgttaaccccaaaaagtaccttacgtttacgtttacttaacctttctaacccaaccgttagttaccgaacctaaccgtaaacgtttccgaagggtaaaccggttaaccggtaccccgggtaaaaccgacccggtaacccccggtaacccttaacgttttacggtttaacggttcgggacccgtaccgggtaaccaaaccgttcgtaaccggtacccgttaccgacgttaccgttaacgggttcccgggaccgggggtacccgaaggggtacccccg

SEQ ID NO: 154237 - DNA, 698 bp, Homo sapiens
  misc_feature: GYAE6OF01BEXZ4.10.38.D05.1.454.CMB.1.raw
  modified_base (226)..(226): a, c, t, g, unknown or other
  misc_feature (226)..(226): n is a, c, g, or t
  modified_base (429)..(429): a, c, t, g, unknown or other
  misc_feature (429)..(429): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctccgtggacagtcagtcaccatctctgcactggaaccngcagtgtactttgtgtcttaataactattgtctcgtaggtaccagccaccaccaggaccaaacgcccccaaacttctttagttttgagtcagtaacgccgcctgacgtacgtcctgtacttccggttctcgtacggcccctacgtaacgttcgtacggaccaacgccggtccctcccgtcgtaccgttctcgtggcctaccgnggtctggacgtagtcggtaaggcttagaactttacgtaccgtgaccacgacgtactaagttaccgttaacggaacccggtaaccccgtaagggtacggggtttcggtttaccgggggacgtaccgggggtaaacgttacggggtccgttacccgggttaccgttcggggtaaccgaccggtacccggaacgggtcccctttacccggcccccggttcggttaccctaccggttcccggttcccgttacccccgtccccgttaaaccccg

SEQ ID NO: 154238 - DNA, 524 bp, Homo sapiens
  misc_feature: GYAE6OF01EUYFO.10.38.D05.1.454.CMB.1.raw
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggtcagcatcagtaacgactacatgaccgtcgggccccgccaggcctccgaggggaaggggctgggagtgggtctcagttatgaaacngatgacatacatattatctgactcgngagggccgttcaccctntaccagagacacttaccaaacaacattctgtatcttacactatnaccanaatctagacgngtacgacgacacgcctactattactgtgcgcganatcgactacgctacaattcgcggggccaggggaccg

SEQ ID NO: 154239 - DNA, 704 bp, Homo sapiens
  misc_feature: GYAE6OF01DHB4J.10.38.D05.1.454.CMB.1.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctattcaaaaggtgtccactgtgaggttcaactggtggagactggaggaggctggatccagccgtggggggtcctgagactctcctgtgcacgcctctgggttcagcatcaagtaacgactacatcgacctgggcccgccaggcctccgagggaagggctggagtgggtctctagttagttacgaaacaggtactggactaacgtacatttaactttaattcgtagacttccggtggtaaacgggtcccggttactacccctctacccagtacgacctacttaacccaaacaaccgtattctttacgtacttacctttccaactacgttcgacctaactaaacgttccgtaaggtaacggtaacggttacccggaaccgaacccgtacccgggtaccctaaaacccgtttagttttaacgtttacggtacgtacccggtaccggtaaacctaccggttacgtaaacccgttaccggacctttacccgttaaaacgtttcccgggttaacggggggacccgtaacgggggtaaacccccgg

SEQ ID NO: 154240 - DNA, 659 bp, Homo sapiens
  misc_feature: GYAE6OF01DI0BH.10.38.D05.1.454.CMB.1.raw
  modified_base (248)..(248): a, c, t, g, unknown or other
  misc_feature (248)..(248): n is a, c, g, or t
  modified_base (339)..(339): a, c, t, g, unknown or other
  misc_feature (339)..(339): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgccactggaaccagcagtgacttttgtgcttanaactatgtctctggtaccagcaccaccaggacaaacgcccccaaacttcctttgttttgaggtcagtaacgccggcctcgaggactcccgngtactcggttctctcgcctcaagtctaggaccaacgaccggcctcccgtgaccgttctcgtcgggcctccgaggtcctggaggactggaacggtctaggtaactttactacgtcgccgacgcgtactattacttaccgaaccggtaccccaaacggtaggggtttcggtttcggggaccgggtacggggtaacgttaagggtccggttaacccggtccggttcgggaccgaccggtacccgaacgggtcccgtcccgggtcccccccgtacgggttcctaacccgtttccgttccggtttccccccgccccgttaccccc

SEQ ID NO: 154241 - DNA, 785 bp, Homo sapiens
  misc_feature: GYAE6OF01DSZHB.10.38.D05.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcaggcacgagggtcctgggcccagtctcgcctgactcacgtcctcctccgcgtccggtctccgtggacngtcagtccacatcctctgcacgtgacngtcagtcgtactttgtcgtacttaatactagtcgtcctcgtacgtaaccncgaccaccgaaccgacggaccaaaccgacccctaacttccgtttgttttacgcgtacgtagtaacgccgtacctacgacggtacgtcccgtaggtaccgttcggtttacctcgttccgtacccgttaccgtaacggttccgtacggtaacccgtaaaccggtccggtacccgtttccccgtacggttacccgtttcggtcccggttccgggtaccctaccggtacggtcgtacgggtaacggtagtaaacgggtcggtaccgttacggtaacctttaccgtaaccggtcgtaaccgtacgtcggtaacttaacgtaccgttaaccggacccggtaacccgtaaacgggtcggggttcggttaccgggacgggtaaccgggttaacgtaccggttaccgggtaacccggttccggtagggtaaccccgcggtaacccggtacggtcccgttacccgtacccccgttcggaccttacgttccccgttaaccctccccgtaacccgtaccg

SEQ ID NO: 154242 - DNA, 634 bp, Homo sapiens
  misc_feature: GYAE6OF01B0LHP.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtactttgtgcttataactatgtctcctgtaccagccaccacccaggacaaccgacccccaacttccttgttttgagtcagtaagcgccctacaggctccctgatcggttctctcgcctccaagtctcgccaacgcgccctccgtcgtaccgtctcgtcgggtcctccgaggtctaggaggtagtcggacggtacttaggtaactttacgtaacgtcgacgtacggccgtactacttacttacccgacggtacccccgaacggtacggggtttcggtttcgggaccgggtcggggtaacgtacgggtcgtaccggtcccgtagggtcctaccggacccgaaggtccctcccggacccccgttcgtacctaccgtccgttccgttccccgcccttacccccg

SEQ ID NO: 154243 - DNA, 702 bp, Homo sapiens
  misc_feature: GYAE6OF01CGB46.10.38.D05.1.454.CMB.1.raw
  modified_base (604)..(604): a, c, t, g, unknown or other
  misc_feature (604)..(604): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacaaaaggtgtccactgtgtaggttcaacgtggtggagacgtagggaggaggctggactccgaggtccggtcggggggtccctggagactcctccgtgtgcacgcctcgtgggttcagcatacaagtaacgactacatcggaccgtcggggccccgaccgacggtccgtacccggaaggggtaacggggccgtgggaacgtggggtacctacgtaagttaagttacgaaaacgtgaacgtggacctaacgtaacaatttaatttacttacgtacgtaaccgtccggttaagggaaccgggtcccggttacctaccccgtactaccgaagacgacctaaccttaacccaaactaactacttcttacgtactttcctacacagttcgactaaactacgtcgagtacgtacgacgaacgaccacggacctaacgttnttacgtgtacgacccgtacggtaaccagttccgaaacccgtacggttacctaaccggttaacgttcccgggtacggggaccccgtaaggggtaccccg

SEQ ID NO: 154244 - DNA, 585 bp, Homo sapiens
  misc_feature: GYAE6OF01AJRAV.10.38.D05.1.454.CMB.1.raw
  modified_base (463)..(463): a, c, t, g, unknown or other
  misc_feature (463)..(463): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgacctcggggccccgccgaggcctccgaggggagggcgtgggagtgggtctctagttattagaaacagatggctactacattattattctagactccgtaggacgggtcccgttccacccttcaccgagacgacctacttacccaaactaccattcttagtacttctacacntcgacacaatctaggacgacgtcgacgacaccggtacccacttattagtcggagtaccggccgaatactacgaccttacgccttaacgtacgtttccggcgggggacccaaggggaccccgg

SEQ ID NO: 154245 - DNA, 719 bp, Homo sapiens
  misc_feature: GYAE6OF01BMAJ3.10.38.D05.1.454.CMB.1.raw
  modified_base (371)..(371): a, c, t, g, unknown or other
  misc_feature (371)..(371): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatgggagttttggctgagctgggttttccttgttgctatttcaaaaggtgtccactgtgaggttcaactggtggagacgtggaggaggctggatccgagccgtgggggtccctgacgactctcctgtcgcagcctcgtgggttcagcatcaagtaacgactacatcgaccgtcgggccccgccgaggccgtaccgagggggaacggggcgtgggtagtggggtctcgtagttattagaaacngatggacacgtacattattattcgtagacgttaccggtaggtaacggggtcccgtttaccaccccgttcctaccgaacggtacgaacctacttaaccccaaactaaccgtaactttaccgtttagttaacttaccttactaacctattacgactaaacctaacgttcgtagggaacggtaaccggttaaccggaaccggttaacccggaacccgggtacccttaaacccgtttaagttttaacggttcggtacggacccggtccgaaccgttaacgtacggtaacccttacgtaccgttacgttaaccggtttacggtcccggggggtaccgacgggggtaaccccgg

SEQ ID NO: 154246 - DNA, 780 bp, Homo sapiens
  misc_feature: GYAE6OF01E2FGN.10.38.D05.1.454.CMB.1.raw
  modified_base (236)..(236): a, c, t, g, unknown or other
  misc_feature (236)..(236): n is a, c, g, or t
  modified_base (348)..(348): a, c, t, g, unknown or other
  misc_feature (348)..(348): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagccctccctccgcgtcccgggtctccgtggacagtcagtccaccatcctcctgcacgtggaaccngcagttcgtacttttgtgtcttaatactatcgtctccgtgtaccacgccaacccaccgaggaccaaaccgccccctaacttccgtttgttttgaggtcagtacgccgtcctnaggtctccgtgtcgttcggttctcgtcgcctacgaacgtcgtcggacaaccgtaccggtccctacccgtcgtacccgtcttccggtacgggcctccgagggtcctagggaacggtagtcgggtacgtccggtagttaacctttaaccgtacgtacgacgacgggacctaacgtaacgttaaccttacccgggaacccggtaaccccgtaacgggttacgggggtttacgggtttacgggggaccccggggttacgggggtaaacccggtttaacggggtcccgggtaccccgggtttaccgggtaccggggttacccgacccgggtaacccccggtaacgggtcccccgttaccccggtcccccccggtttacggttaccccttaacccgttcccgttacccccgtttacccccccaacccccgtttccccg

SEQ ID NO: 154247 - DNA, 630 bp, Homo sapiens
  misc_feature: GYAE6OF01CGZIF.10.38.D05.1.454.CMB.1.raw
  modified_base (254)..(254): a, c, t, g, unknown or other
  misc_feature (254)..(254): n is a, c, g, or t
  modified_base (403)..(403): a, c, t, g, unknown or other
  misc_feature (403)..(403): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcagtccaccatctcctgcacgtggaccaccagcagtagactagtaggtnacttaataactatcgtctctacgtaaccaacaacaccacggccaccggaccccagacctcactactattctgtatcgtctagtcgacgtccggtaccgtttggtactttctaatcgtcttctctcgtcctactagtcgtacgactaacncggtaccttccgtacgacctactccggtccggcctacccgacggcgtaagggaccggtacggtacggtccttacgtaactttacgttaacgtcgaccgtacgtaccttacgtaacttaaccgtacccgaaccggtacgggaccttacgtcgtacgtatacgttacggtcgggacgggtacggccgtgccgtacgtacgtaccgacgtacgaccgcgtaccggtcccg

SEQ ID NO: 154248 - DNA, 749 bp, Homo sapiens
  misc_feature: GYAE6OF01ATI6O.10.38.D05.1.454.CMB.1.raw
  modified_base (233)..(233): a, c, t, g, unknown or other
  misc_feature (233)..(233): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctcgccctgactcacgcctccctccgcgtccgggtctccgtggacagtcagtccaccatctcctgcactggaaccngcagtgtactttgtgtcttataactatgtcctcgtcgtaccagccaaccaccgaggaccaaaccgacccctaaacttccgtttggttttcgacggtacaagtacggccgtcctagtacgccgttcccgtagtacgttcggttctcgtacgtccctacgtaagtccgtcgacctaaccgccggtacccttccggtacgtacccgtccgttacggtcgggtccctaccggacgggtccgtagggacgggtaacgttcgggaacgttcgtaacgttaactttacccgtacggtaccggtacgacggtaccgtacgttaaccgttaccgttacccggaacccggtaaccccggtaagggttacggggtttcgggttcgggaacggggtaccggtaacgttacgggtcccgtaccgggttccggtacgggtaccgaccggtacccggtacggttcccgtacccggtcccccgttacggtaccctacccgttcccttacccggttaccccctcgttaccccg

SEQ ID NO: 154249 - DNA, 750 bp, Homo sapiens
  misc_feature: GYAE6OF01EMSD4.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacttttgtgcttaataactatgtctcctgtaccagcaccaccaggccaaacgcccccaaactccttgttttgaggtcagtaagcggcctcgaggacgtcctgacttcggttctctcgcctacaagtctggaccaacgaccggcccttcccgtcgtacccgttctccgtcgggccttaccgagggtccgttagggaggtacgttggaacggtccgttaggttaacttttaaccgttaaccgttcggtaccgtaacggtcccggtactaacgtttaacgtttacccgaaacccggggtaccccccgtaaaagggttacggggggttttacggttttcgggggaccggggtaccggggtaaccggtttaaacggggtccgggtaaccccggttcccgggtacggggttacccgaaccggtaccccggaaacgggtcccgttaccccggtcccccccggttcgggttacccttacccgtttccccggttaccggtttcccccccgtcccccttacccccg

SEQ ID NO: 154250 - DNA, 753 bp, Homo sapiens
  misc_feature: GYAE6OF01EIK4T.10.38.D05.1.454.CMB.1.raw
  modified_base (249)..(249): a, c, t, g, unknown or other
  misc_feature (249)..(249): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtccaccatctcctgcactggaaccagcagtgtacttttgtgtcttanaactattcgtctccgtggtaccacgccacccacccaggaccaaaccgacccccctaaacttccgtttgttttgacggtcaggtaacgccggccctcgaggtacgttcccgtgtacgttccggttcctctccggtacctaccgtaacgttccgtacggaccaacccgtacccggtccccttccccgtcggtaaccccgttcgttccggttcgggaccctcccggaacggtccgtaagggacggtacgttcgggacggtacttacggttaactttaaccgttacgtcgaccgacggtcccgtactaactttacgttacccgaaccggtaaccccgtaagggttcggggtttacggtttacggggaccgggtacgggtacgtaacgggtccgtcccggtcgggttacgggtccgaaccgtaccccgaacgggttcccgaccccggtccccccgttcggtacccgtaccttcccggttccccgtttcccccgaccccgtttacccccg

SEQ ID NO: 154251 - DNA, 696 bp, Homo sapiens
  misc_feature: GYAE6OF01A4D6V.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggagggaggctgggactccgaggtcccgtgggggggtccctggacgtacctccgtccgtgtcgcgacgtcctcggtcgggttacacgcacgtacgaacggtaaccgactaacgagtacgacccggtccgggccccgaccgacggcctacggaagggggtaacggggcgtagggacggtgggtctacgtagtttaagtaagaaacgtagagtcgactaactaagtaattacttagtctcgtacgtccggtaggaaccgggttcccgtacctacccgtctaccgaagtacaaccgtaccctaccaaactactacttcttagtaactccgtacactatacgacctaactacgtcgtaggaaccgtagtacccgaaacgtacccgaacggtaccctaacttagtttacgtcggaccgtaccgtacaacgtacgtacgtaacctccgtaaccttacgtaaagttccggggtaacggggcccgtaaacgggg

SEQ ID NO: 154252 - DNA, 223 bp, Homo sapiens
  misc_feature: GYAE6OF01BW760.10.38.D05.1.454.CMB.1.raw
  modified_base (221)..(223): a, c, t, g, unknown or other
  misc_feature (221)..(223): n is a, c, g, or t
tcagcatagtagtgcacgaccggtgctcgatttagtatctgatagttgggtttgggtgccgaagttgctggaggtcaccgtctccccagcctccaccaagggcccatcggtcttccccctggcgccctgctccaggagcacctccgagagcacagcggccctgggctgcctggtcaaggctacttccatactatgctgagcgggctggcaaggcgcatagnnn

SEQ ID NO: 154253 - DNA, 667 bp, Homo sapiens
  misc_feature: GYAE6OF01B4DWG.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgtactttgtgcttaataactatcgtctcctggtaccacgccaccacccaggaccaaacgaccccccaaacttccgtttgttttgacggtcaagtaacgccgcctcgaggacgtcctggacttcggttctcgtcgtccctaccgtaagtccgtacggaccaaccgccggtccctcccgtcgtacccgttcctcgtcgggcctccgaggtcgtaggaggtagtaggacggtctagtaactttacctacgtcgcctacgccttactattacgttaggtaagtagttcggtccgttccgtttacgttttacggttacgggttttaccgggacgggtacgggaccgtgggtaccgtacggtacccggttacgttaacggtcgaaccggacccgtaacggtcccgtacccgtccccccgttggtccctaccgttccccg

SEQ ID NO: 154254 - DNA, 815 bp, Homo sapiens
  misc_feature: GYAE6OF01AU103.10.38.D05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacngtcagtcacatcctcctgcactcggaaccagcagtgtactttgtgacttaataactatgtctcgtgtaccagccaccaccgaggacaaaccgccccctaaacttctttgttttgacggtacaggtaacgccgccctagaggacgtcctgtacgttcggttctctcgcctacgaagtcgtacggacaacgccggtccctcccgtcgtaccgttccgtccggttcgggtcctaccgacggtacgtagggacgtagtcggtacgggtcgttacgtaacgtttaaccgtacgttacggaccgtaacggtccgtactaactttaccggttaacccggtaaccccggggaaccccccgttaaacgggttaggggggtttaccggggttttaccgggggacccggggggtaaccggggttaaccggttaaacgggggttccccggttacccgggtttaccggggttacgggggttacccggaacccggtaacccccgggtaaacgggttcccccggtaacccccgggttccccccccggggttacgggttacccccgttaacccggtttccccggtttaccccccgggtttcccccccccgtccccgtttaacccccccgg

SEQ ID NO: 154255 - DNA, 680 bp, Homo sapiens
  misc_feature: GYAE6OF01CQY81.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtgggttttccttgttgctattacaaaaggtgtccatgtgaggttcaacgtggtggagacgtggaggaggctggatccgagccgtcgggggtcctgagtacctctccgtgcgcacgtcctcgtggtcagcatcaagtaacactacatacgaccgtcgggcccgaccgacggccgtaccggaaggggaaggggctgggacgtgggtacctagtagttataaggaacagatcgactactatattaattacttctagtaccgtacggtaggtaacggtcccgtacctaccctacgtaccgaaagtaccgaccttaacctaacccaaaaccaacttaacgtcgtttacgtaacttccttaacactactacgaacactaaacgttcgaaagacggtaaccgtccgaaaccgttaccgaacccggtaaccttacgtttaaagttacgttccggaagcccgggtactaacgtatccgggtaacctaaccggacctttaacgaacgtttcccgggaggggacccgtagggtaacccccgg

SEQ ID NO: 154256 - DNA, 667 bp, Homo sapiens
  misc_feature: GYAE6OF01CRT7U.10.38.D05.1.454.CMB.1.raw
  modified_base (228)..(228): a, c, t, g, unknown or other
  misc_feature (228)..(228): n is a, c, g, or t
  modified_base (491)..(491): a, c, t, g, unknown or other
  misc_feature (491)..(491): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcacctcctcactcagggcacgagggtcctgggccagtctcgcctgactcagcctcctccgcgtccggtctccgtggacagtcagtcacatctcctgcacgtcggaaccnggcagtcgtactttgtgacttataactatcgtctcgtgtacagacaccaccaggacaaaccgacccctaaacttccgtttgttttacgaggtacaggtaacggcgtccctacgacggtacgtccgtagacgttcggttctcgtcgtacctacgtaacgtcgtacggacctaacggaccgtccttccgacgtaccgtctcgtacgggtcctacggacggtcgtacgggagtacgtcggacggttctaggttacttaacgttcgngacacgactacgtactaccgtcgaccgtaaccggacggttggggttcggttacgggaccgggtacgggtacgtacgggtcgtacccgtcgggtacggtacgaccggtaccgaacggtccgtcccggtccccggttcgtaccctacgttccgtccccggttcccgtcccgttacccg

SEQ ID NO: 154257 - DNA, 647 bp, Homo sapiens
  misc_feature: GYAE6OF01D5WUU.10.38.D05.1.454.CMB.1.raw
  modified_base (269)..(269): a, c, t, g, unknown or other
  misc_feature (269)..(269): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggtttttccttgttgcttatttcaaaaggtgtccactgtgaggttcaactggtggagacgtgggaggaggctggactccagtccggtcggggggtccctgacgtacctctcctgtgcngcctctgggttcagcatcaagtaacgactacatcgaccgtcgggcccgccgacggccgtaccggaggggacggggcgtgggcggtgggtctcgtagtttagtagaaacgagagtcggaactaatactattatttacttcgtcgtaccgtcgtaggtacgggtcccgttccaccctctaccagacacctacctacaacaactacttcttatacttctactactatcgacaacgtactcgtagtaacggacgtacgaaccgaccgtaacccgtacctaaccgttaacttacgtttcggtcgtaccggacgtaaccacgttacgtaccgtaccgtacctacgttaaccgttcggggtccgggccggaaccgggtaccccgg

SEQ ID NO: 154258 - DNA, 490 bp, Homo sapiens
  misc_feature: GYAE6OF01BLDVB.10.38.D05.1.454.CMB.1.raw
  modified_base (126)..(126): a, c, t, g, unknown or other
  misc_feature (126)..(126): n is a, c, g, or t
  modified_base (326)..(326): a, c, t, g, unknown or other
  misc_feature (326)..(326): n is a, c, g, or t
  modified_base (436)..(436): a, c, t, g, unknown or other
  misc_feature (436)..(436): n is a, c, g, or t
  modified_base (467)..(490): a, c, t, g, unknown or other
  misc_feature (467)..(490): n is a, c, g, or t
tcagcatagtagtgcacgaccggtgctcgatttagtatctgatagttgggggtttgggggctttgcctgggtctcctggacagtcagtcaccatctcctgcactggaaccagcagtgactttgttncttataactatgtctcctggtaccagcaccacccaggacaaacgcccccaaactccttgttttgaggtcagtaagccggccctgaggacgtccctgatccggttctctgccctcaagtctggccaacaccggccctccctgaccgttctcgtgggcctccgaggctggagatggacggctgtacttactactgacagcgnatactcgaccgccccaagtgggttgttgggcggcggactaaggcgaccgtcgtggcacgccgagcctccgcccgtcgtctaccgtctcctcccaccctcctccactctancgcgtgcgcggcgtggacgaggcacgatagnnnnnnnnnnnnnnnnnnnnnnnn

SEQ ID NO: 154259 - DNA, 761 bp, Homo sapiens
  misc_feature: GYAE6OF01EZR4M.10.38.D05.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctccaccctcctcactcagggcacgagggtcctgggcccagtctcgccctgactcacgccctccctccggcggtcccgggtctccgtggacagtcagtccaccatcctcctgcactaggaaccngcagtgtacttttgtnacttaataactatgtctccgtggtaccacgaccacccaccgaggaccaaaccgacccccctaaattccgtttggttttcggacggttcaggtaacggccggtccctagacggtacgttcccgtgtacgttcggttcctcgtcgcccttacgaacgttcgtacggaccgaaccgtaccggtcccttccccgtcggtaccccgttcgttccggtacgggtcccttaccggacgggtccgtagggacggtacgtcgggaggttacttaggtaactttaccgtacgtcgaccgtacggcctacgtacttaccgtaccgacccggtaacccggtaaggttcgggggtttggttaccggggcgggtaaccgggtaccggtacgggtcccgggtaccgttccgggtacgggtacccgacgggtaccccggaaccggttcccggtaccccgtcccccggttacggtcccttaccgttcccgttaccccgttcccccctacccgttaccccg

SEQ ID NO: 154260 - DNA, 539 bp, Homo sapiens
  misc_feature: GYAE6OF01DG2V4.10.38.D05.1.454.CMB.1.raw
  modified_base (515)..(539): a, c, t, g, unknown or other
  misc_feature (515)..(539): n is a, c, g, or t
tcagcatagtagtgcacgaccggtgctcgatttagtatctgatagttgggggtttgggggctttgcctgggtctcctggacagtcagtcaccatctcctgcactggaaccagcagtgactttgttgcttataactatgtctcctggtaccagcaccacccaggcaaacgcccccaaactccttgttttgaggtcagtaagcgccctcaggagtccctgatcggttctctgcctccaagtctggcaacacggcctccctgacccgtctctgggctccaggctgaggatgaggctgatttactactgcacgcgctatacttcgaccggtaccccaacgaggggttgttcgggcgggtacgggtacgtaggtcggacccgtccgtgggtccacgacccgaaggcctccggacccccctcggtactacctcgttccgtcccccgccctcctacctacctactattcgacgtcggacggtccgggtcgtacggaccgtaaggccgtacacgttagcagcnnnnnnnnnnnnnnnnnnnnnnnnn

SEQ ID NO: 154261 - DNA, 746 bp, Homo sapiens
  misc_feature: GYAE6OF01CIXPA.10.38.D05.1.454.CMB.1.raw
  modified_base (258)..(258): a, c, t, g, unknown or other
  misc_feature (258)..(258): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttcaaaggtgtccactgtgaggttcaactggtggagacgtgggaggaggctggatccgaggccgtggggggtccctgacgactctcctgngcagcctcgtggttcagcatacagtaacgactacatcgaccgtcgggcccgcgacggccgtaccgaggggaacggggctagggaggttcgggcttacaaggtttattacgaaacgagtagtcggacacgtaactattaacttattcgtagtaccttaccgggtaggtaaaccgggtccggttacccaaccccgttacgtacccgaaggtaacctaacccgttaaccgttaacccaaaaccgtaaaccttagttttacccttacgtttaacctttacctttacccggaaacttacgtaccggtaacctaacccgtaaagttcccgtaagtaaccggtacggtaaccggtaccggtaaccaccggtaccctaaactttcgtttaaacgtttgggtaccgaccgggtacgtaaacccgttagtaccggtaacctaaccggttacctaacgtttaaaccgttccggggtaacggggtcccgtaaacgggggg

SEQ ID NO: 154262 - DNA, 654 bp, Homo sapiens
  misc_feature: GYAE6OF01BJ0SD.10.38.D05.1.454.CMB.1.raw
  modified_base (324)..(324): a, c, t, g, unknown or other
  misc_feature (324)..(324): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagccaccaccaggacaaacgcccccaaactcctttgttttgagtcagtagcggcctnaggatcctgatcggttctctcgcctcaagtcgtcggcaaacgccggtccctccctgaccgttctcgtcgggcctccgaggtctggagtagtggacggtctagtaacttacgtactgcagccgactaatacgttcgaaccggcccctaaagggtggggttcggtttcggggccggggtaccggggtaacgttaaacggggtcggtaccccggttccggttacggggtaccgaacgggtaccccgaaagggtccccgttacccgggtcccccccgttcgggttaccctacccgttcccgtttcccggttccccccttacccctttacccccg

SEQ ID NO: 154263 - DNA, 723 bp, Homo sapiens
  misc_feature: GYAE6OF01B3IQB.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctcgggcccagtctcgccctgactcacgccctcccgtccgccggtccgggtctccgtggacagtcagtcacatcctcctgcacgtacggaaccagcagtgtacttttgtgacttaataactagtcgtcctcgtggtaccacgccaacccaccgaggaccaaaaccgtccccctaaactttccgttttgttttaggacggtacaaggttaacgccggtccctagacggtacctccgtagacgttcggttctcgtacgcctaccgtaagtcgtggaccaacgtccggtccctccgtacgaccgtctcggtcggtcctccggaggtccagggtagatcggaggtcctagtaacttaccgtacgtcgacacggacgtacttagtaccgttaccggaacccggacccgtaagggtggggtttacggttccggggacgggtaacgggtaacgttacgggtacggtacccggttcgggtacgggtaccaaccgggtaccccggaagggtccccttacccgggtcccccggttacggttaccttcccgttacccgttcccgtttacccccgccccgtttacccg

SEQ ID NO: 154264 - DNA, 804 bp, Homo sapiens
  misc_feature: GYAE6OF01DZ6JT.10.38.D05.1.454.CMB.1.raw
  modified_base (235)..(235): a, c, t, g, unknown or other
  misc_feature (235)..(235): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagccctccctccgcgtcccggtctccgtggacagtccagtcaccattcctcctgcactcggaaccngcagtcgtacgttttgtgtactttataactatcgtacctccgttaggtaccagaccaccgacccgaggaccaaacccgtaccccctaaacgttccgttttgttttacggacggttactaacggtaacgcccggtaccctagacggtacgttccccgtgtacgttcggtttctccgtcgaccctacgtaacggttctacggacctaaacgccggtccctcccgtacggtacccgttcgtccggtcgggacctccggaggtacgtaggacggtaagtcgggtaggtcttagtaactttaaccgtcgtacggtccgaacggtccgtacgttaattaaccgttaccggaacccgggtaacccccgtaaagggttaccgggggtttcggtttaccgggggaccgggttaccggggtaacgttaacgggtacgtaccccgggttcggttacgggggttacccaacggggttacccccgaaggggtttccccgacccccggttaccccccgggtttacggtaccccttaccccgttaccgggtttccccccgttcccccgttccccccttaccccg

SEQ ID NO: 154265 - DNA, 683 bp, Homo sapiens
  misc_feature: GYAE6OF01CZ3HF.10.38.D05.1.454.CMB.1.raw
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctcctccgcgtccggtctcctggactagttagtccacctatctcctgcactggaaccagcagtgactttgtgcttataactntgtctcctggtaccagcaccaccaggacaacgccccaatccttgttttgagttcagtagcgcctgagctccngtatcggttctctcgcctcaagtctggcaacaccggcctcccgtgacccgtctcgcgggctaccgaggtcctaggaggtacgtgacgggtacttgaactttaacgtacgtgaccgagcccgataacgttacgttaccgaacgggtacccccaaagggttcgggtttacgggtttacgggacccggggtacggggttaaccgttaaacggggttccggtaccccggtttaccgggtacggggtaacccgtaaccggacccccggtaaaggggtccctccccgggtaccccccgttcgggttaccctaaccccggttccgttaccccggttcccccctaaaccccgtccccgttaaccccg

SEQ ID NO: 154266 - DNA, 853 bp, Homo sapiens
  misc_feature: GYAE6OF01CSXHD.10.38.D05.1.454.CMB.1.raw
tcagcatagtagtgcacgaccggtgctcgatttagtatctgatagttgggggtttgggggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcagtcaccatctcctgcactggaaccagcagtgtacttttgtgtactttaataactattcgtcctccgtaggtaaccagaccaacccacccgaaggaccaaaccgtacccccctaaacttccgttttagtttttacggacggttacgtaacggtaaacggcccggtaccctcgaacgggtaccttccccgtggtacttccgggtttctccgtcggtccccttacgtaacgttccgtacggaccctaaaccgccggtccccttccccgtacggtaccccgtttccgtccggtacgggtccctacccggagggtaccgtagggaacgggtattcgggaacggttcttaaggtaactttaaccgtacgttacggacctaggtacccgtactaactttaaccgtccggaaaccccgggtaccccgtaaaacgggtttcgggggtttcgggtttaccggggaccgggggtaccggggtaacgttaaaccggggtcggttaaccccgggttaccgggtaccggggtacccgtaaaccggggtaccccggttaacggggtccccgttcccccggtacccccccgttacggggttacccctaacccgtttcccgtttacccccggttacccccccgttaccccgttaaccccccg

SEQ ID NO: 154267 - DNA, 609 bp, Homo sapiens
  misc_feature: GYAE6OF01A9HEW.10.38.D05.1.454.CMB.1.raw
  modified_base (359)..(359): a, c, t, g, unknown or other
  misc_feature (359)..(359): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggtcagcatcagtaacgactacatcgaccgtcgggccccgccgaggctccgaggggaacggggctgggagtgggtctcgtagttatagaaacngatggcactacatattatctgactcgtgacgggtccgtacaccctctacagacgacacctaccaaacactatcttgtactcttacactatcgacaactaatctaggagtacggtaccgaaccgaccgaccggtaccctaccgtttagtttacttcggtacgacccggacgaacctaggtcgaacccttacggtacccttaaccgttaacgtttcccgggaacggggggtccccgtaagggggtaaccccg

SEQ ID NO: 154268 - DNA, 795 bp, Homo sapiens
  misc_feature: GYAE6OF01B4KKE.10.38.D05.1.454.CMB.1.raw
  modified_base (257)..(257): a, c, t, g, unknown or other
  misc_feature (257)..(257): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctctcactcagggcacgagggtcctgggcccagtctcgccctgactcacgccctccccgtccggtccggtccggtcctccggtagacgtcgtacgacgtccacctctccgtccgcgactacggaacggaaccngacgtagttcgtttacgtttggtactacttaactaactgtcgtcctcgtacgaacacgaccaaccacgaacgtaaccgaacccctaaccttaacgttttcgtttaggttacgacgtacgtaacggtcggccgtacctaggaacgggtcctcgtagtcgttccggtctccgcgcctaacgtacgtcgacgaaccaccggtccctcctacgaccggtccttcgcgggtcgcctacggacggtcggtagggacgtaggtcggtacggtacttacgtaactttaccgaggtcaccggtcgactaacgttacgtacgtacccggaacccggtaacccgttagggggttaccgggtttcgggttaccggggggaaccggggttaacgggttaaacggttacccggggttacccgggttccggtacggggttaccgggacccgggaacccggtaccggaccgggttccccgtacccccggttcccggttaccggttacccctcgttttaacccccggtcccctaacccccgttcccgttaacccc

SEQ ID NO: 154269 - DNA, 620 bp, Homo sapiens
  misc_feature: GYAE6OF01AJM0A.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatgaagttttggctgagctgggttttccttgttgctatttcaaaaggtgtccactgtgaggttcaactggtggagactggaggaggctggatccagccgtggggggtccctgagactctcctgtgcagcctcgtgggttcagcatacaagtaacgactacagtcgaccgtcgggcccgccacggcgtccggagggacggggcgtgggaggtgggtctacgtaggttaagttacgaaacgtagagtcggacaacgtaactattaatttattctacgtaccgtccggtaggaccgggtcccggttccaccccgttctaccgacgacgtacctaaccttaccaactaactacttctttagttactcttacactactcgactaactaacgtctaggagacgttacgaacgaccgaccggtaccctacttattacgtagtcggccgacgactctcgtactaccgtctactaacgttcggtcggggccgtaacgggg

SEQ ID NO: 154270 - DNA, 676 bp, Homo sapiens
  misc_feature: GYAE6OF01EGSEU.10.38.D05.1.454.CMB.1.raw
  modified_base (207)..(207): a, c, t, g, unknown or other
  misc_feature (207)..(207): n is a, c, g, or t
  modified_base (411)..(411): a, c, t, g, unknown or other
  misc_feature (411)..(411): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgtgcttaataactntgtctcctggtaccagcaccaccaggaccaaacgcccctaaattcctttgttttgagtcagtaacgccggcctgaggacgtccctgacttcggttctctcgccttaccgaagttcgtcggacaaccgaccggtccctccgtcgacccgtctcgtgggcctccgaggtctggaggatcggagtctaggtacttaactacgtacgnacgcgactaagttacttaccgaccggacccctaagggtcgggttggttcgggaccgggtacggggtaacccgttaagggtccgtaacccggttccggtacgggtaccgacggacccgaagtccgtcccgtaccccgttcggtcctaccttcccgttaccgtccccctacccgttacctacccgtaaccttcacgttccgccggttacggacgggcccggggtacgtccgggaacgaaccgggtaccggacctaaacggtgcctcg

SEQ ID NO: 154271 - DNA, 623 bp, Homo sapiens
  misc_feature: GYAE6OF01D8JCW.10.38.D05.1.454.CMB.1.raw
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (421)..(421): a, c, t, g, unknown or other
  misc_feature (421)..(421): n is a, c, g, or t
tcagcatagtagtgcacgaccggtgctcgatttagtatctgatagttgggtttggggggggtctcaggaggcagcgctctcaggacgtcaccaccatggcctggctctgctcctcctcaccctcctcactcagggcacagggtcctgggcccagtctgccctgactcagccctccctccgcgtccgggtctcctggacagtcagtcaccatctcctgcactggaaccagcagtgtacttttgtgcttataactatgtctcctgtaccagcaccaccagcaaacgccccctaaatcctttgttttgagtcagtagcgcctnagactccngatcgttcnctgcctacagtcngcaacgcgcctccgtgacctctcgtcggctccgaggctaggagatggagtctagtacttactacgtgacgngcgactattactacgaccggtacccctaaggtaggggttcggtttcgggcgggtacgggtaacgttaaagggtccggtacccggttccggtacggggtaccgtaaccggaccccgtaacgggtcccgtacccggtccccccgttacgggttaccctaacccgttcccgtttccccggtttccccctaacccccgtttccccg

SEQ ID NO: 154272 - DNA, 547 bp, Homo sapiens
  misc_feature: GYAE6OF01B1S5F.10.38.D05.1.454.CMB.1.raw
  modified_base (328)..(328): a, c, t, g, unknown or other
  misc_feature (328)..(328): n is a, c, g, or t
  modified_base (516)..(518): a, c, t, g, unknown or other
  misc_feature (516)..(518): n is a, c, g, or t
  modified_base (520)..(547): a, c, t, g, unknown or other
  misc_feature (520)..(547): n is a, c, g, or t
tcagcatagtagtgcacgaccggtgctcgatttagtatctgatagttggggtttgggggctttgcctgggtctcctggaaagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcgacggccccaagngggtgtttgggcggcgggaactaagggtcgaccggttccgtggggtccacgccccgtaaaggcctacggcccccctgggtccaaccgttccgttcgttccccccgccccttacccgtcccctaaccgttacctaattcgccgtggtacggccggggtcgtgggaccgtaaagggcccgactaagtagnnngnnnnnnnnnnnnnnnnnnnnnnnnnnnn

SEQ ID NO: 154273 - DNA, 516 bp, Homo sapiens
  misc_feature: GYAE6OF01E2XCY.10.38.D05.1.454.CMB.1.raw
  modified_base (512)..(512): a, c, t, g, unknown or other
  misc_feature (512)..(512): n is a, c, g, or t
  modified_base (515)..(516): a, c, t, g, unknown or other
  misc_feature (515)..(516): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatctgtatcttcacatgcacaatctgagagtcgacgacacggccacctattatgtgcgcgacatgactacgctcaattctggggccagggagcccaggtcaccgtctccccagcctccaccaacgggcccatcgtcttccccctggccgccctgctccaggacgcacctccgagacgcaccagccggccctgggcctgccctggtacaaggacctacttcccactactatcgctgacgcgggcgtgggacctaagggccgactacgtaagatcatncgnn

SEQ ID NO: 154274 - DNA, 755 bp, Homo sapiens
  misc_feature: GYAE6OF01AS3CI.10.38.D05.1.454.CMB.1.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctattcaaaggtgtccactgtgaggttcaactggtggagactgggaggaggcgtggatccgagccgtcgggggtcctgagactctcctgtgcagcctcgtggttcagcatcaagtaacgactacagtcgaccgtcgggccccgacgacggccgtaccggagggggaacggggcgtagggtacggtcggggtaccgttacgtaaggtttacgttaacggaaaaccgaggtaagtcggaccgtaacttaactaagtttaacgttttactttacccgtaggtacccgttaccgggttacgggtaaccggggtccccgggtttacccaaccccgtttccgtacccgaaaggtaccgtaacctacccttaacccgaaacctaaacgtcttccgtttagttaacctttaccgttaccctaagtaacttacgactaacctaagtccgtaacggaggtaccgtaccgaaccggaaccgtccggaaccctacgtttaatttcgttacgtccggaccggtacggtaactacgtcggtaacccttaccggacccttacggttaacgttcggggtcccggggccggtaaacggggtaccccg

SEQ ID NO: 154275 - DNA, 717 bp, Homo sapiens
  misc_feature: GYAE6OF01AYHDG.10.38.D05.1.454.CMB.1.raw
  modified_base (713)..(713): a, c, t, g, unknown or other
  misc_feature (713)..(713): n is a, c, g, or t
tcagcatagtagtgcacgaccggtgctcgatttagtatctgatagttgggggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggcaaacgccccaacttccttgttttgaggtcaagtaacgccggccctcgaggacgtccctgtacttccggttctcgtcgccctaccgtaagttcgtcggaccaaccgtaccggcccttacccgtgtacccgttcgtcgtcgggtcctccgaggtcgtaggacggagtaggacggtcttaggtaactttactacgtgacgacggtcgactaattacgttaccgaaccggtaccccgaagggttaggggttcggtttacggggaccggggtaaccggggtaaccgttaacggggtccggtaacccggttccggtacggggtacccaaccggacccgaacgggtcccgtcccggtcccccgttacggtaccctaccgttcccgttcccgttacccccaccccgttccctaccctaccgttaccgtacgtcggtcgtacgggacggtcgggtaccggaggaccggaacgggccaacgacgtagngacg

SEQ ID NO: 154276 - DNA, 618 bp, Homo sapiens
  misc_feature: GYAE6OF01BOSAN.10.38.D05.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
  modified_base (355)..(355): a, c, t, g, unknown or other
  misc_feature (355)..(355): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacngtcagtcaccntctcctgcactggaaccngcagtgactttgtncttanactntgtctctgacngcacaccagacaacgccccaactccttgttttgagtcagtacgcgcctnaggtcgtcctgactcggttctcgtcgcctacagtctggtacaacncggcctcctacgtaccgtctcggtcggctccgaggtctaggagtactggagtctagtacttactacgtgcagcgctatatcgacggtaccctaaggtacgggtttcgttacgggccggggtacggtaacgtaaacgggtccgtaacccggttcccgggtaggtacccgtaaacggccccgtaaacggggtccgtccccggtacccccgttaccgggtcctacccctttccggtacccggttcccccgtcccccgttaaccccg

SEQ ID NO: 154277 - DNA, 754 bp, Homo sapiens
  misc_feature: GYAE6OF01BB8U2.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggttttccttgttgctatttacaaaaggtgtccactgtgaggttcaacgtgggtggagacgtgggaggaggctggatccaggccgtgggggtccctgacgactctcctgtgcagcctcgtggtcagcatacgaagtaaccgactacacgtcgaccgtccgggccccgcgacggtccgtaccggaagggggaacggggtcgtaggggacggttcgggtccttacggtaagtttaagttaacgaaaacgtaggtaacgtcggacctaacgtaactaattaatttaacgttcgtacggtaccgtaccggtacgggtaaccgggtcccgtttaccctaccccgttcgtaacccgaaaggtaccgtaaccctaacccgttaacccaaaacgtaactcgtttaccgtttaattcctttaccgttaccaactacggttaccaactaaacgtacgtaccgtggaaacgtaccggtaaccgaaccggaacccgtacccgtacccctttaacgtttagttaccggttacggtccggaccaacgtaactacgtacgtaaaccccggtctaaccgttaaccgtaggttaccgggcggggacccgagggtaccccg

SEQ ID NO: 154278 - DNA, 579 bp, Homo sapiens
  misc_feature: GYAE6OF01BBD83.10.38.D05.1.454.CMB.1.raw
  modified_base (346)..(346): a, c, t, g, unknown or other
  misc_feature (346)..(346): n is a, c, g, or t
  modified_base (553)..(579): a, c, t, g, unknown or other
  misc_feature (553)..(579): n is a, c, g, or t
tcagcatagtagtgcacgaccggtgctcgatttagtatctgataggttgggggtttgggggctttgcctgggtctcctggacagtcagtcaccatctcctgcactggaaccagcagtgactttgttgcttataactatgtctcctggtaccagcaccacccaggcaaacgcccccaaacttccttgttttgaggtcagtaagcggccctcaggacgtccctgatcggttctctgcctccaagtctggcaacaccggcctcccgtgaccgtctcgtcgggccttccgacggctacggagggagtcggagggcctaggtactttaacctactcgcgtagccgctaatnttccgacggaccccaacggtagggtgttgggcggacgggacgtaaggtcgtacccgtcggtgggaccgacggcccgaacggcctaccgccccccggttgtccctaccgttcctcccggttccccctaccccttccccgtacctacctacctacgtcgtcgcggtaccggccggggcgtcggaccgacgggccgtacgagtagcagcnnnnnnnnnnnnnnnnnnnnnnnnnnn

SEQ ID NO: 154279 - DNA, 575 bp, Homo sapiens
  misc_feature: GYAE6OF01B3W7R.10.38.D05.1.454.CMB.1.raw
  modified_base (276)..(276): a, c, t, g, unknown or other
  misc_feature (276)..(276): n is a, c, g, or t
  modified_base (572)..(572): a, c, t, g, unknown or other
  misc_feature (572)..(572): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgccccaaatccttgttttgaggtcagtaagcggccctnaggatccctgatcggttctctgcctcaagtctggcaacaccggcctcctgacctctctgggctccgaggctggagagtgacggctagattacactgcagcgactatactcacggcccaacgtagggtgttcgggcggacgggacgtaaggtcgaccgtcgtcgggtcacgccgaacgggctaccggccccttcggtacctaccgttccgtaccgttccccgcccttcccgtccctacctaccgtactcgtccgtaggacggcgggtcgtacgggaccgtaacgggccgacgagtgnacg

SEQ ID NO: 154280 - DNA, 732 bp, Homo sapiens
  misc_feature: GYAE6OF01BOLNZ.10.38.D05.1.454.CMB.1.raw
  modified_base (222)..(222): a, c, t, g, unknown or other
  misc_feature (222)..(222): n is a, c, g, or t
tcagcatagtagtgcacgaccggtgctcgatttagtatctgataggttggggtttggggggggtctcaggaggcagcgctctcaggacgtcaccaccatggcctgggctctgctcctcctcaccctcctcactcagggcacgagggtcctgggcccagtctcgccctgactcacgcctccctcggccgtccgggtctccgtggacagtcagtcaccatctcngcacgtggaaccagcagtgtactttgtgtacttaataactatgtctcgtacggtacacgaccaaccaccgaggaccaaaccgtacccctaacttcgtttgttttcgacggtacaggtaacgccggcctagaggtcgttccgtagtacgttcggttctccgtcgtaccctacgtaacgttcgtacgggaccctaaaccggtaccgtccccgttcccgtacggtaccccgttcgtcggtccgggtacctaccgggagggtccgtagggacgggtagttggacgttctaaggtaactttaacgtcgtcgaccgtagccgtaactacgttacgttaccggaacccggtacccgtaagggttacggggtttcggttacggggaccgggtaacgggtaacgttaccgggtcggtacccgtcgggtacgggtaccgaccggtacccggaacggtccctacccggtcccccggtacgtcccttaccggttcccttaccccgtaccccgtccctacccg

SEQ ID NO: 154281 - DNA, 228 bp, Homo sapiens; identical to SEQ ID NO: 154142
  misc_feature: GYAE6OF01EBTFD.10.38.D05.1.454.CMB.1.raw
  modified_base (224)..(228): a, c, t, g, unknown or other
  misc_feature (224)..(228): n is a, c, g, or t

SEQ ID NO: 154282 - DNA, 608 bp, Homo sapiens
  misc_feature: GYAE6OF01CG7TN.10.38.D05.1.454.CMB.1.raw
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (247)..(247): a, c, t, g, unknown or other
  misc_feature (247)..(247): n is a, c, g, or t
  modified_base (353)..(353): a, c, t, g, unknown or other
  misc_feature (353)..(353): n is a, c, g, or t
  modified_base (382)..(382): a, c, t, g, unknown or other
  misc_feature (382)..(382): n is a, c, g, or t
tcagcatagtagtgcacgaccggtgctcgatttagtatctgataggttgggtttgggggggtctcaggaggcagcgctctcaggacgtcaccaccatgcctggctctgctcctcctcaccctcctcactcagggcacgacgggtcctgggcccagtctcgccctgactcacgtccctcccgtccgcggtccggtctccgtaggacagtcagtcacatctcngcagtgaaccagcagtntactttgtncttaatatatcgtctccgtggtaccagtccaccaccgaggaccaaaccgaccccctaaacttccgtttagtttcgacgttcaagtacgccgcctacgagtcgtccngtacttcggtctcgtcgcctacgagtcgngacaaccgcgtccctaccgtgacctcgtcgcggctccggagtcaggacgtagtcgaaggtctagtacttaccagtgactagctactatacctcgaccgacccgtaaggttcggttggtacggcggtacggtagtacggcgtacccgtggtcgaccgccggaccacggtccgtccccgtcccggtacgtccctacgttcccgtaccccttccccgtccgttaccccg

SEQ ID NO: 154283 - DNA, 754 bp, Homo sapiens
  misc_feature: GYAE6OF01DB708.10.38.D05.1.454.CMB.1.raw
  modified_base (184)..(184): a, c, t, g, unknown or other
  misc_feature (184)..(184): n is a, c, g, or t
  modified_base (210)..(210): a, c, t, g, unknown or other
  misc_feature (210)..(210): n is a, c, g, or t
  modified_base (421)..(421): a, c, t, g, unknown or other
  misc_feature (421)..(421): n is a, c, g, or t
  modified_base (753)..(753): a, c, t, g, unknown or other
  misc_feature (753)..(753): n is a, c, g, or t
tcagcatagtagtgcacgaccggtgctcgatttagtatctgatagttgggtttgggggctctgctcctcctcaccctcctcactcagggcacagggtcctgggcccagtctgccctgactcacgccctccctccgcgtccgggtctcctggacagtcagtcaccatctcctgcacgtggaaccngcagtgtactttgtgtcttaataatntgtccttcgtggtaccacgccaaccacccgaggaccaaaccgaccccctaaacgttccgttttaggttttcggaacggttactaaggtaaccggccggtaccctagacggtaccgtcccgtagtaccgttcggttctcgtcgtccctacgaggttccgaggaccaaccgtccggtccctaccgtcgaccgttcgtcgtcgggtcctacggngtcgtggaaggtacgtggacgtcttacgtaacgtttactagtcggactacggactacttaattaccgtaccgaaccggtacccggtaaaggttcggggttagggttccgggacggggttacgggtacgtaaccgggtcgtacccgtcggttacggaccgtacggaccggtaaccggtccgacccggtccccggtacggtacccttaccggttcccgttaccccggttcccccgtacccttcccgtaacccttaccgttaccgttcggtaccgtccggtaggtcccggggtccggtacggtccggaaccggtacgggacgtacgagtggtcgng

SEQ ID NO: 154284 - DNA, 760 bp, Homo sapiens
  misc_feature: GYAE6OF01CP0CX.10.38.D05.1.454.CMB.1.raw
  modified_base (265)..(265): a, c, t, g, unknown or other
  misc_feature (265)..(265): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcgagggcacgagggtcctgggcccagtctcgccctgactcacgccctcccgtcgcgtccgggtctccgtggacagtcagtccaccatctcctgcacgtcggaaccagctagtgtactttgtgtattataactntcgtctcgtacgtaccagccaccaccgaggaccaaaccgacccctaaactttccgttttagttttacgacggttaccaaggtaacggtcccggtccctacggaacggtaccgttccccgtaggtaccgtttccggttctaccgttcggaccccttacgtaacggtcctcgggaaccctaaaccgcccggtcccttacccgtacgtcccgttcgtccggtcgggcccttaccggagggtccgtagggtacggtagtacggtacggtacttaacggtaacctttaacggtacgtacggaccgaacggtaccgtactaacgtttacccgttaccggaacccggtaaccccgtaagggttacggggttcggttacggggccgggtacgggtaacgttaacgggtccggtacccgggtcgtacggtaccgaccggtacccgaggtcccgtacccgtccccggttgtacctacgtcccgttccctaaccccgtcctacccg

SEQ ID NO: 154285 - DNA, 637 bp, Homo sapiens
  misc_feature: GYAE6OF01EQ3R0.10.38.D05.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctctcactcagggcacagggtcctgggcccagtctgccctgactcagcctccctcgcgtccggtctcctggacagtcagtcaccatctcctgcactggaaccngcagtgactttgtncttanactatgtctctgtacagcaccaccagcaaacgccccctaaatcttgttttgaggtcagtaacgcgtccctcaggacgttccctgacgtcgttctctcgcctaccaagttctcggacaaccgtaccggtccctacccgtcgacccggtctcgtcgggcctaccgaggtccgtaggaggtacgttggaacggtcgttagaactttaccgtacgtacggcacggccgtctaacttacgtcgaacccggacccgtaaacggtcggggttcgttacggcggacgggtaacgtaacgggtgtaacccgtcggttacggtaccgtacggacccgtaacggtccgtacccgtcccccgtcggtacccgtaccgtccgttccgttcccccgcccttaccccg

SEQ ID NO: 154286 - DNA, 668 bp, Homo sapiens
  misc_feature: GYAE6OF01BU3CC.10.38.D05.1.454.CMB.1.raw
  modified_base (157)..(157): a, c, t, g, unknown or other
  misc_feature (157)..(157): n is a, c, g, or t
  modified_base (179)..(179): a, c, t, g, unknown or other
  misc_feature (179)..(179): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (466)..(466): a, c, t, g, unknown or other
  misc_feature (466)..(466): n is a, c, g, or t
tcagcatagtagtgcacgaccggtgctcgatttagtatctgataggttggggtttgggggggtctcaggaggcagcgctctcaggacgtcaccaccatggcctggctctgctcctcctcaccctctcactcagggcacagggtcctgggcccagtcngccctgacctcacgccttcccncgccgtcggtctccgaggacagtcagtccacatccgctgacatcgaacngtcagtgtacttgntacttaanaactntgtctcngtaccagccaccaccgagtaccaaacgtaccccctaagtttcccgtttagtttcgtacgtctaacgttacggtccggcccttaggacggtaccgttcccgtagtaccgttccggttacctcgtacggtacctacgtaaagtcctacggacaaccggtcggtccctaccgtcgtaccgtcgtacgtcggctcgagtcgtagagtntacgacgtgtactagtacgtcgagcgacgtacgcttaacgtcgtacgccggtaacccgtacggttacgggttcgtaacgggtccgtacgggtaacggtacggtcggtacccgtcggttacggaaccgtcggtacccgtaacgtcccggtccgtccccgtagtacccttccgtaacccgtttccaacccccgtccttaccccg

SEQ ID NO: 154287 - DNA, 757 bp, Homo sapiens
  misc_feature: GYAE6OF01EBE0F.10.38.D05.1.454.CMB.1.raw
  modified_base (246)..(246): a, c, t, g, unknown or other
  misc_feature (246)..(246): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtatcgccctgactcagccctccctcgcgtccggtctcctggacagtcagtcacctatcctcctgcactggaaccagcagtgtactttgtnacttatactatcgtctctggtaccagccaccaccgagaccaaaccgaccccctaaacttccgttttggtttttagacggttaccaaggttaaccgccggtaccctgtacggtacgttccccgtagtacgttccgttctcgtcgcctacgtagtcgtcgaccaaccgccgtccctccgtacgtaccgtcgtcgtcgggtcctacgcggtccgtaggacggtagtaggacggtctaggttaacttacctacgtcgaccgtagacccgtacttaacgttaccgtaccgaacccgggtacccctaacggggtacggggtttcggttacggggaccgggttaaccggggtaacgttaacggggtcccggttaacccggtttcccgggtacgggttaacccgacccgggtacccgtaaccgggtccccgttacccccgggttcccccggttaaccgggttacccttacccggtttaccccgtttaccccgttacccccccgtccccgtttaaccccg

SEQ ID NO: 154288 - DNA, 670 bp, Homo sapiens
  misc_feature: GYAE6OF01C0REY.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctctgcactggaaccagcagtgactttgtgcttataactatgtctcctggtaccagccaaccaccaggacaacgacccccaaacttcctttagtttttagacggttcaacgtaacgccggaccctcgaggtcgttccctagtacgtcggttctctcgtcctacctaagtcgtggaccaaccgaccggtccctcccgtagtacccgttctacggttcgggccttaccgagggtcctaggacgggatggacggtcttaggtaatttacccgtagtcgacacggctacattacgttcgaacccggaccctaaacgggttgggttgggttacgggaccgggtacgggacgttaacgggtcgtacccggtcgtacggggtaccgacggtccccgtaacgggtccctcccggtcccccgtacggtccctaccttccgttccccgtaccctccccgttaccccg

SEQ ID NO: 154289 - DNA, 696 bp, Homo sapiens
  misc_feature: GYAE6OF01CD20N.10.38.D05.1.454.CMB.1.raw
  modified_base (174)..(174): a, c, t, g, unknown or other
  misc_feature (174)..(174): n is a, c, g, or t
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (501)..(501): a, c, t, g, unknown or other
  misc_feature (501)..(501): n is a, c, g, or t
tcagcatagtagtgcacgaccggtgctcgatttagtatctgatagttggggtttggggggggtctcaggaggcagcgctctcaggacgtcaccaccatggcctgggctctgcctcctcctcaccctcctcactcgagggcacgagggtcctgggcccagtctcgccctgactcncgccctccctccgcgtccggtctcctgacntcagtccaccntcctcctcgcactcggaaccagctagtgtactttgtgtcttaataacttatcgttcctaccgttacggtaaccacgacccaacccaccgacggaaccaaacccgtaccccctaactttccgtttaggtttttacgacggttaccaacggttaacggcccggtaccctacggtacggtaccgttccccgtagtacgttccggttctccgtcgtcccgtacctaacggtcctacggaccctaaaccggcccgtacccgtcccgtacgaccgttccgtcgccggtaccncgtaacggctaggaggctggacgtctacgtaacttccgagtcgagacgtctactagttaccaacggccgtaccgaaggtcgggttggtcgggaccgtaggaccgttagggcccgtaccgtcggtaccggaccacggtaccaccggtcgcccccgtccgtcggtacctccctaggttcccctccccgaccttcccg

SEQ ID NO: 154290 - DNA, 645 bp, Homo sapiens
  misc_feature: GYAE6OF01C1BSU.10.38.D05.1.454.CMB.1.raw
  modified_base (284)..(284): a, c, t, g, unknown or other
  misc_feature (284)..(284): n is a, c, g, or t
  modified_base (344)..(344): a, c, t, g, unknown or other
  misc_feature (344)..(344): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (620)..(622): a, c, t, g, unknown or other
  misc_feature (620)..(622): n is a, c, g, or t
  modified_base (625)..(645): a, c, t, g, unknown or other
  misc_feature (625)..(645): n is a, c, g, or t
tcagcatagtagtgcacgaccggtgctcgatttagtatctgatagttgggggtttgggggctttgcctgggtctcctggacagtcagtcaccatctcctgcactggaaccagcagtgtactttgtgcttaataactatgtctcctggaccagccaccaccaggaccaaaacgacccccctaaacttcctttgtttttaggaggtcaagtaaggccggccctcgaggactccctaggattccggtctctgccctaccaagtctcggaccaacgaccggccctccncgacccgttcgtcgtcggctaccgaggtctaggaggagtggacgctagtacttactacgngacgacgcgtacgtaataccttaccggaaccggtaacccgaacgggtaggggtttcggtcggggacgggtacgggtaaacgtaacgggtacgtacccgggtcgtacgggtaccaccggaccggtaacggcctcccgtcccccgtacggttacctccgttcccttacccgtcccctccccgttaccgacccttacgtaactacgtcgtacggtacgggtaccggcggggtaccgtcggggaaccgtacgacccgtacgtaacgtagntacgntcnannnacnnnnnnnnnnnnnnnnnnnnn

SEQ ID NO: 154291 - DNA, 538 bp, Homo sapiens
  misc_feature: GYAE6OF01D9HPA.10.38.D05.1.454.CMB.1.raw
  modified_base (208)..(208): a, c, t, g, unknown or other
  misc_feature (208)..(208): n is a, c, g, or t
  modified_base (301)..(301): a, c, t, g, unknown or other
  misc_feature (301)..(301): n is a, c, g, or t
  modified_base (511)..(538): a, c, t, g, unknown or other
  misc_feature (511)..(538): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaattcctttgttttgaggtcagtaagcggccctnaggacgtccctgatcggttctctcgccctccaagtctggaccaaccaccggccctccccgtgacccgttctcgtgggcctccgaggctgaggntgagctgacttactatgcagcgctatattcgacgccccaagtagggttgttagggcgggcggtaacgtaacggtcgtaccgtcgtggtcacgacccgaggccgtccgcccccgtggtcctacgtccgtccgttccccgtaccccttccctacctaccttactcgtacgtcgtggacggcgggtcgtcggacgaacggcgacacgtagcgnnnnnnnnnnnnnnnnnnnnnnnnnnnn

SEQ ID NO: 154292 - DNA, 673 bp, Homo sapiens
  misc_feature: GYAE6OF01DBUM1.10.38.D05.1.454.CMB.1.raw
  modified_base (362)..(362): a, c, t, g, unknown or other
  misc_feature (362)..(362): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcacgccctcccgtccgccggtccgggtctccgtaggacagtcagtccacatctcctgcactggaaaccagcagtgtacttttgtagtcttaataactagtcgtcctccgtaggtaccagaccaccacccgagaccaaaccgaccccctaaacttcgtttggttttagacggttcaagtacgccggtaccctnagggtacctccctagtacttcggttcctcgtcgaccctacaaggtcctaggaccctaacgccggccctcccgtaggtaccctctcgcggccttacgcggctggaggtctaggagtactagtaacttactacgtcgtacgacgtcgacgttattacgttaccgaccggaaccccgtacgggtaagggttcggtttcggggacgggtaacgggaacgttacgggtaccgtccggtccggtaggtccgaccgtaccggacggtcccgtccggccccgtgtacctaccgttcttcccggtccccgtcctaccccg

SEQ ID NO: 154293 - DNA, 807 bp, Homo sapiens
  misc_feature: GYAE6OF01ASKF5.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgcttattcaaaaggtgtccactgtgaggttcaacgtggtaggagacgtggggaggaggtcgtaggactccgacggtccgggtcggggggtccctaggtacgtaccgtcctccgtggtcgccgacgtcccgttcggttcgggttaccagtacctaacgttaccgtaaacggtaaactaaccgttaacacgttaccggtaacccggtcccggggaccccggaccgtaccgggtccgtaaccggggaacggggggaacggggtcgtaggggtacggttgggtacctacggttaagttagttaaacgaaacgaggtagccggtaactaacgttaactagtttaacttcttacgtaccgtaccggttcggtaacgggaaccgggtcccggttaccctaccccgttcgtaaccgtacgaacgtacccttaacctaaccaaacctactacttcctattaccttcctacacctagaccgtactaacgtactgtaagaccgtacgaaccgacgaaccgtaccgtaccgtaaccttagttaacgttcgtaccgggtaccgtacgtaaccgtacggtccgtaacccgttaccggtacttaaacccggttacggttaacccgggttacgggggaacccgtaaccgggggtaaccccc

SEQ ID NO: 154294 - DNA, 703 bp, Homo sapiens
  misc_feature: GYAE6OF01BUZC0.10.38.D05.1.454.CMB.1.raw
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctctcactcagggcacgagggtcctgggcccagtctgccctgactcagcctccctccgcgtccgggtctccgtggacagtcagtccaccatctcctgcactggaaccngcagtgtactttgtntcttaataactatgtcctccgtcgtaccacgccaccacccgaggaccaaaccgacccccctaaacttcttttggttttagacggttcaaggtaacggccggtcctacgacggtacgtccctagtacgttcggtctctcgcctacgagtctaggacacgccgtcctccgtcgtacccgttctcggtcggcctaccgtggcgtgaggtagtggtacgtctagtactttacgtacgtcgacgtacgctactattaccgttacggaacccgtaccccgtaaggttacggggtttcggttacggggaccggggtacgggtaacgttacgggttccggtaccccgggttccggtacgggttaccgcccggtaacccggtaaccgggtcccgtaccccggtcccccggttacggtacccctacccgtttaccccggttacccttccccccctacccgttccccc

SEQ ID NO: 154295 - DNA, 837 bp, Homo sapiens
  misc_feature: GYAE6OF01APFOV.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcgagggcacgagggtcctgggcccagtctgccctgactcacgccctccctccggcgtccggtctccgtggacagtcagtcaccatcctcctgcacgtacggaaccagcagttgtacttttgttagtcttaataaccttattcgttccttccgtggtaaccacgaccaacccacccgaaggaaccaaaaccgtacccccctaaaactttccgttttggttttacgacggttacgtaaacggttaacggcccgggtcccctacgaacgggtaccgttaccccgtaggtacgttccggtttcctccgtccgtcccgtaactagtccgtaggaccaaaccggcccggtaccctcccgtacggtacccgttcgtccggtcggtcctaccggacggtcctagggaacggtaggttacgcgggtacgttaggttaacctttaccgtagtacggtacacggaccgtacgttaactaccggttaccgaacccgggtaacccctaaacgggttcgggggtttacgggtttaccgggacccgggggttacgggttaaccggttaaacggggttcccggtaaccccgggttccgggttaccgggtaacccggttaccggaccccggttaaccggggtccccgttaccccgggtcccccggttacggtaccccgtaccgtttccccgttcccggttccccccgtacccgtttaccccc

SEQ ID NO: 154296 - DNA, 735 bp, Homo sapiens
  misc_feature: GYAE6OF01ETZ09.10.38.D05.1.454.CMB.1.raw
  modified_base (377)..(377): a, c, t, g, unknown or other
  misc_feature (377)..(377): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgcttatttcaaaaggtgtccactgtgaggttcaactggtggagacgtggaggaggctggatccagccgtgggggtccctgagactctcctgtgcagccttcgtgggttcagcatcaagtaacgactacatcgaccgtcggggccccgccgacggccgtaccggaagggggaacggggcgtggggtaggtgggtctcgtaagttattagaaacgngagtggacaactactattatttacttcgtacgtaccgtccggtaggaaccgggtcccggttacccaccccgttctacccgaaggtaaccgacctaacccgttaaccaaaacctaacctacttacctttacgttacttccttaccaactacttacgaacctaacctaacgtcgtagggtaacgacggtaccgaaccggtacccaacccggtacccttaaccgtttaagtttaccggttacggtccggtaccggtaccgtaaacccttagtaccgggttaaacccctacgggtaccccttaaaccgggttaacggtttccccggggttacggggggtaaccccgaaaggggggtcccccg

SEQ ID NO: 154297 - DNA, 687 bp, Homo sapiens
  misc_feature: GYAE6OF01BYBG7.10.38.D05.1.454.CMB.1.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctctgcacgtggaaccngctagtgtactttgtncttaataactatcgtctccgtggtaccagccaccacccgaggaccaaaccggaccccctaaacttcctttggtttttaggacggttacgaggtaacggccggtaccctacgaggtacgtccgtgacgttccggttctcgtcgcctactaagtctgacaacgccgtcctccgtcgaccgtctcgtcggcctcgaggtcctaggagtagtggacgtctagtacttacgtacgtcgctagcctactaacttagtaccggaaccggtaccccgtaaacggtcggggtttacggttccgggggacgggtacggggtaacgttacggggtccggttaaccggttcccggttggggtaccaccgggtacccgacgggtcccgttcccggtcccccggttacggttcccgtaccgtttccccgttcccggttccccctaccccgttccccg

SEQ ID NO: 154298 - DNA, 639 bp, Homo sapiens
  misc_feature: GYAE6OF01EN7K9.10.38.D05.1.454.CMB.1.raw
  modified_base (390)..(390): a, c, t, g, unknown or other
  misc_feature (390)..(390): n is a, c, g, or t
  modified_base (428)..(428): a, c, t, g, unknown or other
  misc_feature (428)..(428): n is a, c, g, or t
  modified_base (630)..(630): a, c, t, g, unknown or other
  misc_feature (630)..(630): n is a, c, g, or t
tcagcatagtagtgcacgaccggtgctcgatttagtatctgatagttggggtttggggggagaggagcccagccactgggattccgaggtgtttccattcggtgatcagcactgaacacagaggactcaccatggagttttggctgagcttgggttttccttgttgctatttacaaaaggtgtccactgtgaggttcaactggtggagacgtggagggaggctggactccaggccgtggggggtccctgagactctcctgtgcagcctgtgggtcagcatcagtaacgactacatgaccgtcgggccccgccgaggccgtaccgaggggaacgggcgtggaggtgggtctcgagtttagtagaaacagatggacaatactataattactntgtacctcgcggtaacgggtcccgttacaccccgtttnaccgaagaaccgtactaccgttaccccaaaaactaaccttatttacccgttaagtttaccttactttcaaacctaggttcacccaactaatccgtaggaagtacgtaccgaacgacgaccgacccttaacgttaattgttcggtacgcgaaccgtagtaactcgaacttccggacttaccgaaaggttggtacgggacccgnggtaacccg

SEQ ID NO: 154299 - DNA, 562 bp, Homo sapiens
  misc_feature: GYAE6OF01A1O2Z.10.38.D05.1.454.CMB.1.raw
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
  modified_base (521)..(521): a, c, t, g, unknown or other
  misc_feature (521)..(521): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(539): a, c, t, g, unknown or other
  misc_feature (536)..(539): n is a, c, g, or t
  modified_base (541)..(562): a, c, t, g, unknown or other
  misc_feature (541)..(562): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcacccacccaggcaaaacgccccccaaatcctttgtttttgaggtcagtaagcggccctnaggactccctgatcggttctctgcctccaagtctggacaacgaccggcctcccgtgaccgttctcgtgggcctccgaggctggaggntggagctgatttacagtgcacgcgctaatcttaccgaccggaccccaaaggtggggttcggtttcgggcgggacggaacgttaaggccgtccgtcggtggcaccgaccgaacggctcccggtcccctcggtcacctttcgtcccgttaccccacccctccttaccctacttaccttgcgtccgtaggaccgggccgggtcgtaccgggaacgtaccgggaccncgtaagtgacngncnnnncnnnnnnnnnnnnnnnnnnnnnn

SEQ ID NO: 154300 - DNA, 602 bp, Homo sapiens
  misc_feature: GYAE6OF01C7JYN.10.38.D05.1.454.CMB.1.raw
  modified_base (291)..(291): a, c, t, g, unknown or other
  misc_feature (291)..(291): n is a, c, g, or t
  modified_base (450)..(450): a, c, t, g, unknown or other
  misc_feature (450)..(450): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcaggacacagggtcctgggccctgtctgccctgattcagcctgcctccgtgtctgggtctcctggacagtcggtcaccatcctcctgcactcggacccagcactgattggttggctattataacttgtctctgtatcaacacgccagacaaacgccccanactcttgatttactgaacgtcaaggtaagccggtcccttcgtagggtttccaggttcgtactttctcgtcgaccctaccgaagtcgtggaccaacgaccggcctccagactaactctcgtggcctcgaggtctacgacgacgagctagtaatattacgngacagtctactaagttagtgtaacgtgtcgggtctccgtttacgtttacgttaacgggtttcgggacgggaacggtaccgtacgggccgtaggtcccggttaccgtaacgtcccgaacggacccgtaaggcccgtcccgtcccccggttccg

SEQ ID NO: 154301 - DNA, 748 bp, Homo sapiens
  misc_feature: GYAE6OF01CWX11.10.38.D05.1.454.CMB.1.raw
  modified_base (318)..(318): a, c, t, g, unknown or other
  misc_feature (318)..(318): n is a, c, g, or t
tcagcatagtagtgcacgaccggtgctcgatttagtatctgatagttggggtttggggggagaggagcccagcacgtgggattccgaggtgtttccattcggtgatcagcactgaacacagaggactcaccatggtagttttggctgagtcgttcgggttttccttgttgtcttatttaacgaaaaggtgtccagtgtgtacgttcaacgtgggtaggagacgtagggaggaggcgtaggactccgacggtcccgggttacgggggtccctggaacgtccttccgttccgtggtcgacgcgtccttcggtcggttacncgactactaacgtaacgtaacgtaacttacgacgtaccggtaccggtccgggaccccgacgtaccgggaccgtaaccggggaagggggaacggggtcggtgggtacggttcgggttaccttaggttaacgtttaaaggttacggaaaataggtacgtagaacctaacgttaatatttaacgtttctacgtacgtaccgtcggtacggaaccggttccgtacccaccctcgaacgaacgtacgaaccttaacctaacctaaacgtacttacttcgtaattcttcgtacagtactcgaactctaacgttcgacgtacggaccgtaccgaacctacgacccgtactaacttgttaccgcgttacgaccgatacgtcgtaaaccgtacgtacccgtactacgttacggtcccggacgggacggtacggtacccg

SEQ ID NO: 154302 - DNA, 712 bp, Homo sapiens
  misc_feature: GYAE6OF01DLSLQ.10.38.D05.1.454.CMB.1.raw
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
tcagcatagtagtgcacgaccggtgctcgatttagtatctgataggttggggtttggggggggtctcaggaggcagcgctctcaggacgtcaccaccatggcctggctctgctcctcctcaccctcctcactcgagggcacgtagggtcctgggcccagtctcgccctgactcacgccctccctccggcgtccggtctcctggacagtcagtcacatcgtcctgcacgtggaaccngtacagtctacttttggtacactttaanaacttattcggtaccttccgtaggtaaccacgacccaacccaacccgaggaaccaaaaccggaccccccttaaaagtttcccttttaggttttagacggtaccaaggttaaaccggccgaccctgacggtacgtcccgtgactttcggttctctcgtaccctacgaagtccgtagaacctaaccgccggtcccttcccgtacgtaccgttctcgtcggtaccgtccgaggactaggagtagtaggacgtcgtagttaacttacgtaacgtcgacgtgcctaacattaccgtacgaccgacccgtaaggtcgggttagtcgggacggtacggtagttaacgggccgtaccggtccggtaggaccgtaacccgtaccggaacggtcccgtaccgtcccccgttaaggtccctaacttcccggttaccgttccccccgtacgtttaacccc

SEQ ID NO: 154303 - DNA, 666 bp, Homo sapiens
  misc_feature: GYAE6OF01C27U6.10.38.D05.1.454.CMB.1.raw
  modified_base (610)..(610): a, c, t, g, unknown or other
  misc_feature (610)..(610): n is a, c, g, or t
  modified_base (656)..(656): a, c, t, g, unknown or other
  misc_feature (656)..(656): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggtttccgttgtgctattacaaaaggtgtccactgtgaggttacaacgtggtggagacgtggaggaggcgtggactccgacgccgtcggggggtccctgagactctcctgtgcacgcctcgttgggttcagctaactcgaagtaaaccgactacaagtcggacccgtcggggcccccgaccgtacggcctaccggagggggaaacggggtccgtagggtaggtcgggttactacgtagttaagttagaaacgagagtcggactaactaactattaatttactctacgtaccgtcggtacggtaacgggtacccggttacctacccgttaccgtaccgaaggaaccgtacctaacttaaccccaaaactaactaacttcttaggtaactcccgttaacactacgttgacctaactacgtctaggaacgtcgtacgacgacaccgactacgttattcgtcgngcgtacgatactcgaaccgtcacttacgtaacgtcggacggggtcngggtaacccg

SEQ ID NO: 154304 - DNA, 733 bp, Homo sapiens
  misc_feature: GYAE6OF01BAQIW.10.38.D05.1.454.CMB.1.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcagtaacgactacagtcgaccgtcgggccccgccgacggcctaccggaagggggaaggggtcctggggtaggtcggggtctacgtaggtttacgttaggaaacgaggtatacgggactaacgttaactaatttaactttacgtttacgtacggtaccgttaccgggttacgggtaaacggggtccccggtttaccctacccccgttacgttaccccgaaggtaaccgtaaccttaacccctttaacccaaaactaaccctaacgtttaccgtttacgttaacttccttaccaacgtattacgacctaaccgtaagtcgtaggaacggtacgtaccggaaccgtaccgaacccggacccttaaccttagttaccgttcggtaccgccggtaccgaatacgtactacccgtactccgttaacttacggttaccggccggggtaccgtacggggtaacccg

SEQ ID NO: 154305 - DNA, 574 bp, Homo sapiens
  misc_feature: GYAE6OF01B194T.10.38.D05.1.454.CMB.1.raw
  modified_base (223)..(223): a, c, t, g, unknown or other
  misc_feature (223)..(223): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
  modified_base (572)..(574): a, c, t, g, unknown or other
  misc_feature (572)..(574): n is a, c, g, or t
tcagcatagtagtgcacgaccggtgctcgatttagtatctgatagttgggtttggggggtccctgagactctcctgtgcagcctctgggttcagcatcagtaacgactacatgacctgggcccgccaggctccagggaaggggctggagtgggtctcagttatgaaacagatggcactacatattattctgactccgtgaagggccgttcaccctctccaganacacttccaacaacatcttgtatcttcacatgcacaatctgagagtcgacgacacggccacctattatgtcgcgcgacatgactacgctcaattcgtggggccagggacgcccgaggtccaccgtcctcccacgtccctaccacccgaacggccctacgtccggtcccttcccccgtggcccgtccctcgcctccgacggacgcccaccgtccggacgacgccgacgccggcccgccggtcggtccgcgtaccgtcgtaacgaaccgtacccttacccttaccctaacttactacgcgtacgtcggaccggccgggtcgtcgggacgacggcgacaagtcngtacgncnnn

SEQ ID NO: 154306 - DNA, 746 bp, Homo sapiens
  misc_feature: GYAE6OF01ANSJJ.10.38.D05.1.454.CMB.1.raw
  modified_base (225)..(225): a, c, t, g, unknown or other
  misc_feature (225)..(225): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcacatctcctgcactggaaccngcagtgtactttgtgcttaataactatcgtctccgtcggtaccagccaccacccaggccaaacgcccccaaactcctttgttttgagtcagtaacgccggcctcgaggacgtccctgtacgttcggttctctacgccctacaagtctcggacaacgccggtccctcccgtgtacccgttctccgtacgggcctaccgaggtcctaggacggtattgggaacggtccttaggtaactttaccgtaacgttcggaccgtacggtccgactaagttaccgttaccgaacccgggtaacccccgaaggttacgggggtttcggtttacgggaccggggtaccgggtaaaccgttacggggtaccgtaccccgggtttaccgggtacggggttacccgaaccgggtacccccgaaacggggttccccgttacccccgggtcccccccggtttacgggtaccccttaacccggtttccccgttacccccgggttttacccccccgtaacccccgtttacccccccgg

SEQ ID NO: 154307 - DNA, 328 bp, Homo sapiens
  misc_feature: GYAE6OF01DXNL0.10.38.D05.1.454.CMB.1.raw
  modified_base (320)..(328): a, c, t, g, unknown or other
  misc_feature (320)..(328): n is a, c, g, or t
tcagcatagtagtgcacgaccggtgctcgatttagtatctgatagttgggtttgggaacctatgaacattctgtaggggctactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctcgcccctggtcactctcgttcccaccctcctccactactatgctgagcggctggcaaggcgcatagnnnnnnnnn

SEQ ID NO: 154308 - DNA, 671 bp, Homo sapiens
  misc_feature: GYAE6OF01B3013.10.38.D05.1.454.CMB.1.raw
tcagcatagtagtgcacgaccggtgctcgatttagtatctgatagttgggtttgggggagaggagcccagcactgggattccgaggtgtttccattcggtgatcagcactgaacacagaggactcaccatggagtttttgctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtcgggccccgccgacggcctccggagggggaacggggcgtgggaggttcggggtctcgtaggttattagaaaaccgagatggactacgtaatattaattcttctgaccttccggtaggacgggtcccgttccacccgttctacccgaaggtacaaccctacccgtttacccaaaaccgtaacttacttacgttttacgtactaccctttccaactagttacgaccaaactacgttcgtagacggttaacgtaccggaacccgtaaccggacccggtaccctaacccgttatttacgttcggtagcccggtacgaacctagtaccgtaacgtacccgcttacgtaacgtttcggccgggggaccgaggggtaaccccg

SEQ ID NO: 154309 - DNA, 523 bp, Homo sapiens
  misc_feature: GYAE6OF01BDKDN.10.38.D05.1.454.CMB.1.raw
  modified_base (206)..(206): a, c, t, g, unknown or other
  misc_feature (206)..(206): n is a, c, g, or t
  modified_base (248)..(248): a, c, t, g, unknown or other
  misc_feature (248)..(248): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
  modified_base (495)..(495): a, c, t, g, unknown or other
  misc_feature (495)..(495): n is a, c, g, or t
  modified_base (498)..(523): a, c, t, g, unknown or other
  misc_feature (498)..(523): n is a, c, g, or t
tcagcatagtagtgcacgaccggtgctcgatttagtatctgatagttgggggtttgggggctttgcctgggtctcctggacagtcagtcaccatctcctgcactggaaccagcagtgactttgttgcttataactatgtctcctggtaccagcaccacccaggacaaagcccccaaacttcttgttttgagtcagtaagcggcctnaggagtccctgatcggttctctgcctaccaagtctggcaacnccggcctcctgaccgtctcgtcgggctcaggctaggagagtggaggtctaggtactttactacgtgcaggccgactagttactccgaacggtaccccctaaagggtaggggttgtttcgggcgggacgggtaacgtaaggtcgaccgtcgtgggcacgccaaggctccgcccgtgcnctctccgtcccnccctcctacctactactatgtctaggacggcggtcgtacggccgaaggccgatagagnacnnnnnnnnnnnnnnnnnnnnnnnnnn

SEQ ID NO: 154310 - DNA, 752 bp, Homo sapiens
  misc_feature: GYAE6OF01CVW8R.10.38.D05.1.454.CMB.1.raw
  modified_base (136)..(136): a, c, t, g, unknown or other
  misc_feature (136)..(136): n is a, c, g, or t
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
tcagcatagtagtgcacgaccggtgctcgatttagtatctgataggttgggtttgggggggagaggagcccagcactgggattccgaggtgtttccattcggtgatcagcactgaacacagaggactcaccatggngtttggctggagcgttgggtttccttgtgctattacaaaaggtntccatgtgaggttcaacgtggnggagacgtgggaggaggctggatccgacggccggtcggggggtaccctggacgtactcctccgtgtgacacggtcctcggttcgggttcaggacctattaacgaacgtaaaccgtactaacaacgtcggtaccccggccgggaccccggaccgagggtcccgtaccgggaagggggaacggggtcgtagggacgggttcgggtacttcgtaaggttacttaacgggaaacagtaatcggaacacttaactattaatttacgtacgtcggtaaccgttcggtaacggggtaacgggtccccggtttaaccacccgtttacccggaccaacggaaccgtaacctaacctttaacccaaaactttaacggtactttcccgtttagtaccttaccttaacaccgttagaactaccaagtacttacggagaacggttacgtaccgacgaaccgtaccacccgtatttaactaggttcggacgtcccgtagtaaactcgtaccgaacgtcgtacgtactaacgggttcgggaaccgggaggttaccggaacccggg

SEQ ID NO: 154311 - DNA, 635 bp, Homo sapiens
  misc_feature: GYAE6OF01CH0BX.10.38.D05.1.454.CMB.1.raw
  modified_base (371)..(371): a, c, t, g, unknown or other
  misc_feature (371)..(371): n is a, c, g, or t
  modified_base (626)..(626): a, c, t, g, unknown or other
  misc_feature (626)..(626): n is a, c, g, or t
  modified_base (632)..(632): a, c, t, g, unknown or other
  misc_feature (632)..(632): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctcgcgtccgggtctcctggacagtcagtcaccatctcctgcactggaaccagcagtgtactttgttgacttataactatgtctcctggtaccagcaccaccaggcaaacgccccaactcttgttttgagtcagtagccggcctgaggactcctgattccggttctctcgtcctcaagtctggaccaacgaccggccctcccgtgtacccgtctcgtcgggcctcgaggtctggaggtatggnggtctggtaactttactacgtggcaggtcgactaattacgttacgaccggacccgtaacggtggggttacggttcggggacgggtacgggtacggtaacgggtacggtacccgttcggtcgggtaccgacggtaccgaaccgggtcgtacccggtccccggttacggtacctaccgttccgttccgttaccccggcccttccctacctacctacgtactcgcgtaggcggcggtcgtacgggacgtaacggcgancgtagngtc

SEQ ID NO: 154312 - DNA, 871 bp, Homo sapiens
  misc_feature: GYAE6OF01BMREI.10.38.D05.1.454.CMB.1.raw
  modified_base (687)..(687): a, c, t, g, unknown or other
  misc_feature (687)..(687): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatgggtagttttggctgagtcttgggttttccttgttgcttatttacgaaaaggtgtccactgtgaggttcaacgtggtggagacgtgggaggaggctggactccgacggccggtcggggggtccctggacgtacctccgtccgtggtcgccgtagtcccgttcgttcggggtttcacggactaacgttaccgaaacggtaaaccggtaacctaaccgtaagttaccggaaccccggtccgggggacccccgacccggacggggacccgtaccgggaaggggggaaacggggtccgtaggggaggttcggggttacctaacggttaaggtttaacggttaacggaaaaaccgtaggtaacgtcgggtaaccctaaacttaactaagtttaactttaacgttccgttacggtaacccgtttaccgggtaagggtaaacccggggttcccggttaaccctaccccgttaccgtacccggaagtaccccggtaaaccttaaccccgttaaaccaaacccgttaaagtaccttttacgtttaacgttacttacccctttaanaaccctaacgtttgaacccctaaagtaacgttccgtaagggaaccgttaaccggttacccgaaaccggtacccgtacccggtaaccttaaaccgttattcgtttacggaccgtaccgtacgtaacgtagtaccgtaccgtcctaccgtaattaccgggtttacggcggggtacccgtaacgggg

SEQ ID NO: 154313 - DNA, 629 bp, Homo sapiens
  misc_feature: GYAE6OF01BQJ1U.10.38.D05.1.454.CMB.1.raw
  modified_base (258)..(258): a, c, t, g, unknown or other
  misc_feature (258)..(258): n is a, c, g, or t
  modified_base (600)..(600): a, c, t, g, unknown or other
  misc_feature (600)..(600): n is a, c, g, or t
  modified_base (603)..(605): a, c, t, g, unknown or other
  misc_feature (603)..(605): n is a, c, g, or t
  modified_base (608)..(611): a, c, t, g, unknown or other
  misc_feature (608)..(611): n is a, c, g, or t
  modified_base (613)..(625): a, c, t, g, unknown or other
  misc_feature (613)..(625): n is a, c, g, or t
  modified_base (627)..(629): a, c, t, g, unknown or other
  misc_feature (627)..(629): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgccccaaactccttgttttgaggtcagtaagcggcctgaggactccctgacttcggtttctctcgcctcagtctggcaacgacggcctccngaccgtctcgtcgggctccgaggctggaggactggacggtctgtactttacacgtgcagcgacgtatacgttcaaccggcccctaaaggtggggtttcggtttgggaccggggtacggtaacgttaacgggtccggtaacccggttcggtggggtacccaacggtaccccgtaaaggtcccggttcccggtcccccgttcgggtacctaccgttccggtttacccggttccccccgtcccttacccgtacccctaaaccttccgttaagtcccggttactacgggtacccggggtccggtcgtaccgggacgtaaccgggccgagtaaccgtgctcgagccntannncgnnnncnnnnnnnnnnnnncnnn

SEQ ID NO: 154314 - DNA, 671 bp, Homo sapiens
  misc_feature: GYAE6OF01DOFK5.10.38.D05.1.454.CMB.1.raw
  modified_base (240)..(240): a, c, t, g, unknown or other
  misc_feature (240)..(240): n is a, c, g, or t
tcagcatagtagtgcacgaccggtgctcgatttagtatctgatagttgggtttggggggggtctcaggaggcagcgctctcaggacgtcaccaccatggcctggctctgctcctcctcaccctctcactcagggcacagggtcctgggcccagtctgccctgactcagcctccctcgcgtctgggtctctggacagtcagtcacatctcctgccacgtggaaccagcagtgtactttgtnacttaataactatgtctctggtacacgcaccaccgacggaccaaacgacccctaaacttccgtttagttttacggagttacagtaacgccgcctacgacgtacgtcctgtacgtcggttctcgtcgcctcgaagtcgtacgactaaccgacggtccctccgtcgaccgttcgtacgtcgggcctacgacggtcgtaggacggtacgtcggacggtcttacgtactttaacgtacgtcgacgtacgcgtactaacgtttacgttacccgaaccggtaaccccgtaaacgggttaggggttcgttttacggggaccgggtacgggtaacgtaacgggtccgtaacccggttcgtacgggtaccaccggtaccggtaccggtccgtacccgtccccggtcgtacctaccgttcccgtccgttccccttaccccg

SEQ ID NO: 154315 - DNA, 810 bp, Homo sapiens
  misc_feature: GYAE6OF01ER6Q9.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttacgaaaaggtgtccactgtgtaggttcaacgtggtggagactgggaggaggctggactccgagccgtgggggtccctgacgactctccgtgtgcacgtcctcgtggtcagcactacgaagtaacgactacagtcgaccgtcgggccccgcgacggccgtaccggaggggaacgggtcgtagggtacggttcggggtacctacgtaaggtttaagttaacggaaaacgtaggtaacgtacggaacctaacgttaactaatttaactttacgtttccgtacgtaacccgttaccgggtaacgggtaacccggggttcccgtttacccgtaaccccgtttcgtaaccccgaaaggtaaaccgtacccttaacccgttaaaccccgaaaaaccttaaccttaacgtttacccgttttaacgtaacctttaccctttaaccgaaaacccgtagtttacggaaccccttaaacgttaacgttccgtaagggaaacgttaccgggtaacccggaaacccgtaccgacccggtaacccttaattaacgtttacgtttcggacgtacccgacggtaactacggttacccgaaccttacgaccttaacgttaacggttccggggaccggggaccgtacggggtaaccccc

SEQ ID NO: 154316 - DNA, 749 bp, Homo sapiens
  misc_feature: GYAE6OF01AFSAQ.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggcgtggatccgaggccgtggggggtccctggacgacctctcctgtgcagcctcgtggttcagctactcaagtaacgactacagtcgaccgtcgggccccgcgacggcctaccggaagggggaacggggtcgtagggtaggtcggggtctacgtaggtttaatacggaaacgtaggtacgtacggtaccaacgtaacgtaacttaatttaacttcgttacggtaccgttaccggtacgggaaccggggttcccggttacctacccccgttctacccgaaggtaaccgtaaccctaaccgttaacccaaactaacctacttaccgtttacgttacttacccgtttacaacgttacgttcgaaccgtaactaacgtccggtagaacgggtacgtacccgggaaccgtaacccggtacccggtaccccttaactttacgtttacgttacgggtaccgccggaaccgtacgtacgttacccgtaaccgttacgtacccttacgttaaccggttccgggtacggggacccgtaaccgggg

SEQ ID NO: 154317 - DNA, 780 bp, Homo sapiens
  misc_feature: GYAE6OF01BDOXQ.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgcctcctcctcaccctcctcactcgagggcacgacgggtccgtcgggccctagtctcgccctgactcacgccctccctccgccggttcccgggtctccgtggacacgtcacgtccaacctactcctccgtgccacgtacggaaccagactaggttcgttacgtttttggttacgttactttaaactaacttagttccgttaccttccggttacgtacccacgacccaacccgaaccgaacggaaccgaaaccccgtacccccctaaactttccgtttttaggttttggacgtacgtaacggtaccggcccggtccctaggaggtccttccgtagtacgtttcgtctcgtcgtccctacgtaacgtcgtcgaacccgacgtcccgtccctccgtaccgtaccggttctcggccggtcctacggacggtcgtacggaggtcgacggacgtcgttacgtaaccttacgtacgtcgaccgacgtccgtactacgttaccgttaccggaacccggttacccgtaagggttcggggtttcggtacgggacccgggtacgggtaacggtacgggtcccgtacccggttgggtaccgtaccggaccgtacccggacggtccgtcccccgccccggttcgtaccgttacccttcccgtcccgttccccgtaccccttccg

SEQ ID NO: 154318 - DNA, 644 bp, Homo sapiens
  misc_feature: GYAE6OF01AJUKL.10.38.D05.1.454.CMB.1.raw
  modified_base (352)..(352): a, c, t, g, unknown or other
  misc_feature (352)..(352): n is a, c, g, or t
  modified_base (398)..(398): a, c, t, g, unknown or other
  misc_feature (398)..(398): n is a, c, g, or t
  modified_base (641)..(641): a, c, t, g, unknown or other
  misc_feature (641)..(641): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctccgtggtaccagcaccacccaggcaaacgccccaaacttccttgttttgaggtcagtagccggccctcaggacgtccctgactcggttctctgcctcaagtctggcaacgcgcctccctgacccgtctcgtcgggcctccgnggtcctggaggtatcggaggtcttaggtactttactaccgtgaccnggcgtactaattacgttaccgaccgggtacccccgaacgggtacggggttcggtttcgggccggggtacgggtaacgtaacggggtcgtacccggtccggtcgggtaccgacgacccgacggcccgtccgtcccccgtcggtcctaccgttccgttcccgttcccctaccccttccctaccctaccttacctacgtcgccgtcggacgggccgggtcgtcggaccgtaacggccgacacgtgntcg

SEQ ID NO: 154319 - DNA, 250 bp, Homo sapiens
  misc_feature: GYAE6OF01BJ1HV.10.38.D05.1.454.CMB.1.raw
  modified_base (142)..(142): a, c, t, g, unknown or other
  misc_feature (142)..(142): n is a, c, g, or t
  modified_base (232)..(250): a, c, t, g, unknown or other
  misc_feature (232)..(250): n is a, c, g, or t
tcagcatagtagtgcacgaccggtgctcgatttagtatctgatagttgggtttgggtgccgaagttgctggaggtcaccgtctccccagcctccaccaagggcccatccggtccttccccctggccgccctgctccaggacncacctcagagagcacagcggccctgggctgcctggtcaaggactaccttcccatactatgctgacgcgggctggacaaggcgacagtagnnnnnnnnnnnnnnnnnnn

SEQ ID NO: 154320 - DNA, 707 bp, Homo sapiens
  misc_feature: GYAE6OF01B63YB.10.38.D05.1.454.CMB.1.raw
  modified_base (369)..(369): a, c, t, g, unknown or other
  misc_feature (369)..(369): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagtttttgctgagctgggttttccttgttgctatttcaaaaggtgtccactgtgaggttcaactgggtggagactggaggaggctggatccagccgtgggggtccctggagactctcctgtgcacgcctctgggttcagcatcagtaacgactacatcggaccgtcgggccccgccgacggtcctccggaggggaacggggctgggagtcgggtctacgtagttattacgaaaacnggaacgtggactaacgttaaccatttaagttactttactcggtaccgtccgggtaggtaaaccggggtcccggtttaccgaaccccgttcctacccgtaaggacgtaacctaccgtttaaccccaaacgaactactttaccgttacgttacttaccgttaccactacgttcactaacgtaattccgagaaggtaccgtaccggaacccggacgacccggtaccctaaccttacgtttaacgttggtaccgaccggtccgtaacgaacgttcgaacccgttaccgacttaacccgtaaacggtttccgggtcgggggaccccgtaaggggtaaccccgg

SEQ ID NO: 154321 - DNA, 755 bp, Homo sapiens
  misc_feature: GYAE6OF01B8THY.10.38.D05.1.454.CMB.1.raw
  modified_base (644)..(644): a, c, t, g, unknown or other
  misc_feature (644)..(644): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtccacatctcctgcacgtggaaccagcagtgtacttttgtgcttaataactatgtctccgtggtaccagccaccacccgaggaccaaaccgacccccctaaacttccgtttagtttttaggacggttacaaggtaacggccggtaacctcgacggtacgtccctggacttcggttcctcgtcgtcctacgtaagtcgtacggaccaaaccgtccggtcccctacccgtagaacctaacttcgttcggtcgggtacctccgtacgggtcctacgggaaccggtaacggtacggtacgttaaggtaaactttacgtttaacgtcgaccgtacgtaccgtactaagttagttacgggttaagtaacggttcgggttccgttacccttttcgttttaaccgggttaaggggttttcccgggaacggggtaacgggtaacccggngggtacccgttaccggtacccggttaaccgtaacggttccggaacccggtaaccccgtaaccgggtcccttaaccccggtcccccgttacgggtcccttacccgttcccgg

SEQ ID NO: 154322 - DNA, 655 bp, Homo sapiens
  misc_feature: GYAE6OF01CJ0ZI.10.38.D05.1.454.CMB.1.raw
  modified_base (227)..(227): a, c, t, g, unknown or other
  misc_feature (227)..(227): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgacactggaaccngcaagtgtactttgtgcttaataactatgtctctggtacagcaccaccagacaacgaccccaaactccttgttttgagtcagtacgcgcctgaggacgtcctgactcggtctctcgcctacgaacgtcgtggacctaacgaccggtccctccctcgaccggtctacgtcgggcctcgaggcctgagtagtggaggctagtacttactacgtcgcacgcgtactagtacttaccgaccggtaccctaaggtagggtttcggttcggggacgggtaccgggtaacgttaacgggccggtacccggttccgggtacgggtaccgaaccggtaccccggtaaacgggccccgttacccggtaccccccggttcgggtacccttaaacccgttcccgttttaccccgttcccccggtaaccccctttcccccg

SEQ ID NO: 154323 - DNA, 551 bp, Homo sapiens
  misc_feature: GYAE6OF01E3AC1.10.38.D05.1.454.CMB.1.raw
  modified_base (528)..(551): a, c, t, g, unknown or other
  misc_feature (528)..(551): n is a, c, g, or t
tcagcatagtagtgcacgaccggtgctcgatttagtatctgatagttgggggtttgggggctttgcctgggtctcctggacagtcagtcaccatctcctgcactggaaccagcagtgactttgttgcttataactatgtctcctggtaccagcaccaccaggcaaacgcccccaaactccttgtttttgaggtcagtaagcggccctcaggacgtccctgatcggttctctgcctccaagtctggcaacacggcctccctgaccgtctcgtgggcctccaggctggaggatgaggctgattactactgcagcgactatattccgacggacccccaaaggtggggttgttcgggcgggacgggtaacgtaaagggtcgaacccgtccgtggggtccacggtaccccgaaggccctccggccccccgttcggtccaccttccgttccgttacccccgaccccttcccctcctaaccttactactcgcgtggaacggcggggacgtgggaccgaaacgggccgacagtcgnnnnnnnnnnnnnnnnnnnnnnnn

SEQ ID NO: 154324 - DNA, 779 bp, Homo sapiens
  misc_feature: GYAE6OF01CFOV4.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcacgccctccctccgcgtccggtctcctggacagtcagtcaccatctcctgcactggaaccagcagtcgtacttttgtcgtacttaatactatgtcctccgtacggtaccagaccaccaccgacggaccaaaccgtaccccctaaactttccgttttaggtttttacggacggttaccgtaaagggttaaccggcccggtaccctacggtaacggtccgttaccccgtaggtaaccgtttccgggttacctccgtacgtccccttaaccgtaacggttccgtaccggaccctaaaccggacccggtccccttcccggtacgtaccccggttcgttaccggttaccggggtccctaccggtaaggtccgtagggtaacggtagtacgggtacgtacgttagttaaccttacggtacgtgaccgtacgacgtactaagttaccgtaccgaacccggtacccgtaaggtcgggttcgggttacgggaccgggtaacgggttaacgtacggggttaccgacccgggttacggtacgggaccgacggtacccggaacggtccgtaccccgtcccgttagtccctacgtcccgttccctaccccgtcccttaccccg

SEQ ID NO: 154325 - DNA, 597 bp, Homo sapiens
  misc_feature: GYAE6OF01ANUWM.10.38.D05.1.454.CMB.1.raw
  modified_base (310)..(310): a, c, t, g, unknown or other
  misc_feature (310)..(310): n is a, c, g, or t
  modified_base (445)..(445): a, c, t, g, unknown or other
  misc_feature (445)..(445): n is a, c, g, or t
  modified_base (458)..(458): a, c, t, g, unknown or other
  misc_feature (458)..(458): n is a, c, g, or t
tcagcatagtagtgcacgaccggtgctcgatttagtatctgatagttgggtttggggggggtctcaggaggcagcgctctcaggacgtcaccaccatggcctgggctctgctgctcctcaccctcctcactcaggacacagggtcctgggccctgtctgccctgactcagcctgcctccgtgtctgggtctcctggacagtcggtcaccatctcctgcacgtcggacccagcactgatggttggactattactaaccttgtctcctgtatacaacacgccagacaaaccgccccacactctagtatttanagaacgtcagtaacgcggtccctcgtagggttctagtcgtcttctctcgtccctacagtcgtcggaccaaccgtaccggtccctcccgtacgaactactccgtacggtcggccttccgaggctacgacgacgcgntagaattactacngctacgctactaatgtagtagtagttggtctccgtttacgttacggttacgggtttcgggacgggtacggtaccggtagtcgttcccgtaaccgtacgtacggtaccgtaccgaccgtacggcccttcccggtcccccg

SEQ ID NO: 154326 - DNA, 653 bp, Homo sapiens
  misc_feature: GYAE6OF01B07QC.10.38.D05.1.454.CMB.1.raw
  modified_base (394)..(394): a, c, t, g, unknown or other
  misc_feature (394)..(394): n is a, c, g, or t
  modified_base (649)..(649): a, c, t, g, unknown or other
  misc_feature (649)..(649): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgcttataactatgtctcctggtaccagccaccaccaggaccaaacgcccccaaactccttgttttgagtcagtaagcggccctgaggactcctgactcggttctctgcctccaagtctggcaacgcggccctcccgtgacccgtctcgtcgggctccgaggctggaggatggaggctgtattactactgcagccgtanaattacttcgaaccggtaccccaacggtacggggttggtttacgggaccggggtacgggtaacgttaacgggtccggtaacccggttccggtacgggtaccacggtacccgaacgggtccgtccggtccccccgttcgggtacctacccgttccgttacccggttccccgtccccttaccctccctaccttaccgtacgtcggtccgtaggacgggccgggtcgtacgggaccgtaacgggccgtactacgtagngtcg

SEQ ID NO: 154327 - DNA, 638 bp, Homo sapiens
  misc_feature: GYAE6OF01BO97M.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactcggaaccaggcagtgactttgtgcttatactatgtctctggtaccagcaccaccaggccaaacgcccccaactcctttgttttgagtcagtaacgcgcctcgaggtacgtccctgacttccggttctcgtcgcccttaccaaggttcctacggaccaaccgtacccggccctcccgtcggtaccccgtcttccgtcgggccctccgacggctaggacggtatcggaagtctagtattaccgagtgacagcgactattacgttcgaaccggaccccgaaggttacggggttcggttcgggccgggtacgggaacttagggtcgtacccggtcgtacgggtcacggtacccgagggtcccgtacccgtccccccgttagggacccctacttcccgttccgttcccccgccctaccccg

SEQ ID NO: 154328 - DNA, 695 bp, Homo sapiens
  misc_feature: GYAE6OF01ESY4F.10.38.D05.1.454.CMB.1.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctcgccctgactcacgccctccttccgccggtccgggtctccgtggacagtcagtcaccatcctctgcacgtcggaaccagcagtgtactttgtntacttaataactnttcgtcctcgtcggtaccagccaccaccgaggaccaaaccgaccccctaactttccgtttggttttacgacggtcaaggtacgccgtccctagacggtcgttccgtgtacgttcggttctctcgtcctacgacgtctacgacaaccgccggtccctccgtacgtccgtcgtcggtcggacctcgacggtcgtagggagtcgtaggtacgtcttacggtaacttacgacgtcgacgtacgactacttactacgttaccggaccggtaaccggtaaggttcggggttcggtacgggaccgggtaacggttaacgggtacggtcggtacccggttcggtacgggtaccgacccgggaccgtaccggtccgtaccccgggtaccccgtcggttacctacccggttcccttaccccgttcccccgcccttacccg

SEQ ID NO: 154329 - DNA, 916 bp, Homo sapiens
  misc_feature: GYAE6OF01BQBBN.10.38.D05.1.454.CMB.1.raw
  modified_base (283)..(283): a, c, t, g, unknown or other
  misc_feature (283)..(283): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgtcttataactatgtctccgtggtaccagcaccaccgaggaccaaacgccccaacttcctttgttttgagtcagtaagccggccctnaggacgtccctagattccggttctcgtcgccctaccgtaagtcgtacggaccgaacgaccgggtccccttccccgtacgtaccccggtttcgttacccggttcgggggtcccttacccggaacggggtccgttaggggtaacgggtaacgtttacgggaacggggtaccttacggttaaacgttttaacccttaaccggttcggaccgtaacgggtcccggtaccttaacgtttaaccgtttaccggaacccgggtaaccccccgtaaacgggtttacggggggtttacgggtttacgggggacccgggggtaacccggggtaaccggttaaacggggttacccgggtacccgggttacccggttacggggtacccgaaccggtacccccggtaaacgggtcccgttccccggtacccccccggttaccgggttacccctacccgtttaccccggtttccccggtttcccccccggtacccccttaccccgttcccccgttaaaccgtttacccgtaacccggtttacccggtccggttacggggaaccccgggggttcccgggggtaccggttaccggggtaacccggtaaacccggggtaccggtacccggttaacggttacggcgtacgg

SEQ ID NO: 154330 - DNA, 908 bp, Homo sapiens
  misc_feature: GYAE6OF01C3SRN.10.38.D05.1.454.CMB.1.raw
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (279)..(279): a, c, t, g, unknown or other
  misc_feature (279)..(279): n is a, c, g, or t
tcagcatagtagtgcacgaccggtgctcgatttagtatctgataggttggggtttggggggtctcaggaggcagcgctctcaggacgtcaccaccatggcctgggctctgctcctcctcacctcctcactcaggcacagggtcctgggccagtctgccctgactcacgccctccctccgcgttccgggtctcctggacagtcagtcaccattccnctgcacgtcggaaaccngcagtcgtactttgtntacttaataactatctactcctacgtaccanaccaccaccgaggaccaaaccgacccctaaactttccgtttagttttagacgtactaaggtaaccgccggtccctacgaacggtacgtcccgttagtacgttccggttctccgtcgtaccctaccgtaacgtcgtacggaaccgaacccgtaccggtccccttaccgtccggtaaccccggttccgttaccgggttcggggtacccctaccgggtaacgggtcggttaacgggacgggttaaacgttcgggtaaacgggttaccgtttaaagttaaaccgttttaaccggttaaaccggttgtacccggaaagtccccgttaagtaaaccgttttaaccgtttacccggaaaccccgggaaccccgtttaaaccggggttaacgggggttttaccgggtttaccggggggaacccggggttaaccggggttaaacgggtttaaaccgggttcccgggtaaccccgggtttacccgggttacgggtaacccgggaacccgtaaaccccgggttaaccgggttcccccgttaacccccggtacccccccgggttttggtaacccccgttaacccgtttttaccccggttaaccccccgggtttaacccccctaccccccggtttaaccccg

SEQ ID NO: 154331 - DNA, 662 bp, Homo sapiens
  misc_feature: GYAE6OF01A3NPV.10.38.D05.1.454.CMB.1.raw
  modified_base (237)..(237): a, c, t, g, unknown or other
  misc_feature (237)..(237): n is a, c, g, or t
  modified_base (322)..(322): a, c, t, g, unknown or other
  misc_feature (322)..(322): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtccctgggcccagtctgccctgactcagccctccctccgcgtccgggtctcctggacagtcagtcaccatctcctgcactggaaccagcagtntactttgtgcttataactatgtctcctggtaccagcaccaccaggcaaacgcccccaaactccttgtttgagtcagtagcgcctnagacgtcctgacttcggttctcgtacgcctacaagtcacggaccaacgaccggtccctccctgaccgtctcgtgggcctccgaggctaggaggtactggacggtctaggaactttacctacgtcgacgtagcccgataacgttaacttccggaaccggtacccctaaagggtacggggtttggtttccggggaccgggttaccggggtaacttaacggggtccgacccggttcccgggtagggtacccgaccgggtacccgaacgggtccctacccggtcccccccgttccgggtacctacccgttaccgttccgttacccccccgtccccgttaccccg

SEQ ID NO: 154332 - DNA, 733 bp, Homo sapiens
  misc_feature: GYAE6OF01EU0QR.10.38.D05.1.454.CMB.1.raw
  modified_base (267)..(267): a, c, t, g, unknown or other
  misc_feature (267)..(267): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagtcttaggttttccttgttgctatttcaaaaaggtgtccactgtgaggttcaacgtggtggagacgtggaggaggctggatccgagtccggtcgggggtccctgacgactctcctgtcgcngcctcgtggttcagcactcaagtaacactactacgtcgaccgtcgggccctccgacggtccgtaccggaagggggtaacggggcgtggggtaggtttcgggtccttacgtaagtttaagtacggaaaaccgaggtagtcggaactaacgtactagtttactttacttcgtacgttacctccggtaacgggaaccgggtcccgttacctaccccgttcgtacccgtaaggtacgtaacccctaacgttaaccccaaaacctaacgtcttactttacgtacttccttacacgtactacgtactaactaaccgttcgaggaccgtacgggtaccgaacgtacccgacccggtaaccctaccgtttaatttacggtttcggacgtaccgggtaacctaggtacttaccggaacgttcccgtaccttaccgtacggttaccgggtcgggtaaaccgacgggggtaaccccg

SEQ ID NO: 154333 - DNA, 844 bp, Homo sapiens
  misc_feature: GYAE6OF01AZ4AI.10.38.D05.1.454.CMB.1.raw
tcagcatagtagtgcacgaccggtgctcgatttagtatctgataggttgggggtttgggggggggtctcaggaggcagcgctctcagggacgtcaccaccatggcctgggctctgctcctcctcaccctcctcactcgagggcacgagggtcctgggcccagtctcgccctgactcacgccctcccgtccgcgtccgggtctccgtggacaggtcagtccaccatcctcctgaccacgtaggaaccagcctaggttcgtacttttggtagtacttaataacttattcgtccttccgtggtaccacgaccaacccaacccgaggaaccctaaacccgtacccccctaaaacgttccgttttaggttttacggacggttacgtaacggtaaccggcccggtacccctacggaacgggtaccgttcccgtaggtacgttccggttaccttccgtccgtccccgtacgtaacggtccgtacggacctaacccgtaccggtccccttacccgtcggtacccgtccgtccggtcgggtaccctaccggtaggtaccgtgggtaaggtacggtacgggaacggttccgtaagggttaacctttacccgttagtacggtacgtacggtccgtaagttaaccttaccgtaccggaacccggtaccccggttaagggttacgggggttcgggtttaccggggacccggggtaccgggttaaacgttaccggggtaccggtaccggttccgggttaccgggtaccgaaccggtccccggaacggttcccgaccccggtcccccgtacggttcccacccgtttacccggttcccgttcccccgtcccttaaccccg

SEQ ID NO: 154334 - DNA, 854 bp, Homo sapiens
  misc_feature: GYAE6OF01BWRNH.10.38.D05.1.454.CMB.1.raw
  modified_base (655)..(655): a, c, t, g, unknown or other
  misc_feature (655)..(655): n is a, c, g, or t
tcagcatagtagtgcacgaccggtgctcgatttagtatctgatagttggggtttgggggggagaggagcccagcacgtgggattccgaggttgtttccattcggtgatcagcactgaacacagaggactcaccagtggtagttttggctgagtcgttgggtttttccttgttgtacttatttacgaaaggtcgtccacgttggtaggtacggttacaacgtgggtagggaggacggtggggagggaggtcgtaggactccgacggtccgggtcggggggtccctaggacgtaccttccgtccgtggtcgacgtcgtccgttcggttcgggtacacgactagtacgtaacgtaaccgactacgtagtaccggtaccggtcccgggccccgaccggacgggtacccggtaccggggaggggggtaacggggtcgggtaggggtacgggttcgggtaccgttaacggttaagtttaacgtaacggaaaacgtacggtacgtacggaacctaacttaacgtaatttaacgtttacttacgtacgtaccgttacgggtacggtaccgggtcccgttacccacccgtacaccggtaacgaacgtaacccctacctaaaccaactaacttactttacgttacttaccttcgtaacctaactntaccgaactaaccgttaatccggtaaacgaccggtaccgtaacccggtaaccggtaacccgtaccccgtaaccttaacgtttacttacggttaccgcggaacccgtacgtaaccgtacgtttacccggtaaccgtacccgttaaccgttacggtaacggttacccgggggtaccggggaacgggtaacccggtacccgg

SEQ ID NO: 154335 - DNA, 889 bp, Homo sapiens
  misc_feature: GYAE6OF01EOE2B.10.38.D05.1.454.CMB.1.raw
  modified_base (795)..(795): a, c, t, g, unknown or other
  misc_feature (795)..(795): n is a, c, g, or t
  modified_base (809)..(809): a, c, t, g, unknown or other
  misc_feature (809)..(809): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcaccagtggtagtttggctgagtcgttgggttttccttgttgacttatttaacgaaaaggtcgtccatgtgtaggttacaagtgggtggagacgtgggaggaggtcgtggactccgacggtcccgggttcgggggtccctaggtacgtcctcctcgtggtcgacgcggtccttcggtcggttacacgacacgtaacgtaacgtaaacgtactacacggttccggaccggtccgggacccgaccgggacggtccgggtaccgggaaagggggtacgggtcggtacgggtacgggttcggttacttaacggttaagtttaaacgtaacggtaaaccgtagtaacggttaccggaacctaactttaaacgttaacttttaacttttaacgtttaccgtaacgttacccgggttaccgggttaacggggtaaccccgggttacccgttaccctaaccccgttaccgtaacccgaacggtaaacccttaaccgttaaaccccttaactaaaacctaaccgtttctttacttaaccgttttactcccggtttaaaccacgtaaccggtcctaacccttaagtacccggttacgtaacggggaaccgtaaccgggttaacccgaaccgtaacccggtaccggttaacccttaagtttaacgtttagtccgggaccncggtaaccgttaanaccgggtttaaccaaaccggttacacccgttacgttaaccgggttcggggaaccccggggttaggaacccgggtaccccg

SEQ ID NO: 154336 - DNA, 589 bp, Homo sapiens
  misc_feature: GYAE6OF01DB3SE.10.38.D05.1.454.CMB.1.raw
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (558)..(558): a, c, t, g, unknown or other
  misc_feature (558)..(558): n is a, c, g, or t
  modified_base (562)..(589): a, c, t, g, unknown or other
  misc_feature (562)..(589): n is a, c, g, or t
tcagcatagtagtgcacgaccggtgctcgatttagtatctgatagttgggggtttgggggctttgcctgggtctcctggacagtcagtcaccatctcctgcactggaaccagcagtgactttgttgcttataactatgtctctggtaccagcaccaccaggcaaacgcccccaatcttgttttgagtcagtagcggcctnaggngtccctgattcggttctctcgcctaccaagtccgtggaccaacgccggccctcccgtgacccgtctcgtgggcctccgaggctggaggatggacggctagtactttacctactcgacgagccgactattacttacgaccggaccccaaggtaggggttcggttcgggcgggacgggtaacgtaggtcggtacccgtcggtcgggtacacggacccgacggtccctcccggtcccccgttcggtccctaccttccgttacccgttccccctaccccttccccgtacctaccttacctacgtcggtacgtcgggacgggtccgggtacgtcgggacggaccgggcgacgtactagngacnnnnnnnnnnnnnnnnnnnnnnnnnnnn

SEQ ID NO: 154337 - DNA, 892 bp, Homo sapiens
  misc_feature: GYAE6OF01BA73L.10.38.D05.1.454.CMB.1.raw
  modified_base (208)..(208): a, c, t, g, unknown or other
  misc_feature (208)..(208): n is a, c, g, or t
  modified_base (887)..(887): a, c, t, g, unknown or other
  misc_feature (887)..(887): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccggtctcctggacagtcagtcaccatctctgcactggaaccagcagtgtactttgttcgacttaataactntcgtctccgtggtaccagccaccaccgaggaccaaaccgccccctaaacgtttccttttggtttttagacggttactaacggttaacggcccgggtccctacggaacggtaccgttcccctaggttaccgttccgggtttcctctaccggtaccccttaccgtaacgtttcccgaggtacccaaaccggtacccggtccccttaccccgtacgtaacccgttcgttccgtaccgggtacccttacccggaggtacccgttaggggaaaggttacgtacgggaacgggtacttaacgtttaaccgtttaaccgtttaaccggtcgaacccggttacggacccgtaacttaacgttaccgtttaaccccggaaacccggttaaccccccggtaaagggttacggggggttttaccgggtttaccgggggtaaccgggggtaacccggggttaaaccggtttaacgggggtacccggttaacccccgggttccgggttaccggggtaacccgaaccggtaaccccggtaacccgggtccgtttcccccgggtccccccggtttacgggtacccttccccgttacccgtttccccgttccccgtaccccttcccgtaaccttacccttacgtacgtcgtccgtaggccgggtccggtacgtggaccgtacggctaacgcgtancgtcg

SEQ ID NO: 154338 - DNA, 597 bp, Homo sapiens
  misc_feature: GYAE6OF01DMVD4.10.38.D05.1.454.CMB.1.raw
  modified_base (577)..(577): a, c, t, g, unknown or other
  misc_feature (577)..(577): n is a, c, g, or t
  modified_base (582)..(597): a, c, t, g, unknown or other
  misc_feature (582)..(597): n is a, c, g, or t
tcagcatagtagtgcacgaccggtgctcgatttagtatctgatagttgggggtttgggggctttgcctgggtctcctggacagtcagtcaccatctccctgcactggaaccagcagtgactttgttgcttataactatgtctcctggtaccagcaccacccaggcaaacgcccccaaactccttgtttttgaggtcagtaagcggccctcaggagtccctgactcggttctctcgccctccaagtctggacaaccgaccggccctcccgtcgacccgtctcgtcgggctccgaggctaggacggatggacgtctgtatttaacctacgtgaccgaaggccgactatactttaccggaccggtacccccaaaggtagggggtttcgttcggggaccgggtcgggtaacgttaacgggtccgtacccggtcggtacgggtcgaaccgacccggaacggtccctccggtcccccttcgggtccctaccgtttctccccgttcccccgtcccccttacccctaccctacctttacctacgtcgtaccgtggacgggccgggacgttcggacgacggcgacntacgnnnnnnnnnnnnnnnn

SEQ ID NO: 154339 - DNA, 818 bp, Homo sapiens
  misc_feature: GYAE6OF01AHP03.10.38.D05.1.454.CMB.1.raw
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgtcttataactatgtcctctggtaccagcaccaccgaggaccaaacgtacccccctaaacttcctttcggtttttggacggttccaaggtaacggccggtaccctcgagggtacgtaccctgtattccggttctctcgcctaccgaagtctgacgaacgaccggtccctaccgtcgtaccgtcgtcgtacgggtcctaccgcggtactaggaacggtagtcggtaaggtccgtaggtaactttaccggtaccgttggaccgtacggtacctacgtaacgttacgttaccgacccgggtaccccgtaacgggtacggggtttcgggtttacggggacggggtaaccgggttacggtaacggggttaccggtacccggttccggtacggggtacccggaacccggtacccgggtaaccggttccccggtacccggtacccccccggtttccgggtaccttaacccggtttcccgtttacccggtttaccccccggtcccgttaccccgttaccctaccggtttaaaccgttaacgttccgggtaccggttcggtaaccggggtccggggtaccggtacgggtacccggtaacggtaccggttaaccggacgttaggtcgtacgg

SEQ ID NO: 154340 - DNA, 715 bp, Homo sapiens
  misc_feature: GYAE6OF01DSUCO.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgacgactctcctgtgcacgcctcgtgggttcagcatcaagtaacgactacatgaccgtcgggccccgccgagggcctccggagggggaacggggcgtgggagttggggtctcgtacgttaagttagaaacaggtagtcggcaactactaatttaatttaattcgtacgtaccgttcccggtaggaaaccggggttcccgttaccgtaccccttccgtaccgaacgacgaaccctaccgttaacccaaactaacctacgtttacctttagttaacttccttaccaactaacgtcgtccaaacgtaacttacgtagtaacggaacggtccggtaaccggaccgtaacccgggaccctaacccgtttaagtttttacgttaccgttagggaccgaccgtaacgtacgtaccgtaaccttaccggtaccttcgttaaaccgtttcgggtacccggggaccggtacggggtaaccccgg

SEQ ID NO: 154341 - DNA, 671 bp, Homo sapiens
  misc_feature: GYAE6OF01AWF2V.10.38.D05.1.454.CMB.1.raw
  modified_base (630)..(630): a, c, t, g, unknown or other
  misc_feature (630)..(630): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (648)..(648): a, c, t, g, unknown or other
  misc_feature (648)..(648): n is a, c, g, or t
  modified_base (651)..(652): a, c, t, g, unknown or other
  misc_feature (651)..(652): n is a, c, g, or t
  modified_base (654)..(655): a, c, t, g, unknown or other
  misc_feature (654)..(655): n is a, c, g, or t
  modified_base (658)..(661): a, c, t, g, unknown or other
  misc_feature (658)..(661): n is a, c, g, or t
  modified_base (663)..(666): a, c, t, g, unknown or other
  misc_feature (663)..(666): n is a, c, g, or t
  modified_base (668)..(671): a, c, t, g, unknown or other
  misc_feature (668)..(671): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggacgtccctgatcggttctctgcctcaagtctggcaacacggcctcctgaccgtctcgtgggctccgaggctaggaggatggacggtcttagaactttaacctacgtcggactacggccgactacgtttaacttaccggaaccgggtaccccccaaaaggtgggggttcgttttacgggggccggtaccgggggtaacttaaacgggttccggaacccggttccggttcggggtaacccaaccgggtaccccgtaaaggggtcccttcccgggacccccccgttacgggtccctaaccttcccggtttacccgttacccccctaaccccgttccctaacccgtaacccttaacgttacgtcggtccgtacgggacggtcccggggtcgtacgggaccgaaacgggtccgaacgtagtaccgncgcngntncgtagtcacncgnncnngcnnnncnnnnannnn

SEQ ID NO: 154342 - DNA, 765 bp, Homo sapiens
  misc_feature: GYAE6OF01D5XMP.10.38.D05.1.454.CMB.1.raw
  modified_base (230)..(230): a, c, t, g, unknown or other
  misc_feature (230)..(230): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactaggaaccngcagtgtacttttgtgacttaataactatgtcctcctggtaccagaccaccacccagacaaaccgccccctaaacttcctttgttttagaggtcaggtaacgccggccctcgaggtacgtcccgtgtacgttcggttctccgtcgtccctacgaagttcctacggaccaaccgaccggtccctacccgtcgtacccgttcgtcgtcgggtcctaccggacggtacgtaggacgggtacgtggtacggtcgttacgtaactttaccttacgtcgtccgaggtccgtacttaacgttacgttaccgaacccggtacccccgtaaagggttacgggggtttcggtttaccgggggaccgggtacggggtaaccgttaacggggttaccggttacccgggtaccgggttacggggtacccgtaaccgggtaccccggaacgggttccccgtccccgggtacccccccggtttcgggtttacccctttaacccgtttttacccccggttacccccccttaccccgttccccgtaaccccg

SEQ ID NO: 154343 - DNA, 620 bp, Homo sapiens
  misc_feature: GYAE6OF01B9HDH.10.38.D05.1.454.CMB.1.raw
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgcttatttcaaaaggtgtccactgtgaggttcaacgtggtggagacgtggaggaggctggactccgacggccggtcggggggtccctggacgactctcctgtgcagcctcgtgggttcagcatcaagtaacgactacatcgaccgtcgggcccgccgaggccgtccggaggggaacggggcgtagggaggttcgggtctcgtaagtttagttagaaacgtagagtacggactacgtataattatttacttctacgtacgtccgtaggacgggtcccgttaccacccttcaccgagacgacctactaccaactaactnttacttgtactctacactatcacctanacttcgagacgtacgtacgaacgtaccgacgacccttacttagtttacgtgtacgccggacactacgtcgtaacctcgtacctacgttaagttccgggcgggccggtaaccggg

SEQ ID NO: 154344 - DNA, 663 bp, Homo sapiens
  misc_feature: GYAE6OF01DNCFY.10.38.D05.1.454.CMB.1.raw
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
tcagcatagtagtgcacgaccggtgctcgatttagtatctgatagttgggtttgggggctctgctcctcctcaccctcctcactcagggcacagggtcctgggcccagtctgccctgactcacgcctccctccgcgtccgggtctccgtggacagtcagtcaccatctcctgcactggaaccagcagtgtactttgttgcttaataactatgtctctggtaccngcaccaccagcaaacgccctaaatcttgtttgagtcagtagcgcctnaggactccngacgttcggttctctcgcctctaagtcgtcggacaccgtaccggtcccttccgacgtacccgttcgtaccgttcggggacctcggacggtctaggacggtaactggaacggtcttaagtacgttactacgtgcgtacgctactaagttacgtaacgaccggtaaccgaacggtacgggtttacggtacgggtacggggtaacgggtaaccgggttaacggtacgggttacccgttacggtcggaccgaaccgtacccggacgtcggtacccgtacccgttcggtcctacctccgttaccgtccccgtcccttaccgtaccctactacgtaactcggtccgtaggacggtcggacgtcggacgaacggtccgatacgtacgngn

SEQ ID NO: 154345 - DNA, 561 bp, Homo sapiens
  misc_feature: GYAE6OF01BQ4D5.10.38.D05.1.454.CMB.1.raw
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (348)..(348): a, c, t, g, unknown or other
  misc_feature (348)..(348): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttataactatgtctcctggtaccngcaccaccagcaaacgccccaactcttgtttgagtcagtagcgcctnagactcctgatcggttctctgcctcagtctgcacncgcctcctgaccgtctcgtggcctccgaggctggagtactggaggtctagacttactacgtgcagcnctatcttcgacgccccaagtgggttgttcggcggnggtactaagggtcgtaccggtcgtgggtaccncggtaccccgaagggccctaccggccccccgttcgggtccctacccgtttccggtcccgttccccccggcccttccccg

SEQ ID NO: 154346 - DNA, 708 bp, Homo sapiens
  misc_feature: GYAE6OF01BTLBK.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagccctcccgtccgcgtccgggtctccgtggacagtcagtcaccatcctctgcactaggaaccagctagtcgtacttttgtgtcttaataactattcgtctccgtaggtaccagccaaccaccgaggaccaaacccgccccctaaacttcctttggttttgacgtcagtacgccgcctgagacgtcctgacgttcgttctcgtcgcctacgaacgtcgtagacaccgtccgtccctccgtcgtacccgttcgtcgtacggccctaccgtaggtcgtagggaggtacgtggacggtcttaaggtactttaaccgtacgtcgccgtaacggcctacttactaccgtaccggaacccggaccccgtaagggtttcggggtttagggttaccggggcgggtaaccgggttaacgtacgggttacccggcccgtttacgggtccgggtacacccggtaccccggagggttcccccgttcccggtaacccccggttccgtcccgttacccgttccgtttacccccgttcccctccccgttaccc

SEQ ID NO: 154347 - DNA, 854 bp, Homo sapiens
  misc_feature: GYAE6OF01DKN53.10.38.D05.1.454.CMB.1.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
tcagcatagtagtgcacgaccggtgctcgatttagtatctgatagttggggtttgggggggtctcaggaggcagcgctctcaggacgtcaccaccatggcctgggctctgcctcctcctcaccctcctcactcagggcacgagggtcctgggcccagtctgccctgactcagccctcccgtccgcgtccggtctcctggacagtcagtccacatcnctgcactggaaccngcngtntactttgtnctttanaatatgtctccgtgtaccagaccaccaccgacggaccaaaccgaccccctaacttccgtttagttttgacggttacaaggtaacgccggtccctagacggtcgtcccttagacttcggttctcgtcgcctacgtaagtccgtcgactaaccgccgtacccttcccgtggtacccgtcgttaccggtcgggtacccttacgaacgggtccgtaggaacggtacgtaggacggttacgtaacggttaaccgtttaacccgtacgttacggaccgtaccggtaacccggtaacgttaacgtttaaccgttaccgtaaacccgggttacccccccgtaaaagggtttcccgggggttaacggttttccgggggaacccgggtttaacccgggggttaacggttaaccggggttaacccggtttaccccggggttaccccggtttaccgggggtaacccgtaaaccccgggttaaccccgggttaaaccggggtcccccggtttacccccgggtaccccccccgtttagggtaccccccgtttaacccggtttccccggtttacccccgggttttaaccccccccgtcccccgttttaaaccccccgg

SEQ ID NO: 154348 - DNA, 803 bp, Homo sapiens
  misc_feature: GYAE6OF01A6PPO.10.38.D05.1.454.CMB.1.raw
  modified_base (727)..(727): a, c, t, g, unknown or other
  misc_feature (727)..(727): n is a, c, g, or t
tcagcatagtagtgcacgaccggtgctcgatttagtatctgatagttgggtttgcgggggagaggagcccagcactgggattccgaggtgtttccattcggtgatcagcactgaacacagaggactcaccagtggtagttttggctgtagtcgttgggtttttcctttgttgtcttatttacaaaaggtgtcctactgtgtaggttacaacgtggtggagtacgtggagggacggcgtggacgtccacggtccggtcgggggtccctggacgtacttccttccgtggtcgcgtacgtccgttcggtcggttcgacgcctacgtactaacggtaaccgaactacgtacgtaccgtacccggtccggggccccgaccgtacggtcccgtaccggggaacggggtacggggtccggtagggtacgggtttcgggtactacggttaagttacgttaacgaagtagtagtacggactaacgtaactattactttaacgttcgtacgtaccgtaccggttaggtaaccgggttcccgtttacccacccttccgtaccgaaggtaaccgtaccctaaccttaaccgaaactaacgttacgtttccttaggttaccttaccttagacttacgtaccaacgttaactacgtacgtaacggtaacgttaccggtacccgaaccgtacccgtaacgtaccccgtaaggtttaaccttgggttccgaacggtaccggtntaaaccgttcggtaaccgtacttaaccggtaccttacggttaaacccgggtccgggaacgggacccggtaaccggg

SEQ ID NO: 154349 - DNA, 780 bp, Homo sapiens
  misc_feature: GYAE6OF01BUGGN.10.38.D05.1.454.CMB.1.raw
  modified_base (246)..(246): a, c, t, g, unknown or other
  misc_feature (246)..(246): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcgagggcacgagggtcctgggcccagtctgccctgactcagcctccctcgcgtccggtctcctggacagtcagtccaccatcctcctgcacgtggaaccagcagtgtactttgtncttatactatgtctcgtggtaccagccgacccacccaggaccaaacgacccccctaaactttccgttttaggtttttcgaggtcctaaggttaacgccggtaccctcgacggtacgttccccgtaggtacgttcggttctccgtcgtccctacgtaacgtcgtcggaccaaccgaccggtcccttcccgtcgtacccgtctccggtcgggcctaccggaggtcctagggacggtacgtagggacgggtctaggttaactttaccgtacgttcggaccgtacggaccgtactagtttaccgttaccggaccggtaaccccccgtaaggggttacgggggttttcgggttttacgggggacccggggttacgggggtaaccgttaacgggtccgggttacccgggttccggttacgggggtacccaaccggggttaccccggaaacgggttcccgttaccccgggtccccccgtttacgggtaccccttacccggtttcccggtttcccccggttcccccgtcccgttacccccgg

SEQ ID NO: 154350 - DNA, 670 bp, Homo sapiens
  misc_feature: GYAE6OF01D888T.10.38.D05.1.454.CMB.1.raw
  modified_base (554)..(554): a, c, t, g, unknown or other
  misc_feature (554)..(554): n is a, c, g, or t
  modified_base (614)..(614): a, c, t, g, unknown or other
  misc_feature (614)..(614): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggtttttccttgttgcttatttcaaaaggtgtccactgtgaggttcaactggtggagacgtgggaggaggctggatccgaggccgtggggggtccctgacgactctcctgtgcacgcctcgtgggttcagcatcaagtaacgactaacatcgacccgtcgggccccgccgacggccgtacggagggggaacggggcgtgggacggttcgggtctacgtagtttaagtagaaacgagaagtcggactaacgtaactaatttatttacttcgtacgtacgttccgggtacggaacgggttcccgttaccgtaccctcgtaccgacgaccgtaactaccctttacccaaaactaacttactttacgttacgtacttcctacacgtatcgactaactactcaggganacgtaccgaaccggactacccgtaccctaacgtttattacgttgacggtccgacttaacnctacgtaaccctcgtaccttacgaacgtttcgggacggggaccgcgggtaccccgg

SEQ ID NO: 154351 - DNA, 575 bp, Homo sapiens
  misc_feature: GYAE6OF01A90HO.10.38.D05.1.454.CMB.1.raw
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (538)..(538): a, c, t, g, unknown or other
  misc_feature (538)..(538): n is a, c, g, or t
  modified_base (553)..(553): a, c, t, g, unknown or other
  misc_feature (553)..(553): n is a, c, g, or t
  modified_base (558)..(559): a, c, t, g, unknown or other
  misc_feature (558)..(559): n is a, c, g, or t
  modified_base (568)..(570): a, c, t, g, unknown or other
  misc_feature (568)..(570): n is a, c, g, or t
  modified_base (572)..(572): a, c, t, g, unknown or other
  misc_feature (572)..(572): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaaacgccccccaaactccttgtttttgaggtcagtaagcggccctcaggagtccctgattcggttctctgcctcaagtctggcaacncggcctccctgaccgtctctcgggctccgaggctgaggntgaggctgattactactgcagcgcatattcgacggacccccaagacggggttgtttgggcgggtcggggaactaacgggtcgaacccggttcgtcggggtaccacggcccaagggtccctcgccccccgtggtccaccgttccgttcgttccccgcccttccctcctactacgtatcggacgttggacggtccgggcgtcgggaccgaacgggtccgacgtaacgtacggatcgcngancncnncgcncgtcgcgcgcgcgcngcgcnncgcacgacnnngngtg

SEQ ID NO: 154352 - DNA, 758 bp, Homo sapiens
  misc_feature: GYAE6OF01CN2NH.10.38.D05.1.454.CMB.1.raw
tcagcatagtagtgcacgaccggtgctcgatttagtatctgataggtttgggggtttggggggggtctcagtaggcagcgctctcaggacgtcaccaccatggcctgggctctgctcctcctcaccctcctcactcagggcacagggtcctgggcccagtctgccctgactcacgccctcccgtccgccggtcccggtctccgtggacacgtccatccaccatcctctgcacgtcggacccactaagttacagtttaggaaataatagtaattattcgtcctaccgtacggtaaccaaacgacgtaacccgaaggaaccaaaaccgacccccaaagtgaactagtattttatgactagtacaagtaactccgaccgtcggtagggtttctgtactcgttctttcgtttcgacctacacgttcacggaccaacgccgtcctacctcgaacctactcgtcgtacggtctaccgagacgtaggacggacgtacggtctagtaactttaagttacgacgtacaacgtctaacgaactaacgtacgaacggccggtaaacggtcggggttaccggggttagggggttaccgggttaccggggggaacccgggggtaaccctaacccggtaccggttaacccgggtacccgggttacccggttaacgggtaacccggtaacccggtaaccccggaaccgggttccctacccccgggttacccccggttaccggtaccgttaccccgttcccgtttacccccggg

SEQ ID NO: 154353 - DNA, 614 bp, Homo sapiens
  misc_feature: GYAE6OF01DLESU.10.38.D05.1.454.CMB.1.raw
tcagcatagtagtgcacgaccggtgctcgatttagtatctgatagttgggggtttgggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcacgtaggaaccagcagtcgtacttttgttgactttaataacttattcgtcttccgtggtaccacgccaaccaccaggacaaacgccccctaaattcctttgttttagaggtcagtaacgccggcctacgaggtactccctgtacttcggttctctcgcctacgaagtctacggacaacgccgtcctccgtcgtaccgtctcgtgggtcctcgacggtcctaggacggtactggacgtctagtactttacgactgacaggcgactaatacgtcgaacgtaccccgaaggtcggggtttgttcgggacggcgggtactagggtccgtaccggtcgtgggtacacggcccaggtcctccggccccgtcgtctacctccgttccgtccccgtccttcccg

SEQ ID NO: 154354 - DNA, 987 bp, Homo sapiens
  misc_feature: GYAE6OF01C692Z.10.38.D05.1.454.CMB.1.raw
tcagcatagtagtgcacgaccggtgctcgatttagtatctgatagttgggtttggggggggtctcaggaggcagcgctctcaggacgtcaccaccatggcctggctctgcctcctcctcaccctcctcactcgaggcacgaggtcctggcccagtctcgccctgactcacgccctccctccgcggtccggtctccgtggacagtcacgtccaccattcctccgtgccacgtacggaaccagctagtcgtacgttttgtacgtacttaataacgttattcgttcctccgtaggtaccacgtaccaacccaacccgtacggaaccaaaccccgacccccctttaaaacgtttccccgttttttaggtttttacgggaacggttaccgaaacgggttaaccgggcccggtaccccttacgggtacgggttacccgttaccccgttaggttaaccggtttcccgggtttccgtaccgttccgtacccccttaccggtaaacggttccgtacgggtaaccctaaaaccggtcccggtccccgttccccgtacggttaccccggttcgttaccgggtcccgggtccctaccgggtacgggttaccgttaagggtaacgggtacggttacgggtacgggttaccgttaaacggttaacccgttttaaccgttaccggtccggaaccgtaaccgggtaccgtaacgtttaaccgtttacccgttacccgggtaaacccccggtaaccccggttaaagggggtttacgggggtttttccggggttaccggggggtaacccggggttaaccggggttaacgggttaaaccggggttccccgttaaaccccggggttcccgggtttacggggaaccccgtacccgggtaacccggttacggttcccccggtacccccgggttacccccggttccggttaacccgttacccgtttaccccgtttacccccgttaaccccccgtccccgtttaacccccg

SEQ ID NO: 154355 - DNA, 717 bp, Homo sapiens
  misc_feature: GYAE6OF01C4GG7.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctgctcctcaccctcctcactcaggacacgacgggtcctgggccctgtctcgccctgactcagcctcgcctccgtgtcgtcgggtctccgtggactaggtccgtcacctatctctcgccacgtcggaccagcacgtgacgtggttgggactatttaactaacttcgtcctccgtagtactacgaacaaccgaccacgaaccaaaccgacccccactaccgttacttagtatttactagaacgtacgtaacgtaacggccgtccgttacggttacgggtttacgttacgttcgtaccttctcgtaccgtcctaccgtaacgtcgttaacggaccaaccgtaccggtcccctacccgtacgtaactaacttccgtacgttaccgggtcctaccggacgtccgaacggaaccgacggtacggacttaaggtaaacttacttacgtacgacgtacgtacgtataacgttagtagtagtcgttccggttacgttccgtttcgtttaacggtttacgggttaccggaacgggaccggtacgtacgtccggttaacgtacccgttacgtaacgtaccgaacgtacccgtacgtcccgttcccggtacccccgg

SEQ ID NO: 154356 - DNA, 1002 bp, Homo sapiens
  misc_feature: GYAE6OF01CYZBG.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggtagttttggctgagtcgttgggttttccttgttgtcttatttacgaaaaggtcgtccactgtcgaggttctaacgtgggtggaagacgtggagggaggcgtggactccgacggtcccggttcggggggtccctaggacgtaccgttccttccgtggtcgccgacggtcccgttcggttacggggtttacaacggtcctaacgttaaccgaaacggttaaccgaaaccttaacgttaaccgttcgggaaccccgttccgggggccccccgtaccgtacggggacccgtacccgggaaggggggaacggggtccgtgggggtacgggttccgggttacgttcgtaaacggtttacgtaaacggtaaaaccgtaaggtaacgtacgggtaaccctaaccgttaaacctttaaagtttacgtttaaccgtttaccgttaccggttaaccggtttccccgggtaaagggttaacccggggtacccccggttttaccccaaccccgttacccgttacccgaaacggttaaccggaccctttaaaccccttaacccaaaaccttaaaccgtacgttttaccttttaacgtttaccctttaccttacccgtaacctttaacgtaccgtaaccttaaacctaccgtttaccggtaaccggtaaacggtacccggtaacccgggtaaacccgtaaccccggtaaccgggttaaccccttaacgggttttaaaacttttacgggtttccgtaaccgggttccggaacccgttaacgaaaccgggtttactaaaacccccggtttccgggttaacctttaaacccggttaaccggggtttcccgggtaaacccggggtacccccgggtaaaacccgggggg

SEQ ID NO: 154357 - DNA, 600 bp, Homo sapiens
  misc_feature: GYAE6OF01BEAIC.10.38.D05.1.454.CMB.1.raw
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggaaccagcagtgacttttgtgcttataactatgtctcctggtacagcaccaccagcaaacgcccccaaatccttgttttgagtcagtagcgcctnagctcctgntcggtctcncncctcaagtctggcaacacgcctccncgacgtctcgtggctccgagctggacgatggagtctgtacttactacgtgcgagctacgtataacgttccaacggaccccgaagtacggggttcgtttcgggacgggggtacggtaacgttaagggtccgtaccggttccggtagggtaccaccgggtacccaagggtccctacccggtccccccgtacggtccctaccgttacccgttccggttcccccctacccggttaccccc

SEQ ID NO: 154358 - DNA, 790 bp, Homo sapiens
  misc_feature: GYAE6OF01A1DK7.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatgggtagttttggctgagtcttgggtttttccttgttgcttatttacaaaaggtgtccactgtgtaggttcaacgtgggtggagacgtgggaggaggctggactccgaggccggtcggggggtccctggacgacctcctcctggtcgcacgtcctcgttgggtacagcatacaagtaacgactacacgtcgaccgtcgggcccgcgacggccgtaccggaggggacgggcgtgggaggttcgggtctacgtagtttaagtagaaacgtagtacgtcggactaacgtaactattaatttattacgtacgtaccgttaccgggtaggtaaccgggtcccggttaccaaccccgttcacccgaacggtaccaacccttaccttaaaccccaaactaaccttagtttacctttacgttaacttacccgttacaacctacgttacgtacctaaactaaacgttccgtaacgggtacggtaacggttacccggaaaccggtaacccggtaccccggtaaccccttaaaccgtttaagtttacggttcggtaaccgggtccgtaaaccggtaacttaacggttaccgtaaacccgttacccgtaacgtttaccgtaaaaccggttttccggggaaccggggggttaacccaacggggggtaaccccg

SEQ ID NO: 154359 - DNA, 806 bp, Homo sapiens
  misc_feature: GYAE6OF01EREI3.10.38.D05.1.454.CMB.1.raw
tcagcatagtagtgcacgaccggtgctcgatttagtatctgatagttggggtttgggggggagaggagcccagcactgggattccgaggtgtttccattcggtgatcagcactgaacacagaggactcaccagtggtagttttggctgagtcgttgggttttccttgttgtcttatttacgaaaaggtgtccactgtgtaggttcaacgtggtggagacgtgggaggaggcgtggactccgacggtccggtcggggggtccctggacgtaccttcgtccgtggtcgcgacgtccgttcggtcggttcacgtcatacgaacgtaacactacacgtcgacccggtccgggccccgacgacggtccgtaccgggaggggacgggcgtgggtacggttcggtctagtagttacgtaagaacgtagtacgtacgactaactactattactttactcgtacgtaccgtacggtacggtacgggttcccgttaccctaccctacgaccgtaacgaaccgtaacctacccttaaaccaaaccgtacttacgttaccgttagttaccttcgtaaccactacgtaccgtaacctaacgttacgtacgtaacggaacggttaccggacccggaaacccggtaccgtaaccccggttaaccttaaccggtttaagtttccggtttacggacccggttaccgggtaaaccctaaggttaccggtaaccgttaaccccggttacgtaaacccgttttacgggttaaccgggtttcccgggggaaccgggggtaccccgggtaaacggggtaaccccccgg

SEQ ID NO: 154360 - DNA, 673 bp, Homo sapiens
  misc_feature: GYAE6OF01CT9D2.10.38.D05.1.454.CMB.1.raw
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgccactggaaaccagcagtgacttttgtgcttataactatgtctctgtaccagcaccaccagacaaacgccccaaactccttgtttgagtcagtaancgcctnagngtccngatcgtntcngctcaatcngacaacacggcctcccgtgaccgtctacgtcgggtcctaccgacggctacggaggtaatggaagggcttaaggtaactttaacgtaacgtgacccgagtccgactaattaacgttcgaaaccgggtccccaaaaacggtagggggttccgtttggggacccgggtaccgggaacttaaacggggtacgtaaccccggttcgttacggggttaccgaaccggggaccccgtaaacggggtccgtaccccggtacccccccgttacgggtacccgtaaacccgttccgtttacccggttaacccccccttacccccgttaacccccg

SEQ ID NO: 154361 - DNA, 166 bp, Homo sapiens
  misc_feature: GYAE6OF01A3ARZ.10.38.D05.1.454.CMB.1.raw
tcagcatagtagtgcacgaccggtgctcgatttagtatctgatagttgggtttgggggtgtggtggtctccactcccgccttgacggggctgctatctgccccctcggtcactctgttccccgccctcctccactactatgctgagcgggctggcaaggcgcatag

SEQ ID NO: 154362 - DNA, 1057 bp, Homo sapiens
  misc_feature: GYAE6OF01CCX3B.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgcttattttacaaaaggtgtccactgtgtaggttcaacgtggtggagactgggaggaggctggatccgaggccggttcggggggtccctgacgaccttccgtccgtgtcgcacggtccttcgttcggggttcacggtactaacgtaccgtaaacggtaaaccgtaacgtaacctacgtaccggtaccccggtccggggacccccgtaccggaccgggtccgtaaccgggaacggggggtaacgggggtccggtaggggtacgggttcgggttaccgttacggttaacggttttaagttaacggtaaaaccgtaaggtaacgttacgggaacctaaacgttaaacctaatttaacgttttaactttcgtaaccggtaacccgtttacccggggttaacgggtaaacccgggggttcccggtttaccccgtaaccccgttacccgttaacccgaacgggtaacccgtaacccttaaaccccgtttaacccaaaaacccgtaaaccgtttaacgtttacccgttttacggttaaaccctttccccgttttaaacgaaaccccgttaacggttaacccgtaaccccgtaaacgttaaaccgtttccggttaaacggggtaaccgggttaaaccgggtttaacccggggaaaacccggtaaccccgggtaacccccggttaaccccgtttaaacccggtttaaagttttttacccgggtttaacggggtacccggttaacccggtaaaccccgggttaaaccttaacccgggtttaaacccgttaaaccccggtttaaaccccgggttaaaccccgtttaaccggtttaaaacccggggttttcccccgggtaaccggggggggtaaccccggttaaaccgggggggtaaaacccccccg

SEQ ID NO: 154363 - DNA, 693 bp, Homo sapiens
  misc_feature: GYAE6OF01DBYEY.10.38.D05.1.454.CMB.1.raw
  modified_base (433)..(433): a, c, t, g, unknown or other
  misc_feature (433)..(433): n is a, c, g, or t
  modified_base (587)..(587): a, c, t, g, unknown or other
  misc_feature (587)..(587): n is a, c, g, or t
  modified_base (595)..(595): a, c, t, g, unknown or other
  misc_feature (595)..(595): n is a, c, g, or t
  modified_base (652)..(652): a, c, t, g, unknown or other
  misc_feature (652)..(652): n is a, c, g, or t
  modified_base (683)..(683): a, c, t, g, unknown or other
  misc_feature (683)..(683): n is a, c, g, or t
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagcgttgggtttttccttgttgcttaatttacgaaaaggtgtccacttggtgtaggttcaacgtgggtggagacgtgggagggaggcgtggactccgacgtccggtcgggggggtcctggacgtaccgttcctccgtggttcgcgacggtcccttcggttcgggttcacgctactcgtaacgtaaccgtactacacgtcggtacccgtccggggaccccgtccgacgggtaccgtcggaaggggacggggtcgtgggaggtcggtctacgtagttaagtagaaacgngagtacggactaactactattattacgttcgtgaccgttacggacggtaaccggtccggtacctacccgtccgtaccgaagactaacctaaccctaacccaaacgtaccttcgttacttagtaactccttaacactactacgactaactacgtnaggacggntaccgacgacctacgtacctattacgtctcgtagacctagtactagtcgtaaccgtnactaacgttacgtaccgggtcgggaacccgngggtaacccg

SEQ ID NO: 154364 - DNA, 334 bp, Homo sapiens
  misc_feature: GYAE6OF01A2A7G.10.38.D05.1.454.CMB.1.raw
  modified_base (319)..(319): a, c, t, g, unknown or other
  misc_feature (319)..(319): n is a, c, g, or t
  modified_base (324)..(334): a, c, t, g, unknown or other
  misc_feature (324)..(334): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacgagggtgtttggcggcgggactaaggtcgaccgtccgtgggtcacgcccaggcctcgccccctggtccactctcgttcccacctcctccactactatgctgacgcggctggcaggcncatgnnnnnnnnnnn

SEQ ID NO: 154365 - DNA, 650 bp, Homo sapiens
  misc_feature: GYAE6OF01BRY61.10.38.D05.1.454.CMB.1.raw
  modified_base (208)..(208): a, c, t, g, unknown or other
  misc_feature (208)..(208): n is a, c, g, or t
  modified_base (315)..(315): a, c, t, g, unknown or other
  misc_feature (315)..(315): n is a, c, g, or t
  modified_base (619)..(620): a, c, t, g, unknown or other
  misc_feature (619)..(620): n is a, c, g, or t
  modified_base (622)..(622): a, c, t, g, unknown or other
  misc_feature (622)..(622): n is a, c, g, or t
  modified_base (629)..(650): a, c, t, g, unknown or other
  misc_feature (629)..(650): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaactcctttgttttgaggtcagtaagcggccctnaggacgtccctgacttcggttctctcgcctccaagtctggcaacgaccggcctcccgtcgaccgtctcgtgggcctaccgaggctgaggatgaggctgattacctancgcagccgacagttactccgaccggacccctaaggtacggggtttcggttacgggccggggaacgggtaacgttaaacggggtccgaacccgggtttccggtacggggtaccaacgggaccccggtaaagggtccctacccgggtccccccgttcggtccctaaccgttcccgtttacccgggtttccccccgccccctttcccgtacccctaacgtttaacccgtagttccggtcccgtagggaacccgggtcgggggtcgttccggggacgtaaccgggtcccggataacggtacgacgtcnngngcgcgannnnnnnnnnnnnnnnnnnnnn

SEQ ID NO: 154366 - DNA, 630 bp, Homo sapiens
  misc_feature: GYAE6OF01BOP8L.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactggaggaggctggatccgagccgtggggggtccctgacgacctctcctgtgcagtcctcgtcgggttcagcatcgaagtaacgactacagtcgaccgtcgggccccgccgacggccgtaccgagggggaagggcgtgggaggtcggtctacgtagttattacgaaacagagtcggactactacattattacttctacgtacgtcgtaggaacgggtcccgttaccaccccgttctacccgaaggtaccgtaaccctacctttaacccaaaacgtaccttattccgtttagtacttccttacactatcgacaactatcgtagacgtacgtaccaacgaccgtcgacctacgttattacgttggacgtacgctaactaggtcaaccttcgacttacgtaacgttgggaccggggcaacggggtaccc

SEQ ID NO: 154367 - DNA, 793 bp, Homo sapiens
  misc_feature: GYAE6OF01C47OC.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcgttgggttttccttgttgtcttatttacaaaggtgtccactgtgtaggttcaacgtggtggagacgtgggagggaggcgtggactccgacggtcccggttcggggggtccctggacgtaccttccgtccgtggtcgcgacgtccgttcgttcgggttcagctaagtaccgtaagtaaccgtaacctaacgtacgtacggaccccggtccggggacccccgaccgacgggtcccgtaccggggaacgggggtaacgggggtccggtaggggtacgggtttacggggttccttacggttaaggtttaacgttaacggaaaacgtaaggtacgtacggtacctaaaccgttaactaagttttaaactttacgttaccgttacggtacccgtttacccggggtaacgggtaacccggggttccccggttacccgtaaccccgttaccgtacccggaacgtaaccgtaacccctaaacccgttaaaccccaaaacctaacgttactttacgtttacgttacttcccttacaactacgttaccgactaaacgtatcgtaaggtacgacgtaccgaccgtaccgaccgtactacgttagttcgtcgcgacgacatagtcactcacctagtagtcggacgggacgtcggaccg

SEQ ID NO: 154368 - DNA, 772 bp, Homo sapiens
  misc_feature: GYAE6OF01B5NU7.10.38.D05.1.454.CMB.1.raw
tcagcatagtagtgcacgaccggtgctcgatttagtatctgatagttggggtttgggggggggtctcaggaggcagcgctctcaggacgtcaccaccatggcctgggctctgctcctcctccaccctcctcactcgagggcacgagggtcctgggcccagtcctcgccctgactcacgccctcccgtccgcgtccgggtctccgtggacagtcacgtccaccattcctcctgaccacgtacggaaccagacgtagtgtacttttggtagtactttaactaacttactcgttccttccgtacggtaaccacgacccaacccgacccgaacggacccaaacccgtacccccctaaacttttccgttttggttttacggaacggttcgaacggttaaccggcccggtacccgtacgacgggtaccgttccctaggtaccgttcggttctccgtccgtccctacgaagttccgtaggacccaaccggtccgtccctcccgtccggaccttccgtccggtcgggtccctacggcgtacgtagggaaggagttcggacgtcgtacgttacttacgtcggtgacgtacgtccgtactacgttcgtacggaaccggtacccgaagggttgggtttcgggacgggtacggaccggggttaacgtaccgggtaccggtacccggttcggtacggtccgaccggtacccggacggtccccgttccccggtaccccgttcgtaccgtcccttacccggttcccgtacccccgtccccgttaccc

SEQ ID NO: 154369 - DNA, 693 bp, Homo sapiens
  misc_feature: GYAE6OF01B88IX.10.38.D05.1.454.CMB.1.raw
  modified_base (121)..(121): a, c, t, g, unknown or other
  misc_feature (121)..(121): n is a, c, g, or t
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (633)..(633): a, c, t, g, unknown or other
  misc_feature (633)..(633): n is a, c, g, or t
  modified_base (681)..(681): a, c, t, g, unknown or other
  misc_feature (681)..(681): n is a, c, g, or t
  modified_base (691)..(691): a, c, t, g, unknown or other
  misc_feature (691)..(691): n is a, c, g, or t
tcagcatagtagtgcacgaccggtgctcgatttagtatctgatagttgggtttgggtccctgagactctcctgtgcagcctctgggttcagcatcagtaacgactacatgacctgggcccnccaggctccgaggggaagggctagggagtgggtctcgagtttatagaaactgatggacactacatagttattcngacctccggtggaacgggccgttaccacccttcnccaggacacctacctacaaacaacctgttccttagtctaccttacaacgntcgacactaatcgtagagacgtacgacgacgacgtacctacgttattacgttgacgcgcaactntacgaactcgntactaagttccgggcgggaccagggccgacctacgggtaccctacccgtcccgtaccccgacgtcccctaaccgacggaacccgggcccctaaggttccccggttaccccttccccggcggtaccctcccgtacggccctaaccggacggaaccctccccgtacccggtaccggacgaccgcccgaacggacccgggtcccgtaccccggtcgggtcctccgggtaacccgtacgggtaaccgacccggtaaccctttaccgtaccctaagttacccgntcgcggtacggaccggtcgggactccgggaatacggccagtaagtcgnactagctcgnac

SEQ ID NO: 154370 - DNA, 747 bp, Homo sapiens
  misc_feature: GYAE6OF01D0ARM.10.38.D05.1.454.CMB.1.raw
  modified_base (278)..(278): a, c, t, g, unknown or other
  misc_feature (278)..(278): n is a, c, g, or t
  modified_base (469)..(469): a, c, t, g, unknown or other
  misc_feature (469)..(469): n is a, c, g, or t
tcagcatagtagtgcacgaccggtgctcgatttagtatctgataggttgggtttggggggagaggagcccagcactgggattccgaggttgtttccattcggtgatcagcactgaacacagaggactcaccagtggtagttttggctgagtcgttggttttccttgttgtcttattacaaaggtcgtccactgtgaggttcaacgtgggtggagacgtgggaggaggctggactccgaggtccggtcgggggtccctgacgtacctcctcgtgtcgcncgtccgttggtggttacagtctagtaccgaagtaaccgactacgacgtcggtacccggtcgggaccccgcgtacgggtcccgtaccggggaagggggtaacgggtcgtagggtacggttcgggtactacgttaagtttagtaacggaaacgtaggtacgtcggaacctacgtaacttagtttaaacgtttnttaccgtacgtaccggttacccgggttaagggtaacccgggtttcccgttaccctaccccgttacgtacccggtaaacgaacgtaacccttacccgttaaacccgaaacttaaccgtactttaccgtttacgtaccttaccttacacttactacgtaaccaacgtactgtagaacggtacgacgtaccgacgtaccgtacctaacttgttacgtcgtacgcgactatacgtcgtaaacctgtaacctacgtaacggttcgggaccggtcgacggtccg

SEQ ID NO: 154371 - DNA, 878 bp, Homo sapiens
  misc_feature: GYAE6OF01DT8DE.10.38.D05.1.454.CMB.1.raw
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcgacgggcacgaggggtcctggggcccaggttcctcgccctgacctcacgtccctccctccggccggttcccgggtctccgtaggactacgtcacgtccacctacttcctcctgacctaccgtacggaacccaggccaggttcgttacttttcggtgtactttaactaacttnttccgtacctccgtaggtaccntacccaccaccgngaaccaaccgaccccttaactttcgtttaggtttcggagtacgaggtacggccgtccctagacggtacgtcccgtagtacgttccgtactccgtcgaccctacgtacggtcacggtaccaaccgtcccggtacctcccgtacggtacctttcgtccggtacgggtacccgtaccgtacgggtacgtacggggtaacggtcgtaacgggtacggttaccgtaacgttaaacctttaccgtaccgttacgacgtacccgggtacttaacgttaccttaacccgttacccggggaaccgttaaacccccgggaagggttttccgggggggttttaacggtacccggggtacgggggttaaacccgggttacggttaaaccgggggttcccggttaaccccgggttcggggttaaccgggttaacccgacccgggttaaccccggttacggtcccggtcccccggttaccccggtacgggttaacccttccccgggtttccccgtttacccccgggtccccccgttaccccgttaaaccccgg

SEQ ID NO: 154372 - DNA, 769 bp, Homo sapiens
  misc_feature: GYAE6OF01AUPC5.10.38.D05.1.454.CMB.1.raw
  modified_base (259)..(259): a, c, t, g, unknown or other
  misc_feature (259)..(259): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctccaccctcctcactcagggcacagggtcctgggcccagtctgccctgactcagcctccctccgcgtccgggtctcctggacagtcagtcaccatctcctgcacgtggaaccagcagtgtacttttgttgcttaatactntgtctctgtaccagccaccaccgagaccaaaccgaccccctaacttctttgttttagacgtacagtacgccgtccctagaggtacgtcccgtagtacgttcggttctcgttcgtccgtacctaagtcgtacggaccaacgaccggtcccttacccgtacgtacccgttccgtcggtccgggtcctaccggacgggtaccgtacggggtaggtacgttacggggaacgtcgttaacggttaactttaacccgttacgtcggaccgtaggtccgtactaacgttaccgttaccgacccggtaacccccgtaacgggttaggggtttcggtttacggggccggggtaaccgggttaaccgttaacggggttcccgtacccgggtttccgggtacggggtaccgaacccgggtaccccggaacgggttccccgttaccccggtccccccggttacgggttccccttaacccgtttacccgtttccccgttaccccccgttacccccgttacccc

SEQ ID NO: 154373 - DNA, 679 bp, Homo sapiens
  misc_feature: GYAE6OF01DZB06.10.38.D05.1.454.CMB.1.raw
  modified_base (628)..(628): a, c, t, g, unknown or other
  misc_feature (628)..(628): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctattacaaaaggtgtccactgtgaggttcaacgtggtggagacgtgggaggaggcgtggactccgacggccggttcggggggtccctggagacctctcctggtcgcacgcctcgttgggttcagcatacaagtaacactacatcgaccgtcgggccccgccgacggccgtaccggaagggggaacgggcgtgggtacggttcgggttactcgtagttaagttaacggaaacgagtagtcggacctaacgtaactaatttaatttactcgttacgacgttccggtacggtaaccgggtcccgttacccacccgttcctaccgagaaccgtacctaccttaacccgaaactaacgtactttaccgttgttaacttaccgtaccactagtacgactaactatcgtaacggagtacgtaccgaacgaccgaccggtacctaacgttattcgtacggcgacgacgtanacggtacaccgtacgacctactaacggttccgggacgggccgagggacccg

SEQ ID NO: 154374 - DNA, 779 bp, Homo sapiens
  misc_feature: GYAE6OF01EHOXD.10.38.D05.1.454.CMB.1.raw
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacagggtcctgggcccagtctcgccctgactcacgccctccctccgcgtccgggtctcctggacagtcagtcaccatctcctgcacgtggaaccagcagtgtacttttgttgtacttaataacttattcgttccttccgttacggtaaccacgacccaacccaacccgacgggaaccaaaaccgacccccccttaaaacgtttccgtttttggttttttaggaacggtttccgaacggttaaaccggcccggtaccccttacggagggtaccgttcccgttagtacgtttccggtttcctcgttccgtacccttacgtaacgttcgtacggaccaaaccggtcccggtcccttaccccgtacggtaccccggtttccgttacggttccggggttaccctacccggtaagggtccggtaggaacgggtaagtcggtaggacgttagtaactttaccgtacgttcgacgtacgcgtaacttagtaccgttacgaaccggaccctaaacggtggggttacggttacgggaccgggtacgggtaccgtagggtccgtaccggtcgtagggtccacggacccgacggtccgtaccccgtcccgttcgggttacccacttcccgtacccttccccgccttaccccg

SEQ ID NO: 154375 - DNA, 908 bp, Homo sapiens
  misc_feature: GYAE6OF01AOC8Z.10.38.D05.1.454.CMB.1.raw
  modified_base (140)..(140): a, c, t, g, unknown or other
  misc_feature (140)..(140): n is a, c, g, or t
  modified_base (204)..(204): a, c, t, g, unknown or other
  misc_feature (204)..(204): n is a, c, g, or t
  modified_base (287)..(287): a, c, t, g, unknown or other
  misc_feature (287)..(287): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacgngggtcctcgggcccagtctcgccctgactcacgccctccctccggcgtccggtctccgtggacngtcacgtccacctacttccgtcctgacctacgtacggaacccagcctagttcgttacttttcggttctaacttaataacgttntcgtccttacgtacggtaccacgacccacccgaaccgtacgaacccaaaccggtaccccccttaaacgtttccgttttacggttttacggacggttaacgtaacggtaccggccgtacccgttacggaacggtcccgttccgtagtaccggtttccggttctccgtaccggtacctaccggttaacgtccggtaccggaccgtaaccggtccccgtccccgtttaccgtaccggtaccgtccgttaacgggtcccggttaccgttaccggacggttaccgggtaagggtccgggtaccgtagggtacggttcttaaccggtttaacgtttccggtacgtaccgacgttaccggtaccgtaactttacgtacccgttaacccgggtacccgtaaaccgggtttcgggggttaacggggttttcgggtacccgggggttacggggttaacccggggttaacggtaaccggggtttccggaccccgggtttaaaccgggggtcctaacccgggtacccgggaaccgggttaacccggtccccgggttccccccgttaaaccgggttctaccccggtttacccgtaccccgtttccccgttaaccccccgttcttaaccccccgg

SEQ ID NO: 154376 - DNA, 670 bp, Homo sapiens
  misc_feature: GYAE6OF01AC4IX.10.38.D05.1.454.CMB.1.raw
  modified_base (192)..(192): a, c, t, g, unknown or other
  misc_feature (192)..(192): n is a, c, g, or t
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (632)..(632): a, c, t, g, unknown or other
  misc_feature (632)..(632): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (642)..(643): a, c, t, g, unknown or other
  misc_feature (642)..(643): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (666)..(666): a, c, t, g, unknown or other
  misc_feature (666)..(666): n is a, c, g, or t
tcagcatagtagtgcacgaccggtgctcgatttagtatctgatagttgggggtttggggcctttgcctgggtctcctggacagtcagtcaccatctcctgcactggaaccagcagtgtactttgtgcttataactatgtctctggtaccagccaccaccgaggacaaacgccccctaacttctttgttttgnggtcagtaacgcgcctgaggactcctgacgttccgtctcgtcgcctacgatcgtcggaccaaaccgtcccggtccttcccgtacggtacccgttcgttccggtcggggtccttaccggcgggttaccggtaggaaggcggtaaggcggtacttacggttaactttactcggtcgacgtaccgctactacgtttacgacccggaaccggaacccggtaacggttgggggttcggttacggggaccgggaaccgggttacggtaacggtccgtaccggttcggtacggaccgaccgccggtacgtaccgtacccggtacccgttcgtcccgttaaccttcccgtacccgtacccctacctcccgtacctacttactcgtacgtcgcggtacggcggacgtcggtacgacgcgtactagcgactnacgtngtanactgacctnaccgancngnngctncncacgtcgcgcncanctngtcg

SEQ ID NO: 154377 - DNA, 663 bp, Homo sapiens
  misc_feature: GYAE6OF01ECQOE.10.38.D05.1.454.CMB.1.raw
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (436)..(436): a, c, t, g, unknown or other
  misc_feature (436)..(436): n is a, c, g, or t
tcagcatagtagtgcacgaccggtgctcgatttagtatctgatagttgggtttgggggctctgctcctcctcaccctcctcactcagggcacgagggtcctgggcccagtctgccctgactcacgccctccctccggccggttccgggtctccgtggacagtcagtcaccatcctctgcacgtaggaaccngctagtgtactttgtntcttaataactntcgtctcgtcgtaccacgccaccaccgagaccaaccgtacccctaagttctttggttacgacggtactacggtacgccgtacccgtgacggtctccngtacgttccgttctcgtcncctacgtagtctcggacctaccgtccgtccctccgtacgtccgtctcggtcggcctcggaggtctaggaaggtctggcgtctacgtacttcgtacgcgacncggtccacttagtccgtaccgaacccgtaccgtgggttacgggttcgggttacgggaccgggtagtaacggtacgtcggtacccgtcggtacggtcaaccggtcgaccggtccgtccggtccctcggtacccttcttcccgtccccgttacccacccgttccgacttaccgtacgtcgttccgtcggtaggcgggtcggacgtacgaccggtagacgactggtgcta

SEQ ID NO: 154378 - DNA, 814 bp, Homo sapiens
  misc_feature: GYAE6OF01BYBOT.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacagggtcctgggcccagtctgccctgactcacgccctccctccgcgtccgggtctcctggacagtcagtcaccatctcctgcactcggaaccagccagttgtacttttgtcgacttaataactatcgtcctcctggtaccagccaccacccaggacaaaccgcccccaaacttccgttgttttgaggtcgtagtaacgccgacctcgagacggggtccctgtagttcggttctcgtcgtcctaccgaacgtcgtcgtacaaccgtaccgccctacccgtcggtacccgtcttaccggtcgggtcccgtaccgacgggtcgtacgggtaacggtagttacgggacggtcgttacgtaacgtttacctaccgtagtaccgtaggtacccgtacgtaacgtttaccgtcgaacccgggtaccccccgtaaagggttacggggtttcggggttttaccgggggaacccggggttaaccgggggtaacccggtttaaggggttacccgggttaaccccggggttaccggtttacccgggggtaaccgtaacccggggaccccgggttaaacgggttccccggttacccccggtaaccccccgggttcgggtttaccccgtaaccccggtttaccccggtttacccccgggtttccccccgtccccccgttttaaccccccgg

SEQ ID NO: 154379 - DNA, 578 bp, Homo sapiens
  misc_feature: GYAE6OF01EE1PQ.10.38.D05.1.454.CMB.1.raw
  modified_base (329)..(329): a, c, t, g, unknown or other
  misc_feature (329)..(329): n is a, c, g, or t
  modified_base (538)..(538): a, c, t, g, unknown or other
  misc_feature (538)..(538): n is a, c, g, or t
  modified_base (570)..(570): a, c, t, g, unknown or other
  misc_feature (570)..(570): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctattcaaaaggtgtccactgtgaggttcaacgtggtggagactgggaggaggctggatccagccgtggggggtccctgagactctcctgtgcagcctctgggttcagcatcagtaacgactacatcgaccgtcgggcccgccgaggcctccggaggggaacgggntgggagtgggtctcgtagtttagtgaaacgagtagtcggactactactattattaacttctacgtacgtccggtaggaaccgggtcccgttaccacccgttcctaccgacgacgacctaccttaccaaactaactatcttagtacttcttcacatcgactacatcgtagagacgtcgacgacaccgacctactattagtcgtgcgcganactcgacgtactctacgtactcggcgggacgngggtaccg

SEQ ID NO: 154380 - DNA, 683 bp, Homo sapiens
  misc_feature: GYAE6OF01EVJBT.10.38.D05.1.454.CMB.1.raw
  modified_base (251)..(251): a, c, t, g, unknown or other
  misc_feature (251)..(251): n is a, c, g, or t
  modified_base (316)..(316): a, c, t, g, unknown or other
  misc_feature (316)..(316): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (678)..(679): a, c, t, g, unknown or other
  misc_feature (678)..(679): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
tcagcatagtagtgcacgaccggtgctcgatttagtatctgatagttgggtccctgagactctcctgtgcagcctctgggttcagcatcaagtaacgactacatgaccctgggcccgcaggctccgagggaaggggctgggagtgggtctcagttattagaaacagatgacactacatattatctgactccgtagaacgggtccgttcaccctctccagagacacttaccaacacatcttgtactctacanatgcaacaatcgtagagacgtacgaacgactaccggcctaaccttatttacgtgtcgcgtacganagtcgaactacgtctactaacgtttcggacggggacctagggaccgcccgaacggttccaccccgttaccgtaccccgacggaccctacccgaaaccggaaccggccctaacggtttccccggtaccctttaccccccggngggtaccccgtcccncggacccgtacccgacggaccgaccctaacccgtaccgacgaccgaccgaccgacgggccccggtacccggcggtaccgtccgccgttacgggactaaccgggtacccttaaccgttcccctaaccgttacttaacgtcgtacgtcggtacgggtacccgggtcgtacgggaccgtaacggccgtaacgacgtagcgtatgaccgnngngn

SEQ ID NO: 154381 - DNA, 823 bp, Homo sapiens
  misc_feature: GYAE6OF01AWLQU.10.38.D05.1.454.CMB.1.raw
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacgagggtcctgggcccagtctcgccctgactcagccctccctccgcgtccgggtctccgtggacagtcagtcaccatctcctgcactcggaaccagcagtgtacttttgttgtactttaataacttattcgttcctccgttacggtaaccacgtacccaacccgaacccgaggacccaaaaccgaccccccctaaaactttccgttttggtttttacggacggttaccgtaaggttaacggcccgggtacccctacgaacgggtaccgttccccgtaggtacgtttccgggtttcctccgtcggtacccttaccgtaagttccgtacggaccaaccgtacccggtcccttacccgtacgaccccgttcgtcggtccgggtacccttaccggacggtaccggtaggtaacgggtatacgggaacggtcgttagttaactttacgtacgtcgaccgtacgtccgtaactacgttacgttaccggaacccggtaaccccgtaagggttggggtttaccgggttcgggaccggggtacgggtaacggtaacggggttccggtacccggttccgggtacgggtacccaacccgggacccgtaacgggtccccgttaccccggtcccccgttacgggtacccttaccggtttaccccgttccccgttaccccccgtacccgttaccccg

SEQ ID NO: 154382 - DNA, 719 bp, Homo sapiens
  misc_feature: GYAE6OF01D0M11.10.38.D05.1.454.CMB.1.raw
  modified_base (588)..(588): a, c, t, g, unknown or other
  misc_feature (588)..(588): n is a, c, g, or t
  modified_base (608)..(608): a, c, t, g, unknown or other
  misc_feature (608)..(608): n is a, c, g, or t
  modified_base (640)..(640): a, c, t, g, unknown or other
  misc_feature (640)..(640): n is a, c, g, or t
  modified_base (678)..(678): a, c, t, g, unknown or other
  misc_feature (678)..(678): n is a, c, g, or t
tcagcatagtagtgcacgaccggtgctcgatttagtatctgatagttggggtttgggggggagaggagcccagcactgggattccgaggtgtttccattcggtgatcagcactgaacacagaggactcaccatggtagttttggctgagtcgttgggtttttccttgttgtcttatttacgaaaaggtcgtccatgtgtacggttcaacgtggtggagacgtgggaggaggcgtaggactccgaggtccggtcgggggtcctagacgtcctcctcgtgtcgcacgtccgttcgtcggttacacgctactacgtaacgtaacactactacgtcggaccggtacgggccccgtaccggacggtcccggtaccggggaaggggggaacgggtcggtagggtacggtttcggtacttacgttaaggttaataaggaaacgaggtacgtagaacgtaaactattaatttaacgtttactcgtacgtaccgttaccggtaggtaaccgggttcccgttccgtacccttaccgtacgaacgtaccgtaacttaccctaaacccaaatacttgttaccttagttacttacacactnactacgaactaagtcgaagngtaccgtacaacccgcgacccgtactaacttnttacggtcgcgtacgactatacttccgaacggttaccncgttaacgtacggttcgggaccgggtaaccgcggtaacccg

SEQ ID NO: 154383 - DNA, 528 bp, Homo sapiens
  misc_feature: GYAE6OF01A7MAE.10.38.D05.1.454.CMB.1.raw
  modified_base (505)..(528): a, c, t, g, unknown or other
  misc_feature (505)..(528): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggcctcaggagtccctgatcggttctctgcctcaagtctggcaacacggcctcctgaccgtctcgtgggctccaggctgaggatgaggctgattactatgcagcgcatactacaaccagcagctacttctgtactcggcggagggaccaagctcggaccgtctaggtcacgcccgaaggctacccgcccccgtcggtacctacccgttccgttccgttaccccccgacccctttcccgaccctaccttaacctacgtcgccgtcggacgggtcgggcgtcgggaccgacgggccgacgtagtagnnnnnnnnnnnnnnnnnnnnnnnn

SEQ ID NO: 154384 - DNA, 674 bp, Homo sapiens
  misc_feature: GYAE6OF01EGM51.10.38.D05.1.454.CMB.1.raw
  modified_base (621)..(621): a, c, t, g, unknown or other
  misc_feature (621)..(621): n is a, c, g, or t
tcagcatagtagtgcacgaccggtgctcgatttagtatctgataggttggggtttgggggggtctcaggaggcagcgctctcaggacgtcaccaccatggcctgggctctgcctcctcctcaccctcctcactcgagggcacgagggtcctgggcccagtctgccctgactcagccctccctcggcgtccgggtctccgtggacagtcagtcaccatcctcctgcactggaaccagcacgttgtacttttgtgtacttaataacttatcgtacctccgtaggtaccagccaccaccaggaccaaacgccccctaaattctttaggttttgaggtcaggtacgccggccctgacggtacgtcccgtagtacgttcggttctcgtacgtccctactaagtcgtaggaccaaccgtaccggcccttacccgtcgtacccgttcgtccgtcggggtccttccggaggccgttaggaggtaactcgggaggtctaggttaacttaccgtatcggcacgcgtactagttactccgacggacccctaaggtggggttcgttcgggaccgggtacggtacgtaacgggtccgaccggtccggtagggcccgacggacccgaaggtcccncccggtcccccgttggtccctacgttccttacccgtcccccgcccttaccccg

SEQ ID NO: 154385 - DNA, 726 bp, Homo sapiens
  misc_feature: GYAE6OF01B1ULE.10.38.D05.1.454.CMB.1.raw
  modified_base (555)..(555): a, c, t, g, unknown or other
  misc_feature (555)..(555): n is a, c, g, or t
  modified_base (573)..(573): a, c, t, g, unknown or other
  misc_feature (573)..(573): n is a, c, g, or t
  modified_base (590)..(590): a, c, t, g, unknown or other
  misc_feature (590)..(590): n is a, c, g, or t
  modified_base (685)..(685): a, c, t, g, unknown or other
  misc_feature (685)..(685): n is a, c, g, or t
  modified_base (716)..(716): a, c, t, g, unknown or other
  misc_feature (716)..(716): n is a, c, g, or t
  modified_base (722)..(722): a, c, t, g, unknown or other
  misc_feature (722)..(722): n is a, c, g, or t
tcagcatagtagtgcacgaccggtgctcgatttagtatctgataggttggggtttggggggggtctcagggaggcagcgctctcgaggacgtcaccaccagtggccgtgggctctgcctcctccctccaccctcctcacgtcgagggcacgcgggtccgtcgggcccagtctcgccctagactccacgtccctcccgtccggccggttcccgggtctaccgtcggacacgtcgacgtccacctacttccgtccgtcgacctacggtacggaaccacgccgttaggttcgtttaacgttttggtacgttactttaaactaacgttctcggttcctacggtacgaaccacgcccaaaccgaccgtaacgacccaaaccccgtaccccttaactttcgttttaggtttcgagttacgacgtaccggccgtacctaggtacggtacccttccgtaggttacggttcctttcgccgtaccgcccgttaaccgaagtccgtacggaaacctacccgggtcgtcccctacgtcggtacccgttggaccgtcgggacctcggngtacgaggtagagtacgngtacgagttattaccgngcgacgtacggtacactaagtaccgtacggaacccgtacgtagggttcgggtaggttccgggacggtacgtacggacgtccgtacgcgcgacgcncgacgttcgcccctcgagtcctactccgtcncccgtntacc

SEQ ID NO: 154386 - DNA, 793 bp, Homo sapiens
  misc_feature: GYAE6OF01A91EZ.10.38.D05.1.454.CMB.1.raw
  modified_base (330)..(330): a, c, t, g, unknown or other
  misc_feature (330)..(330): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccagtggtagttttggctgagtcgttgggttttccttgttgcttatttacgaaaggtgtccatgtggaggttcaagtgggtggagacgtgggagggaggctaggactccgacggtccgggtcggggggtccctaggacgtcctcctccgtggtcgccacgtccgttcgttcgggtaccagctactacgaacgtaactacctanacgtaccggacccggtccggggccccgaccggtacgggtacccgtaccggggaaggggggtacgggtccggtaggggtacggttcgggtactacgttagttaagtaacggaaacgtggaagtacggactaactaacgtatttacttaacgttctacggtaccgttacggtaacgggtacccgggttccctaccctaccctacgtaccgaacgtaaccgtaacctacctaaacccaacgtaacttccgtttattacgttacctaccgttaacctacgtactacgaacctaacgttagtacggtaaggtaacggaccgtaccgaaccggtacccgacccggtaccttaaacgtttggttacgttacggacggacccggtataaccgtaacggttccaacccggttacgacccttaaacggttcggttaacccggggaccggggaacccgtacggggtaccccccg

SEQ ID NO: 154387 - DNA, 275 bp, Homo sapiens
  misc_feature: GYAE6OF01EE6S5.10.38.D05.1.454.CMB.1.raw
  modified_base (245)..(245): a, c, t, g, unknown or other
  misc_feature (245)..(245): n is a, c, g, or t
  modified_base (250)..(275): a, c, t, g, unknown or other
  misc_feature (250)..(275): n is a, c, g, or t
tcagcatagtagtgcacgaccggtgctcgatttagtatctgatagttgggtttgggtgccgaagttgctggaggtcaccgtctccccagcctccaccgaagggccctatccggtccttcccccgtggccgccctgctccgagggacgcacctcgagaggcacgacggccggccgtgggctcgccttggtacaacggtaccttacctcccatactatgtctggaggcgggctaggacgaagcgtanagtgnnnnnnnnnnnnnnnnnnnnnnnnnn

SEQ ID NO: 154388 - DNA, 708 bp, Homo sapiens
  misc_feature: GYAE6OF01CEWGV.10.38.D05.1.454.CMB.1.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
tcagcatagtagtgcacgaccggtgctcgatttagtatctgatagctgggttttccttgttgctatttcaaaaggtgtccactgtgaggttcaactggtggagaccggaggaggctggatccagcctggggggtccctgagactctcctgtgcagcctctgggttcagcatcagtaacgactacatgacctgggcccnccaggctccgaggggaagggctggagtgggtctacgtaagtttatagaaacgngaagtggacactacattattattctagaactccggtagaacgggtccgttaccaccctctccagacactaccttaccaacaactatcttgtactcttacgactactcgacaccgtaatcgtagagtacgtacggaacgtaccgaccggtacctaaccttaagttacgttcggttacgcgtaccgaactactacgtacctaaccgtcctacgttaacgttaccggtacgggacccgaagggaccgcccgtaaccggtaccctaacccggttcccctaccccgaccgtacccgtaccccgaacccggtaaaccgggaccccctaaccggttcccggttccccgttcccccgtcggccccgtccctccggccctccggaccgtacgacccgtccgtaccgaacggaccgaccaacggtcccggacccggtaccggtccgggccgtccgtcccggtaacgg

SEQ ID NO: 154389 - DNA, 775 bp, Homo sapiens
  misc_feature: GYAE6OF01AP5GK.10.38.D05.1.454.CMB.1.raw
  modified_base (762)..(762): a, c, t, g, unknown or other
  misc_feature (762)..(762): n is a, c, g, or t
  modified_base (772)..(772): a, c, t, g, unknown or other
  misc_feature (772)..(772): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagccctccctccgcgtccgggtctcctggacagtcagtcaccatctcctgcacgtggaaccagcagtgtacttttgttgtcttaataactatcgttcctccgtaggtacccagccaacccaacccgaggaccaaaccgcccccctaaattccttttggttttgaggtccaaggtacgccggtccctgaggtactccctgacgttccggttctcgtcgccctaccgaagttcctggaccaaccggtaccggtccccttcccgtacggtacccgtcgttcggtcggggcctcccgaggtcgtagggaacggtgtcgggtaggtacgtaggtaactttaccgtacggtgaccgaggccgtactaacttacgttaccgaacccggtaccccgaacgggttacggggtttggttacggggtccggggaccgggtaacggttacgggtccggtaaccggttccccggtagggtcccgaaccggtacccgtaacgggtcctaccccggtcccccggttcggtaccctaccggttccgtttccccggttacccccgtcccccgttcccttaccccgacgtttaaccctacgtccggtaccggttagggccgggtccggggaccgtcgggtaaccggtaccgggacgtanaaccgggttngcg

SEQ ID NO: 154390 - DNA, 1019 bp, Homo sapiens
  misc_feature: GYAE6OF01CRDEG.10.38.D05.1.454.CMB.1.raw
  modified_base (181)..(181): a, c, t, g, unknown or other
  misc_feature (181)..(181): n is a, c, g, or t
tcagcatagtagtgcacgaccggtgctcgatttagtatctgataggttggggtttgggggggggtctcaggaggcagcgctctcaggacgtcaccaccatggccgtgggctctgcctccctcctccaccctcctcactcgagggcacgacgggtccgtgggcccagtctcgccctgactcncgtccctcccgtcggccgtcccgggtctccgtggacctgtacacgtccacctacttcctccgtgacctacgtacggaaccaggtactaggtcgtttacgtttgttacgtactttaactaacttacttcgttacctaccgttaccggtaaccaccgacccaacccgacccgaacggtaaccctaaaccccggtaaccccccttaaacgtttttccccggttttaggtttttacgggaccggttaaccgtaaacgggtaaccggtccccggttcccgtacggaaaccgggtcccgttaccccgttaggttaccggttcccggtttaccttccgtacccggtaccccgttaaccggtaacggttcccggtaaccggtacccgtaaacccggtccccgttacccccgtacccgttaccggtaccccggttccggttacccgggtccggggttaccctccgggtaacgggtacgggttaccgggaacggggaacggttacgggtactttaaggggtttaacctttaaccggttcccgtaaggttacccgtaaaccgggttccttaaacgtaaacccgttaaacctaacccgtaaaacccggtccggtaacctaaaccggtttacccgttaccgttttcgggtttaaacccgggttaacggggttacccggggggtaaaaccgggggttacccggtaaaaccccgggtaccgttaccgggttaaccccggttaccccgggtacgttaaacccgggggtacccgtaacccgggaccccgttacggtccccgttaaccccgggtccccggtttaaaccggtccccgtttaacccggttcccccggg

SEQ ID NO: 154391 - DNA, 774 bp, Homo sapiens
  misc_feature: GYAE6OF01DTWPI.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggtttttccttgttgcttatttacaaaaggtgtccactgtgaggttacaacgtggtggagacgtgggagggaggctggatccgagccggtcggggggtccctgagactcctcctgcgcacgcctcgtgggttcagcatcaagtaaccgactacatcgaccgtcgggccccgccgaggtccgtaccggagggggtaacgggcgtgggtaggtcgggtactacgtagttattacggaaacgtaggagtacggactaaacgtaactaatttaatttacgtttacgtacggaccgttccggtaaggggtaaccggggtcccgttacccgtaccccttaccgtacccaagggtaaccgaccccttaaaccctttaaccccaaaccgtaaaatacctttacgtttacggtaacttccctttaccaagtacttaggtaacccaacgttaagttacccgagggaaaccgtaacgggttcccggaaaccggtaacccgaccccggtaccttaaacccgtttaagtttacgtacgggttcgacccggtaccgtaaaacttcggtacggtaacccctaccggttacctacgttaaaccgttcgggtaccgggggaacccggtaggggtaaccccg

SEQ ID NO: 154392 - DNA, 848 bp, Homo sapiens
  misc_feature: GYAE6OF01AGICW.10.38.D05.1.454.CMB.1.raw
tcagcatagtagtgcacgaccggtgctcgatttagtatctgatagttgggtttgggggctctgctcctcctcaccctcctcactcgagggcacgagggtcctgggcccagtctgccctgactcagccctccctccgcggtccgggtctccgtggacagtcagtccacctatcctcctgcacgtggaaccagacaggtgtactttgttgtacttaataacttatcgttcctcgtacggtaccacgaccaaccgacccgacggaccaaaacccgtaccccctaaactttccgttttaggttttaggacggtactaacggtaacggtcccggtcccgtacggacggtaccgttccctaggtacgttaccggttctctacggtaccctacgaacgtccgtacggaaccaaccgccggtccctcccgtacggtaccctcgtacggcggtccgtaccggaggtcgtaggaaggtacgtaggacgtctacgtactttaaccgtacgacgacgacggcctactagttacctaaccggacccgggaacccgtaagggtttgggggttaccggttaccgggggaccggggtaaaccggggttaacgtacccggggtacgttacccggtacgggtacggtaccgaaccccgggtaccgtaccgggtccccgttccccggtcccccggttaaccggttccttacccggttcccgttacccccggtccccccgttaccgttaccccgttaacccgttaaccttaaaccggttcggtccggttacccgggtaccggggaccgggttccccgggtcggttaacccggggaaccgaacgggttccggaactaacgggcagtccg

SEQ ID NO: 154393 - DNA, 759 bp, Homo sapiens
  misc_feature: GYAE6OF01EMXO9.10.38.D05.1.454.CMB.1.raw
  modified_base (223)..(223): a, c, t, g, unknown or other
  misc_feature (223)..(223): n is a, c, g, or t
  modified_base (575)..(575): a, c, t, g, unknown or other
  misc_feature (575)..(575): n is a, c, g, or t
tcagcatagtagtgcacgaccggtgctcgatttagtatctgatagttgggtttgggggggtctcaggaggcagcgctctcaggacgtcaccacatggcctgggctctgcctcctcctcaccctctcactcgagggcacgagggtcctgggcccagtctgccctgactcacgccctccctccggcgtccggtctccgtaggacagtcagtccacctatcctccngcacgtgggaaccagccgtagttcgtactttttggtacgtactttaaataaccttagttcgttcccgttaccgttacgggttaaccacgaccaacccaacccgacgggtaaccaaaacccgtaccccccctaaaacgtttcccgttttacggttttttacggacgggtttaccgtaacgggtttaaaccggcccgggaccccgtttacggaacgggtaaccgtttccccgttaggtacgtttccgggtttctccgtaacggtcccttaccgtaaacgttccgtacggacctaaaccggtccggtcccttccgacgtcccggtctcggttcgggacctcgacggtcagggagngtcggagtctagtactctacgtgacgtgcctatacttacgtaccgaacggaccctaagggtcgggtttcggttcgggacggacggtaacgtcggtccgtaccggttcggtacgaccgtccgacggtaccgtcgtccccgacccgttcgtacgtccttccggtacccgttccccgccgttacccc

SEQ ID NO: 154394 - DNA, 749 bp, Homo sapiens
  misc_feature: GYAE6OF01CJOWU.10.38.D05.1.454.CMB.1.raw
  modified_base (258)..(258): a, c, t, g, unknown or other
  misc_feature (258)..(258): n is a, c, g, or t
tcagcatagtagtgcacgaccggtgctcgatttagtatctgataggttggggtttgggggggggtctcagggaggcagcgctctcaggacgtcaccaccagtcggcctgggctctgctcctcctccaccctcctcactcgagggcacgacgggtcctgggcccagtctcgccctgacctcacgtccctcccgtccggcggtccgggtctccgtaggacacgtcacgtccaccatccgtcctgaccacgtacggaaccngactagttgtacgttttgtgtactttaataacgttatcggtcctccgtacggtaaccacgaccacccgaccgacggtacccaaaccggtacccccttaaactttccgtttttaggtttacggacggtacgtaacggtaccgcccggtcctaggtacggtactcctgtaccttcggtactcctcgtcccgtactaaggtcacgacgtaacccgccgttcccctaccgtacggcccgttctccgggtccgtcgtacccggtagaccgttagggtaacggtgttacgggaccgttcggtaacgttacccgttaactcggtacggctacggccttaactaagtccgtacgacccggtaccaacggggttgggtcggtacgggacggacgggttaataccgggctacccggtggttaccggacctaccgggccgtaccggtcccttccggtccccgttgtaccgtaccttccccgggtccctcccgtccccgttac

SEQ ID NO: 154395 - DNA, 797 bp, Homo sapiens
  misc_feature: GYAE6OF01B3HFW.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtgggaggaggcgtggactccgaggccggtcgggggtccctggacgtactcctccgtgtcgcacgtccttcgtcgggttcacgtactaataccgtaacggtaaccgtaactaacacgtcggacccgtccgggccccgccgaacggccgtaccggaagggggaacggggtcgtgggaggtgggtcgtacgtagtttactaacgaaacgagtacgtaggactactaactaatttaagttacttcgtacgtaccgtaccggtacgggtaacccgggtcccggttaccctaccccgttcgtaccgaacggtaaccgtaaccctaaccttaaaccccaaactaaccttactttacccgttacgttacctttacccgtactaactaacgtcgtaaccctaacttaacgtccgtaggtaaacgtaccggtaacccgaaccggtaacccgtaacccggtaccccttaaacgtttactttaacggttccggtacgacccgtagtaacccgttagtacccggaacccgtttaaccggtccttaaccggttaaacgggttccggggaccggggtaacccggtacccgggggtaacccg

SEQ ID NO: 154396 - DNA, 459 bp, Homo sapiens
  misc_feature: GYAE6OF01CO0V9.10.38.D05.1.454.CMB.1.raw
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (437)..(459): a, c, t, g, unknown or other
  misc_feature (437)..(459): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgtttttgaggtcagtaagcggccctcaggagtccctgatcggttctctgcctccaagtctggcaactacggcctccctgacccgtctctgggctccaggctgaggatgaggctgattactactgcagcgcatattcaggccccaacagggtgtttggcggcggactaaggtgaccgtctgggtcagcccaaggctgccccctggtcactctgttcccncctctccactactatnctgagcggntggcaagngcatgnnnnnnnnnnnnnnnnnnnnnnn

SEQ ID NO: 154397 - DNA, 1015 bp, Homo sapiens
  misc_feature: GYAE6OF01ANQTU.10.38.D05.1.454.CMB.1.raw
  modified_base (1005)..(1005): a, c, t, g, unknown or other
  misc_feature (1005)..(1005): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcgttgggttttccttgttgtcttatttacgaaaaggttcgtaccacgtgtagtacggtttaccgtaacgttgggtggacgtacggtagggagggacggcgtagggactccgacggtcccgggtcggggggtcccctaggaacgtaccttccgtcccgtggtcgccgtacggtccccgttcggttcgggttaccgacgtaccgtaacgttaaccgtaaacggttaaaaccgtaaccttaacgtacgttaaccgggtacccccggtcccggggggaccccccgacccggtaccggggtaccccgtaacccggggaacgggggggtaaacggggtcccggttacgggggtacgggtttcggggttccgttaaccggttaaggttttaaacgttaaacgggaaaaaccgtacggtaacggttaccgggtaaaccttaaaccgttaacgttaacgttttaacttttaaccggtttccgttaaccggtaacccggtttacccggggttaaaccgggttaacccggggttacccccgtttaccccgtacccccgtttaaccgttaacggaaaccggtaaccccgtaacccttttaaacccccgttaaaaccccgaaaacttaaaccgtttcgttttaaacccgtttacctttaacttccccgttaaacgacttacccgtaacgtaacctaaacctaacggtttccgtaagggtaaccgtaacccggggttcccgaaaccccgggtaaccgtaacccccggtaacctttccgttaaagttttccggtacggtaccgaccgttaccgaatacgttacccaaccggttctacccgtttaggtacgttacccgggccggggtaaccgnggtaaccccg

SEQ ID NO: 154398 - DNA, 706 bp, Homo sapiens
  misc_feature: GYAE6OF01CYS64.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcacgccctccctccgcgtccgggtctccgtggactagtcagtccaccacttctctgccacgtacggaacagctagtcgtacttttgctacttaagtaactattcgtaccttccgtacggtaaccacgaccaccaccgacggaaccaaaccgacccctaaacttccgttttagttttacgaggttacagtaacggccgtcctcgagtacctcctagtacgttcgttctctcgtccactagcgtcgacaccgccgtccctccgtcgtccttctcggtcggcctacgacgcgtagagtacgtggcgtcttagtacttacgtctcgacgtacgtacgtactacttacgtaccggaaacccgtaccggtaacgggttcggggttcgtacggggacgggtacgggtaacggtaccgggtaccggttcccggtacggtacgggtacccgtaccggacgggaacccgttccgtaccccgggtaccccggttccggttacccgttacccgtttccggttcccccgtccccgttcccggttacccc

SEQ ID NO: 154399 - DNA, 863 bp, Homo sapiens
  misc_feature: GYAE6OF01AUBOY.10.38.D05.1.454.CMB.1.raw
tcagcatagtagtgcacgaccggtgctcgatttagtatctgatagttggggtttgggggggggtctcaggaggcagcgctctcaggacgtcaccaccatggcctgggctctgctcctcctcaccctctcactcgagggcacgagggtccgtgggcccagtctcgccctgactcacgccctcccgtccgccggtccgggtctccgtggactagtcacgtccacctacttccgtcctagcctacgtacggaacccagctaggttcgttacgttttgtcgtacttaattaacttagttcgttccgttacgtaccgggtacccacgtaccccaacccgaacccggaagtaacccaaaacccccgtacccccttaaacgtttccgttttacgggttttaggaccggttactaacgggtaccgtcccggtacctacggacggtaccgttcctaggttaccgtttccggttacctccgtaccgtacccgtaacgtaacggttccgaccggtaaccgaaccggtcccgtccccgttacccgtcggtacccgtttcgtaccggtccggtaccgtaccggcggtaccgtacggtaccggtacggtaacggtacgtaacgttaacgtttacgttaccgtacgtacggtaacccgtgttaaccgtacgttagtacggttaacgtttcggtaccggtttccggttacccgttttccgggttaacggggttaccgggttccggggaacgtttacgggaccgttacgggtaccgttaaccggtaccggtacgttaccgaccggtaccccgtaccgggtaccccgttcccgtccccgtacccggtttacccgtaccgtcccgttcccgttacccccccg

SEQ ID NO: 154400 - DNA, 885 bp, Homo sapiens
  misc_feature: GYAE6OF01DP8YN.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgatagttgggtttgggggggggtctcaggaggcagcgctctcaggacgtcaccaccatggcctggctctgcctcctcctccaccctcctcactcgagggcacgagggtcctgggcccagtctcgccctgactcacgccctccctccggcgtccgggtctcgtggacagtcagtcacctatcctccgtcnctacgtacggaaccagccagttctacgttttggttcgactttaataaaccttagtcgttccttccgtacggtaaccgacgaccaacccacccgaaggaccgtaaaccccgacccccttaaaactttccgtttttaggtttttacggaacggtaccgtaaggttaccggacccggtccccttaggaacgggtacccgttccccgttaggtaccgtttccggttaccgttccgtccgttaccctaccgtaacggttccgtacggaaccctaaacccggtcccgtcccctaccccgttacggtacccggtttccgtccgggttcgggtaccccgtaccggtcggttaccggtagggtaacggtacgtgggtaccggtacttaagggttaaccctttacgtaaccggcgtacgtaacggccgtaacttacggttttaaccgaccccggacccgggttaaaccccgtagggttcggggttttacggtacggggacggggttaacccgggaacgttacggggtacccgttaccgggttcccgaagggggttaccccgacccggaaccgggtaaccgggttccgcccccggtttcccccgggaccgtttacccacccccggtttaccggtttcccccccgtaccctttaccccccggttaacc

SEQ ID NO: 154401 - DNA, 778 bp, Homo sapiens
  misc_feature: GYAE6OF01EGE74.10.38.D05.1.454.CMB.1.raw
  modified_base (567)..(567): a, c, t, g, unknown or other
  misc_feature (567)..(567): n is a, c, g, or t
  modified_base (571)..(571): a, c, t, g, unknown or other
  misc_feature (571)..(571): n is a, c, g, or t
  modified_base (703)..(703): a, c, t, g, unknown or other
  misc_feature (703)..(703): n is a, c, g, or t
tcagcatagtagtgcacgaccggtgctcgatttagtatctgataggttggggtttggggggggtctcaggaggcagcgctctcaggacgtcaccaccatggcctgggctctgcctccctcctccaccctcctcactcgagggcacgacgggtccgtcgggcccagtctcgccctcgactccaccgtccccttcccgtccggtccggttcccggtcctccgtcggacgtagtacctacgtccaaccctacttccttccgtacgacctaaccgtaacggaaccaggtaccgtaggttacgttacgtttttcggttacttaacctttaattaacttacgttccgttaccttccgtacggtaccaccgaccgaacccgaacccggaacgaaacccgtaaacccgtaacccccttaacgttttccgttttaggtttttacggacgttacgtaacggtacggcccggtcccgtacggtacggtccttccgtagtacgttccgttcctcgtccgtcctacgtacgttcgcgaaccgtacgtcccggcctcccgtcgtccgttcgcgtcggtccncggngcgtggacgtcgtagcggtctaagttaccgtactcgacgtcgacgcgttacacttcgtccggaaccgtacgtacgggtcggggtttcggtcgggacgggtacgtacggttcggtaccggtaccgttccgggngtaccgccggaccgacggtcccctccgggtcccgttacgtcccgttaccctccggttcccctcccttcccgtacc

SEQ ID NO: 154402 - DNA, 756 bp, Homo sapiens
  misc_feature: GYAE6OF01C9FMN.10.38.D05.1.454.CMB.1.raw
tcagcatagtagtgcacgaccggtgctcgatttagtatctgatagttggggtttggggggagaggagcccagcactgggattccgaggtgtttccattcggtgatcagcactgaacacagaggactcacatggtagttttgctgagtcttgggttttccttgttgcttatttacaaaaggtgtccactgtgtaggttcaacgtggtggagacgtgggaggaggctggactccgagccggtcgggggtccctgacgactcctcctgtcgcacgtcctcgtgggttacagactactacgaacgtaacgactacacgtcggaccggtcggggcccccggccggtaccggccggtaacggggaacgggggacgggtcgggtagggtcgggttcgttacctaaggttaagttaacgtaaacgaagagtcggacgtaactaactaacttatttaacttacgtacgtacgtaccgtacgggtaacgggtaccggttacccgtaccctaccgtccgacgagtaacctacctacctaaacaactacttcttacgttatcttaccactactgtaccaactaacgtacgttaccgaagggtaaccgacgaacccgaacctaaccgtaaccccgttacttaacgtttagttaccggacgggtaccgaacccgtaaacgattaccgggttaaaccgacccgttacgtacctttaacggttaacccggggtccgggggaacccgggtaaggggtcccccggtaaaccccg

SEQ ID NO: 154403 - DNA, 811 bp, Homo sapiens
  misc_feature: GYAE6OF01EZVC9.10.38.D05.1.454.CMB.1.raw
  modified_base (647)..(647): a, c, t, g, unknown or other
  misc_feature (647)..(647): n is a, c, g, or t
tcagcatagtagtgcacgaccggtgctcgatttagtatctgatagttgggtttgcgggggagaggagcccagcactgggattccgaggtgtttccattcggtgatcagcactgaacacagaggactcaccatggtagttttggctgagtcgttgggtttttccttgttgcttatttacgaaaaggtcgtccactgtggaggttcaacgtgggtggagacgtgggagggaggctggactccgacggtccgggttcgggggggtccctaggagtaccttccgttccgtggtcgccgacgtcccgttcggttcggggtttacgacggtccaattaccgaaaggttaaaccgaaccttaacgaagtcggtaacccggttccgggggccccgacccgacggggtcctacccggggaaggggggaaagggggtccgtaggggtaggtcggggttctaccgttaaggtttaagttaacggaaacgtaaggtaggtacggtactaacttaacgtaatttaattttacgttcttacggtaccgttccggtaacgggtaaccggggtacccgtttacccgtccgttaccgttaccacgaacgtaacctaacccttaaaccaaaccgtaatacctttacttacgttactaccgtttanacctagtacgactaacgaactttgaggtaacggtacgtaccgaccgaaccggtacccgtaactaccttatttaggttccgtacggcggtaacccgatcggttaaccgaccgttacgtaccgttacgtaaacgttccggggttaaccgggccgggttaaaccggg

SEQ ID NO: 154404 - DNA, 803 bp, Homo sapiens
  misc_feature: GYAE6OF01BDEBA.10.38.D05.1.454.CMB.1.raw
  modified_base (605)..(605): a, c, t, g, unknown or other
  misc_feature (605)..(605): n is a, c, g, or t
  modified_base (613)..(613): a, c, t, g, unknown or other
  misc_feature (613)..(613): n is a, c, g, or t
tcagcatagtagtgcacgaccggtgctcgatttagtatctgatagttgggtttggggggagaggagcccagcactgggattccgaggtgttccattcggtgatcagcactgaacacagaggactcaccatggtagtttggctgagtctgggttttccttgttgctattcaaaggtgtccacgtgtgaggttcaacgtggtggagacgtggaggaggcgtaggactccgacggtccggtgggggtccctggacgtaccgtctccgtggtcgccgtacgtccgttacggttcggggttaccaacggtacctacgtaccgtaaacggttaaccgtaaccttaacgtaacgttccggtaacccggttccggggacccccgaccggtaacgggtccgttaaccgggaacggggggtaacggggtcgttacggggtaacggttcgggttaccttaccgtaaggttttagttaacggaaaccgtaggtacgtaccggtacgtaactaacgtacgttaacgtttacgttacgtacgtaccgtccggtaaggtaaccggggtcccgttacctacccgttcgacggtaacgacgtaacccacttaaccccgaaanaaccgttnttacgttgtactcttaccgatctacggtactaactactcgtaggaacgtaccgggttacgaacccgtaacccgaaccgggttctaaacccgttttagttcgtacgggtaccgacggtactaaactggtaccccggtaacaaccggttcccttaaggtaccgttcccgggagggcccgtaagggtaccccg

SEQ ID NO: 154405 - DNA, 650 bp, Homo sapiens
  misc_feature: GYAE6OF01BFFBR.10.38.D05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactggaaccagcagtgactttgtgcttataactatgtctctggtaccagcaccacccaggcaaacgcccccaaactccttgttttgagtcagtaagccggccctcgaggacgtccctgtactcggttctcgtcgtccctccaaagtctgggaccaaacgccggtccctcccgtgacccgtctcgtcgggcctcgaggctggaggatggacggctagactttactcgtacgcagccgctaacttacgttccgaaccggtaccccaaacggtcgggggtttacggttttcggggaccggggtacgggtaacgttaacgggttccggaacccggttccggtacgggtaccgacggtaccccgaagggtcccgtacccgtcccccccggttaggtaccctacccgttccgtcccggttcccccgccccttaccccg

SEQ ID NO: 154406 - DNA, 865 bp, Homo sapiens
  misc_feature: GYAE6OF01BE9ZF.10.38.D05.1.454.CMB.1.raw
  modified_base (781)..(781): a, c, t, g, unknown or other
  misc_feature (781)..(781): n is a, c, g, or t
tcagcatagtagtgcacgaccggtgctcgatttagtatctgataggttggggtttgggggggagaggagcccagcactgggattccgaggtgtttccattcggtgatcagcactagaacacagagactcaccatggtagttttggctgagtcgttgggtttttccttgttgacttaatttacgaaaaggtcgtccatggtgtagttacaacgtgggtaggagacgtgggagggaggcgtgggactaccgacggtcccgggttcggggggtccctggacgtaccttcctccgtgtcgcctaccggtcccgttcggttcgggttaccaagtacctagtacctaaacggtaaaccgtactacctagtccggtacccgtcggggcccccgacgtacggccgtacgggaagggggacgggtcgtaggggtacgttcgggttacgtacgttagttaacgtaacggaaacgtggtacgtcggaacctacttaacgattttacgtttacttaccgacgttaccgttacggtacgggtaaccgggtcccggtttacccaccctttaccgacgtaacgtaccgtaaccttaccccgtaaacaaacctaaccgttagttttcccgtaatttacccgtacctttacgaaactttgaaccccggtacttaaaccgttaacggcgttaacggggtaaccgtaccggggtaaacccgttacccgaaacccgggttacccggtaaccctttaaccttaacggtttgggtttacggtcccgaaccccgggtaaacttntaaccgggttaccgtaacccctaaccgtccggttacgtaaacggttcccgggggaacgggtacccccggtagggggtacccccg

SEQ ID NO: 154407 - DNA, 780 bp, Homo sapiens
  misc_feature: GYAE6OF01DNG45.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccagtggtagttttggctgagtcgttgggttttccttgttgcttatttacgaaaaggtgtccactggtgtaggttacaacgtggtaggagacgtgggaggaggctggactccgaggtccggtcgggggtccctgacgtactccgtcctgtcgctacgtcctcggttggttacacgctagtacgtaacggtaacgactactacgtccgtaccggtcggaccccgaccggacggtccgtaacgggaagggggacgggtacgtgggtaggtcggttacctagttacgttaagtaacgaactaggtacgtacgaacctaacgtaacttaatttactttacgttcgacgttaaccgtccgggttaacgggtacgggttaccccgttacccacccgtccgtaaccgaacggtaaccctaacccgttaacccttaaccgtaaaccgtaactttcttaaccgtttacgtttaccttaccgttacaaacgttcttaccgaacttaacgtaacgtcggtaccgtaacggtaccgtaacgacccgaaccgtaaccggtaccttaaccttagtttaccggcgtaccggcgtaaaccgattacggtaccaaccgttcgtaacccgtcgttacggtaccgggttaccgggacggtacgggtaccccg

SEQ ID NO: 154408 - DNA, 746 bp, Homo sapiens
  misc_feature: GYAE6OF01EU4EH.10.38.D05.1.454.CMB.1.raw
tcagcatagtagtgcacgaccggtgctcgatttagtatctgatagttggggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggactccaggccggtcgggggtcctgacgactctccgtgtgcacgcctcgtgggttcagcatcgaagtaacgactacatcgaccgtcgggccccgcgacggccgtaccggaagggggaacggggtcgtgggacgggttgggtccttacgtaaggtttaagttacggaaaacgaggtagtcggaactaactaactactttaatttacttcgtacgtaccgtccggtacgggaacgggttccccgttacctaccccgttaccgtaccgaacggtaacgtacctaaacccttaaccgaaaaccctaacgttacgtttacctttacggtttaacttaccctttaaccgacctaagtcgaacctaactaacgttcgtaaggaacgtacgggtacccggaacggaacccacccgggtacccttaaccgttagtttaccgttagggaccgtaccgggactaacgtacttcggtaaccctaccggttaccttaacgttaacggttaccggggtccgggacctgggtaaccgggg

SEQ ID NO: 154409 - DNA, 699 bp, Homo sapiens
  misc_feature: GYAE6OF01E07YT.10.38.D05.1.454.CMB.1.raw
  modified_base (641)..(641): a, c, t, g, unknown or other
  misc_feature (641)..(641): n is a, c, g, or t
  modified_base (648)..(648): a, c, t, g, unknown or other
  misc_feature (648)..(648): n is a, c, g, or t
  modified_base (653)..(653): a, c, t, g, unknown or other
  misc_feature (653)..(653): n is a, c, g, or t
  modified_base (656)..(656): a, c, t, g, unknown or other
  misc_feature (656)..(656): n is a, c, g, or t
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (671)..(671): a, c, t, g, unknown or other
  misc_feature (671)..(671): n is a, c, g, or t
  modified_base (674)..(674): a, c, t, g, unknown or other
  misc_feature (674)..(674): n is a, c, g, or t
  modified_base (679)..(679): a, c, t, g, unknown or other
  misc_feature (679)..(679): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
  modified_base (696)..(696): a, c, t, g, unknown or other
  misc_feature (696)..(696): n is a, c, g, or t
  modified_base (698)..(698): a, c, t, g, unknown or other
  misc_feature (698)..(698): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctctgtacagcaccaccagcaaacgccccaaactccttgttttgaggtcagtaagcggcctcaggagtccctgattcggttctctgcctccaagtctggacaacgacggcctacctgaccgttctcgtagggcctcgaggctgaggatgaggctgaattactacgtcgcgagtccgctaacttacgtttaccgaaccggtaccccccaaaggttaggggttcggttttacgggaccggggtaccggtaacggtaaacgggttcggtaacccggtttcccggtaggggttaccaacggtaccccggtaaaacggtcccgtcccggtaacccccccgttcggggtacctaacccgtttcccgtttaccggtttccccccggtccccctttaccccgttacccctaaaccgtttaacccgtaacgttacgggtaccgtttagggaacgggcccgggggtacccgttagggacccgggtaaacggtccccggagtaacgttaacggngctagcncgtanacncgcgcgcgnganatngcnacgcncgcgtcgtcncntcngngng

SEQ ID NO: 154410 - DNA, 742 bp, Homo sapiens
  misc_feature: GYAE6OF01BVJKM.10.38.D05.1.454.CMB.1.raw
  modified_base (739)..(739): a, c, t, g, unknown or other
  misc_feature (739)..(739): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcgtagtaccagaccaccaccaggaccaaaccgaccccctaaattcctttggttttagaggtccaaggtaacgccggtccctgacggtcgtaccctgtacgttccggttctcgtcgaccctaccgtaagttccgtcggacctaaccgaccggtcccttacccgtcggtacccgttccgttccgtacgggccttaccggacggtccgttagggaacggtctagggtacggtaccttaagtaacgtttaacccgttacgtacggacgaacggtaccggtactaaccgtttaacgttaccgaaccgggtacccctaaggtaggggttcggtttacggggacgggtaaccgggaacgtttaacgggccggtaacccggttcgtacgggtccaacggcccgtaaggtcccgttcccggccccgttccggacctccgttacccgttccgttcccccgtaccccgttcctacccgtacttaccgttagtccgcgttgggaccggtcggtcgtacggaccggtacgcgtatacgtcgngtc

SEQ ID NO: 154411 - DNA, 636 bp, Homo sapiens
  misc_feature: GYAE6OF01BM54C.10.38.D05.1.454.CMB.1.raw
  modified_base (410)..(410): a, c, t, g, unknown or other
  misc_feature (410)..(410): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgacgactctcctgtgcagcctgtgggttcagcatcagtaacgatacatcgacctggccgcagctccgaggggaagggctggaggtggtctacgtagtaattagaaacagatggacactactatattattctcgacgtccgtaggaaacgggtcccgtttacaaccccgttnaccgaacgaggaccaactttacccaaacgaactattccgttagtaatccttaccagtaacctgcccaaacgtaactcgtaggacgtaacggttaccgaaacgacgtaacccggaccctaaaccgttagttaacttcgggtagcccggttaaagacctaaagttcggtaacccttaagacccgtactaaacggtttcccggtcgggggaaccaacgggggtaccccg

SEQ ID NO: 154412 - DNA, 1006 bp, Homo sapiens
  misc_feature: GYAE6OF01B74HP.10.38.D05.1.454.CMB.1.raw
  modified_base (285)..(285): a, c, t, g, unknown or other
  misc_feature (285)..(285): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcgagggcacgagggtcctcgggcccagtctgccctgactcacgccctcccgtccgccggtccgggtctccgtggactagtcacgtcaccattcctcctgaccacgtacggaaccatacgagttcgttacttttggttacgacttttttttaanaacttacttcggtccttccgttacggtaaccgacgacccaacccgacccgaaggaacccaaacccgtacccccctaaacgtttcccgtttttaggtttttacggaacggttacgaacggtaaccggcccggtacccgtacgtaacgggtaccgttacccttaggtaccgtttccggtttcctccgttaccgtacccgttaaccgtaacggttccgtacgggtaacccgtaaacccggtcccggtaccccgttacccgttaccggtaccccggtttccggttccggttaccgggggtaccctaacccgggtacgggtacccggtagggggtaacggtacggtacgggacggttaccgttaacgggttaactttaacccggtacgttaccggacccggtacggtaacccgttaaccgttaaacgtttaaccggttaacccgggaaccccgggttaaacccccggtttaaaggggttacccggggggttttacggggttttacccggggggaacccgggggtttaacccgggggttaaacggttaaccggggtttcccggggttaaaccccgggttccgggtaccggggttaaccggtaaccccggacccggggttaaccggttcccccgggttaccccgtttaccccccgggttacgttacccccgttaccccgtttacccccggtttaccccgttaccccccgttccccgtttaacccccgg

SEQ ID NO: 154413 - DNA, 665 bp, Homo sapiens
  misc_feature: GYAE6OF01DR8KG.10.38.D05.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcacgcctccctcgcgtccgggtctccgtggacagtcagtcaccatctcctgcactggaaccngcagtnacttttgtgcttanaactatgtctctggtaccagcaccaccagacaacgccccctaatcctttgtttcgagtcagtacgccgcctgaggtctcctgtacgttccggttctcgtcgccctacgtaagtccgtacggaccaaccgacggtcccctaccgtacgtaccgtctcgtcgggcctacgcggcgtaggacgtagtggacggtacttagtacttaacgtcgtcgacgacgccgtactatacgttcgaaccggtaccccgaaggttacggggttggtttaccgggaccggggtacggtaacggttacggtaccgggtacccggttccggtcgggtaccgtaccggtacccgagggtccccgttacccggtccccccggttcggtaccgtacccgttcccgttccggttcccccctaaccccgttcccc

SEQ ID NO: 154414 - DNA, 966 bp, Homo sapiens
  misc_feature: GYAE6OF01BOTNS.10.38.D05.1.454.CMB.1.raw
tcagcatagtagtgcacgaccggtgctcgatttagtatctgatagttgggtttgcggggagaggagcccagcactgggattccgaggtgtttccagttcggtgatcagcactgaacacagagactcacatggtagtttggctgagtcgttgggttttcctttgttgtcttatttacgaaaaggtcgtacctactggtggtaggttacaacgtgggtggagacgtgggagggaggtcgtggactccgacggtccgggtcggggggtcccgtaggacgtacctccttccgtggtcgccgtacgtccgttcgttcgggttacgacgactactacgtaacgaaccgtttttttttttttaacacgtacgtaccggtacccggtcccgggcccccggtaccggaccgggtaccggtaccggggaacggggggtaacggggggtaccgggtacggggtacgggtttccggggtttaccgttaaccggttaaggttttaaacggtttaaacggtaaaaccggtaaaggtaacggttacgggtaaccgttaaaccgttaaactttaaacgttttaaacgttttaacgtttacgttaccggttaacccggttacccgggttaaccggggtaacccgggggtttaccccgggtttaccccgttacccccgttaccccgttaacccgtaaccggtaacccggtaacccttaaccccgttaaacccgtaaacctaaaccttaactttaccgtttacgttaacctttaccttaccgtaacctacgtacgtaaccgtaactaacgtaccggtaaggtaaccggtaaccggtaaccggaacccgtaaccccggtacccgttaacccgttaaccgtttaacgtttacgttacggtacggtaccgtaccgtaacgtacgttaaccgtaccgtacgttaccttacgttaaggttaccgggtaccggggtaaccgggtaaccggg

SEQ ID NO: 154415 - DNA, 778 bp, Homo sapiens
  misc_feature: GYAE6OF01CNY1G.10.38.D05.1.454.CMB.1.raw
  modified_base (408)..(408): a, c, t, g, unknown or other
  misc_feature (408)..(408): n is a, c, g, or t
  modified_base (441)..(441): a, c, t, g, unknown or other
  misc_feature (441)..(441): n is a, c, g, or t
  modified_base (746)..(746): a, c, t, g, unknown or other
  misc_feature (746)..(746): n is a, c, g, or t
tcagcatagtagtgcacgaccggtgctcgatttagtatctgataggttggggtttggggggagaggagcccagcactgggattccgaggtgtttccattcggtgatcagcactgaacacagaggactcaccagtggtagtttggctggagtcgttgggttttccttgttcgcttaatttacgaaaaggtgtacaacgtggtgtaggttacaacgtgggtaggagacgtgggaggacggcgtaggactcgacggtccgggtcgggggtcctagaacgtcctcgtcgtagcgacacgtccgtcggttgggtacacggacaactacgtaaacgtaactactacgtacggtaccggaccggtcccggacccgacggtcgaccggacggggaaggggtacgggtcggtagggnggttcggtacgtagtaagttaagaacgtaaagnggtaacgcgaaactaactaacttaatttacgttacgttacgtaccggttaccgtaccgggtaacggggtaccgtccccgttaccctaccgttcgacggtaacaccgtaccctacctaaaccaacgtaactacgtttccgtaactacgttaccaccgtaactacgtacgtaaccgaacttacgaacgtaggaaccggtaacggacccgtaaacgaccctaccgtaacttaccttaaggtttgccggtaccgaaccgacgtaaccgtcggtaacccttaaccgtaccctacgttaacgttacccggnggggtaacccgggaggttaacccggacccggg

SEQ ID NO: 154416 - DNA, 754 bp, Homo sapiens
  misc_feature: GYAE6OF01AVO3Y.10.38.D05.1.454.CMB.1.raw
  modified_base (205)..(205): a, c, t, g, unknown or other
  misc_feature (205)..(205): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacgagggtcctgggcccagtctgccctgactcagccctccctccgcggtccgggtctccgtggacngtcagtcaccatcctcctgcacgtggaaccagcagttgacttttgtcgactttaataacgtattcgtcttccgtggtaccagaccacccacccgaggaccaaaccgaccccccaaactttccttttaggtttttcgaggttacgaggttaaccgcccggtaccctacgacgggtacgtcccgtagtacgttaccgggttctacgtcgtccctaccgtaagtccgtacggaccaaccgaccgtccctacccgtcgtaccccgttcgtaccggtacgggtccctaccggtacgggtccgtagggtaacggtacgttgggacggtcttacgttaacgtttacctacgtgaccgtacggccgtactagttaccgtacgaccggtaccccgtaagggttcggggttggttacgggcggggttaacggtaccggttaagggtcccgtacggtcggtaccgggtacgcccggtacccgtacgggtcccttaccccgggtccccgttacggttacccgtaccgttcccgttaccccgttcccccctaccctttcccg

SEQ ID NO: 154417 - DNA, 729 bp, Homo sapiens
  misc_feature: GYAE6OF01D2CHS.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggtttttcctttgttgcttatttacaaaaaggtgtccactgtgaggttcaacgtgggtggagacgtggagggaggctggaactccgagccggtgggggtccctggacgaccttcctccgtgtcgcacgtccttcgtggttacagcatcaacgtaacgactacatcgaccgtcgggccccgccgaggccgtaccggaggggaacgggcgtagggacggtcgggtctacgtaagttaagttagaaacgagtacgtaggactaacgtaatagtttaatttacttctacgtaccgtaccggtacggaaccggttcccgttaccacccgttcgaccgaacgaactaccctaaccttaacccgaaacaactattccgttagttacttccttacactactacgtaccaacgtaactcggtagaacgtacgtaccggaccgtaaccgtacccggtaccttaacgtttaacgttacgttccggcgtaacccggtacccgtaaatacggtaaccgtaaccgttacccgtaaccgtttacgttaaaccggtttccggggaccggggaaccccggtaggggtaacccccg

SEQ ID NO: 154418 - DNA, 779 bp, Homo sapiens
  misc_feature: GYAE6OF01B1DOG.10.38.D05.1.454.CMB.1.raw
  modified_base (140)..(140): a, c, t, g, unknown or other
  misc_feature (140)..(140): n is a, c, g, or t
  modified_base (202)..(202): a, c, t, g, unknown or other
  misc_feature (202)..(202): n is a, c, g, or t
  modified_base (414)..(414): a, c, t, g, unknown or other
  misc_feature (414)..(414): n is a, c, g, or t
tcagcatagtagtgcacgaccggtgctcgatttagtatctgatagttgggtttggggggggtctcaggaggcagcgctctcaggacgtcaccaccatgcctgggctctgctcctcctcaccctcctcactcagggcacgngggtcctgggcccagtctgccctgactcagccctccctccggcgtccgggtctccgtggacngtcagtccaccatctcctgcactggaaccagctagtgtacttttgtcgtctttaatacgttatcgtcctccggttacggtaccacgaccgaacccacccgaacggaccaaaccccggaccccccttaaaccgtttccgttttaggttttttacggacggttaccaacggttaacggtcccgtacccgtacgacgggtaccgtcccgtagttnttcccggtttctcgtacgtccttacgtaacgtccgtacgacctaacccgtaccggtcccttccgtaccgtacccgttctccggtcgggtacctaccggtggtccgtgggaacgtgtagggacgtacgttcgtaacgtttaccgtacgtcgacgtacgtccggtactaacgttaccttaccggaacccgtaccccggttaacgggttggggtttcggttcggggtacccggacggggttacggttaacgggtccggtaccggttccggggttacggaccgtacggtaccccggtacgggtcccgtccccggttccccggtcgtccccttacggtcccggttcccccgttccccgtccttacccccg

SEQ ID NO: 154419 - DNA, 663 bp, Homo sapiens
  misc_feature: GYAE6OF01D6KGH.10.38.D05.1.454.CMB.1.raw
  modified_base (225)..(225): a, c, t, g, unknown or other
  misc_feature (225)..(225): n is a, c, g, or t
  modified_base (328)..(328): a, c, t, g, unknown or other
  misc_feature (328)..(328): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctctcactcagggcacagggtcctgggcccagtctgccctgactcagcctccctcgcgtccgggtctcctggacagtcagtcaccatcctctgcactggaaccngcagtgactttgttgcttataactatgtctcgtggtaccagcaccaccaggacaaacgccccctaaactcctttgttttgacggtcaggtaacgcggccctanagacgtcctgactcggttctctcgacctccaagttcgtacggccaaccgtaccggccttccccgtggtaaccccgttctacgtcgggtacttccgaacggtccgtaggaggattggacggcttaggtactttaccgtacgttgaactcggccgtacgtacttacgtttccgaaccggacccccgtaaggtaggggtttcggtttcgggacgggtaccgggacgttaaaggccggtacccgtccgggtcgggtaccgaccggtacccggaacggtccgaccggtccccccgttgggtccctaaccttccgtacccgtttcccccgccttacccccg

SEQ ID NO: 154420 - DNA, 696 bp, Homo sapiens
  misc_feature: GYAE6OF01CBW8P.10.38.D05.1.454.CMB.1.raw
  modified_base (293)..(293): a, c, t, g, unknown or other
  misc_feature (293)..(293): n is a, c, g, or t
  modified_base (346)..(346): a, c, t, g, unknown or other
  misc_feature (346)..(346): n is a, c, g, or t
  modified_base (693)..(693): a, c, t, g, unknown or other
  misc_feature (693)..(693): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgcttataactatgtcctccgtgtaccagccaccaccaggaccaaacgcccccaaacttcctttgttttgaggtcagtaacgccgccctgaggctccngtactcggttctctcgcctcagtctggaccacgccgccctccgcgtccgttcncgtcggcctcgcggcgtaggagtagtggacgtctacgtactttaaccgtctacgtcgacgccgtactagttaccgttaccgaacccggaccccgtaaggtacgggggtttacgggttacggggacgggtaacggggtaaccgttaacggggtccggtaaccccgggtttcggtccgggtaccgacgaacccggtaaccggtccgtaccccggtccccgttaccggtccctacccgttcccgtttccccgttacccccgtccccgttacccctacccgttaacctacgttaccgtacgtcggttcggaccgggtccggcgtaccgggacgtacggcctaggactacgngac

SEQ ID NO: 154421 - DNA, 811 bp, Homo sapiens
  misc_feature: GYAE6OF01EVTBE.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcgttgggtttttccttgttgtcttatttacaaaaggtcgtccactgtgtaggttcaacgtgggtaggagacgtgggagggaggcgtggactccgacggtccggttcggggggtccctgacgtaccttcctccgtgtgcgacgtccttcggtgggttcagtcgactaccgtaagtaaccgtactacgtacgtcggacccggtccgggccccgaccggacgggtaccgtaccgggaagggggtacggggtcggtcgggtacgggtttcgggttaccgttacggttaagttttaacgttaacggaaaacgtacggtaacgtaccggtaacctaaacgttaacttagttttaactttacgttccgtacggttacccggtaccgggttacggggtaacccggggttccccgttacccgtaccccgttaccgtaacccggaagtaaccgttaacctaacccgttaaacccaaacgtaacttactttaccggtttacttaacctttcctaacgtaccttacgtacgaacctaactaagtccgtaggacgtaccgtaccgaaccgaccgtacccgtaccttacgttagttcgttcggacgtaccgtacaacgttataccgtactaccggtacttaccgtaggttaccgggcgggtaaccgcgggtaccccg

SEQ ID NO: 154422 - DNA, 675 bp, Homo sapiens
  misc_feature: GYAE6OF01CEQH4.10.38.D05.1.454.CMB.1.raw
  modified_base (341)..(341): a, c, t, g, unknown or other
  misc_feature (341)..(341): n is a, c, g, or t
  modified_base (370)..(370): a, c, t, g, unknown or other
  misc_feature (370)..(370): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (622)..(622): a, c, t, g, unknown or other
  misc_feature (622)..(622): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggttttccttgttgctatttcaaaaggtgtccatgtgaggttcaacgtggtggagacgtgggaggaggcgtggactccgagccgtcgggggtcctgagactctcctgtcgcacgcctcgtggttcagccatctaagtaacgaactacgatcgaccgcgggaccccgccgacggccgtaccggagggaggggngtggaggtggtctagtagttagtagaaanagtagtggactaacgtaacgatttattacttacgtcgaccgttccggaggtaccgggtcccggtcccnccgttaccncgaacgtacgtaccctaacttacccgaaactaacgtacttaccgtttacgttacttacctttaccgaacctaagttccgaacctaagtaacctcgttagggaaccgtaacgggtaccgaaaccggtacctacccggaacttaaccgttacttagttcgtacgacggtaccgtaangttacgacctacggtactaacgtacgttcgggaacgggccgtacgggacccgg

SEQ ID NO: 154423 - DNA, 690 bp, Homo sapiens
  misc_feature: GYAE6OF01EIRHY.10.38.D05.1.454.CMB.1.raw
  modified_base (279)..(279): a, c, t, g, unknown or other
  misc_feature (279)..(279): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggttcctgggccccaggtctgcccttgactcacgccctccctccgcgtccgggtctctggacagtcagtcacctatcctccgtgccactcggaaccagcagtcgtactttgttgcttatactatgtctctgtaccngccaccaccaggacaaaccgcccccctaattccgtttaggttttgacggtctaagtacgtccggaccctgacgtacgtccctagtacgttccggttctccgtcgtacccctacgtacgttcgtacggcctaaacgcccggtcccttacccgtcgacccgttcgtcgtacgggtccgtaccgtacggtcgtaggacgtagtgacggtactagtactttaccgtcgttcgacgagccgtactacttacgtaccgaccggaccgtaacggtgggttcggtacgggtacgggaacgggtacggtaacgggtccggtaccgggttccggtggtaccgaccggtacccggaaacggtcccgtacccgtccccggtacgttccgtaaccgttccgttcccgttccccgtccctccccg

SEQ ID NO: 154424 - DNA, 719 bp, Homo sapiens
  misc_feature: GYAE6OF01AM14C.10.38.D05.1.454.CMB.1.raw
  modified_base (228)..(228): a, c, t, g, unknown or other
  misc_feature (228)..(228): n is a, c, g, or t
  modified_base (475)..(475): a, c, t, g, unknown or other
  misc_feature (475)..(475): n is a, c, g, or t
  modified_base (623)..(623): a, c, t, g, unknown or other
  misc_feature (623)..(623): n is a, c, g, or t
  modified_base (658)..(658): a, c, t, g, unknown or other
  misc_feature (658)..(658): n is a, c, g, or t
tcagcatagtagtgcacgaccggtgctcgatttagtatctgatagttgggtttggggggggtctcaggaggcagcgctctcaggacgtcaccaccatggctggctctgctcctcctcaccctctcactcagggcacgagggtcctcggggaccctagtctcggccctagacgtccacgtccctacccgtccgcgtccgggtctcgtggacacgtcacgtccaaccgtnttccgtccgtgacctacgtacgggaaccagccgtagtacgttacgttttgtcgtaacttaacgtaacttagtcgtccttaccgtacggtaacccacgtaccgaacccaccgtaggaacccaaaacccgtaccccctttaaacgtttcgtttaggtttagacgtaccgaagtaacggcccgtccttaagacgtacgtccgtagtacgttccggtactcgtactaccgtaacctgtacgcgaaccaacnccggtcccttcgtacgtaccgtcgtacggtacgacctaccgtaggtaagcgggtaagtacgtaggacggtttaccagtttaaccgtaacgtcgaccgagttaccgaatcctaagttaccgacgacgtcgaaggtcgggttgtaccggnggtaacggtaactggaccggtcgtacgtcggaccncgaacggcttccgaccggttcccgtagacccttcgtacccgttcccaccccgttcgtaccg

SEQ ID NO: 154425 - DNA, 780 bp, Homo sapiens
  misc_feature: GYAE6OF01AE9YP.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcgttgggtttttccttgttgcttaatttacaaaaaggtcgtccacgtgtaggtaggttacaacgtggtggagacgtgggaggaggctggactcccgaggccggtcgggggtccctgacgacctcctcctgtgcacgtcctcgttggtacagcaactacgacgtaaccgacctaacacgtacggacccgtccgggcccccgaccggacggccgtaccggaagggggtaacggggtcgtagggtaggttcgggtctacgttaaggtttaagtaacgaaacgagtacgtaggacctaacgttaactaatttaagtttacttacgtacgtaccgttccgggtaacgggtaccgggttcccggttacccacccgttcctacccgacgtaacgtaaccttaacccttaacccaaaacctaccgttactttaccgtttacgttacttacccttacctaacgtaccgtacgaaccctaacttaacgttccgtaggtaacggtaccggtaccgaaaccgtaacccgtaccggtaacccttaaccgtttaacttacggttcgtacgaccgccgtaactagtaccgtaccgttactacccgtaacctacgggttaccggtaccggggaccgtacgggggcccc

SEQ ID NO: 154426 - DNA, 748 bp, Homo sapiens
  misc_feature: GYAE6OF01EL171.10.38.D05.1.454.CMB.1.raw
  modified_base (220)..(220): a, c, t, g, unknown or other
  misc_feature (220)..(220): n is a, c, g, or t
tcagcatagtagtgcacgaccggtgctcgatttagtatctgatagttgggtttgggggggtctcaggaggcagcgctctcaggacgtcaccaccatggcctggctctgctcctcctcaccctctcactcagggcacgagggtcctgggcccagtctcgccctgactcacgccctcccgtccgcgtccggtctccgtggcagtcagtcacctatctccgtnccactacggaaccagctagtcgtactttgtcgtacttaataactattcgtcctccgtacggtacccacgaccaacccacccgaacggaccaaacccgtacccccctaaacgtttccgttttaggttttacggacggttaccgtaaggtaaccggccggtaccctacggacggtaccgttcccgtgtacgtttcggttcctcgtcgcctacgacgttcgcgaccaccgtcccggtccctcccgtcgtcccgtcgttcggtccgtaccgtcgacggtcctagggaacgtggtcgacggtcttagtactttaccgtcgtcgaccgtagaccgtataacttcgtacccggtaccgtaacccgtaacgggtgggtttacggttccgggacggggtacggtaccggttacggtacgggttacccgtcggtacgggtccgacccgggtaccgtaaccggtcccgtacccccgggtcccccgtacgggttaccctacccgtttcccggttcccccttcccccgtcccgttaccccg

SEQ ID NO: 154427 - DNA, 805 bp, Homo sapiens
  misc_feature: GYAE6OF01BPXNT.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggtagttttggctgagtcttgggttttccttgttgcttatttacgaaaaggtcgtccacgtgtgtaggttcaacgtgggtggagacgtgggaggaggcgtggactccgacggtccggttcgggggggtccctggaacgtccgttccgtccgtggtcgccgacgtcccgttcggtcgggttacacggacctagttaccgaacggttaaaccgacgttaaccgtacgttacggtacccggtacggggacccgaaccggcccggacgggtacccgttaccggggaaagggggaacgggggtccggttaggggtaacgggttcgggttacccgtagttaggtttaacgtaacggaaacgtaggtacgtacggactaactaactaagtttactttacgttcgtacggtaccgttccggtagggtaaccgggttcccgttaccctacccgtctacgacgtacgtaaccctaccttaaccaaactactcttacgttcgtaacttccgttacactacgtacgaactaactaacgttacgacggtaacgtacggttacccggaaccgtacccgtacccggtaacccttaaccgtttagttaccgttcggcggtacgacctaacgtacgtacccgtaacgtaccgtacttacggtaacccgttcggggtaaccgggaacccggg

SEQ ID NO: 154428 - DNA, 629 bp, Homo sapiens
  misc_feature: GYAE6OF01B8SJ7.10.38.D05.1.454.CMB.1.raw
  modified_base (422)..(422): a, c, t, g, unknown or other
  misc_feature (422)..(422): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (620)..(620): a, c, t, g, unknown or other
  misc_feature (620)..(620): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcacatggagttttgctgagcgttgggttttccttgttgcttatttacaaaaggtgtccactgtgtaggttacaactgggtggagacgtgggaggaggctggactccgacgtccggtggggggtccctggacgtacctcctcctggtgcgagccctggttggttcagcatccaagtaacgactacgaactcggacccgtcgggccccgccgaggcccgtccggaaggggaacggggcgtgggaaggtgggtctcgtaggttattaggaaacgtagagtacggactaactactaagttnttacttcgtacgaccgtcggtacggaacggttcccggtctaccccgtctaccgagtacgacctactacccaanaacgtnttnttacgtcttactcactactgacaactaatccagagtacgtaccgagaccaccggacctacttatttagcgttagcacgactactacgaaccttcgacttacgaatttcggccgggngtaaccggg

SEQ ID NO: 154429 - DNA, 745 bp, Homo sapiens
  misc_feature: GYAE6OF01AS4FS.10.38.D05.1.454.CMB.1.raw
  modified_base (180)..(180): a, c, t, g, unknown or other
  misc_feature (180)..(180): n is a, c, g, or t
  modified_base (740)..(740): a, c, t, g, unknown or other
  misc_feature (740)..(740): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctcgcgtccgggtctcctggacagtcagtcaccatctcctgcactggaaccngcagtgtactttgtgcttataactatgtctcctggtaccagcaccaccgaggaccaaaccgcccctaaactcctttgttttgagtcaagtaacgccggtaccctgaggtacgtccctgtacttcggttcctcgtcgtcccctaccgaagtccgtcggaccaccgaccggcccttcccgtggtacccgttcgtccgtcgggtcctccggaggtccgttaggaggtacgtacgggtacggtcttaggtaaactttaccggtaactcggtaccgacgtccgtaactacgttacgttaccgaacccggtaaccccgtaacggtacggggtttacgggtttacggggaccgggtaaccgggtaaccggttaacgggtacccggtacccggttacccggttcgggtaccgaccggacccggtaaccggtccgtacccggtccccgtaccggttacctacccgttccgttcccgttccccgcccttcccgtacccgtacgtaccgtacgtccggtacgtggtaccgggccgggtacgtacggaccgtaacgggtcctaggactaggngtacg

SEQ ID NO: 154430 - DNA, 712 bp, Homo sapiens
  misc_feature: GYAE6OF01CDQF1.10.38.D05.1.454.CMB.1.raw
  modified_base (300)..(300): a, c, t, g, unknown or other
  misc_feature (300)..(300): n is a, c, g, or t
  modified_base (700)..(700): a, c, t, g, unknown or other
  misc_feature (700)..(700): n is a, c, g, or t
  modified_base (704)..(705): a, c, t, g, unknown or other
  misc_feature (704)..(705): n is a, c, g, or t
  modified_base (710)..(710): a, c, t, g, unknown or other
  misc_feature (710)..(710): n is a, c, g, or t
  modified_base (712)..(712): a, c, t, g, unknown or other
  misc_feature (712)..(712): n is a, c, g, or t
tcagcatagtagtgcacgaccggtgctcgatttagtatctgatagttgggtccctgagactctcctgtgcagcctctgggttcagcatcagtaacgactacatgacctcgggcccgccaggctccgaggggaaggggctggagtgggtctcagttattgaaacagatggcaactacattattattctgactccggtggaacggggccggttcaccctctccagagacacttaccaacaacattcttgtattcctcacatgcacaatctgagacgtcgacgacgacggccacctattatgngcgcacatgactcgctctaattcgacggggccagggcgacccgaggtccacccgtcctcccccagtcccctacccgaaccggaacggccccgtacgttcccggtacccctttcccccgcgggtccccgcccgtccgcccgttacccgacgggacgccctaccccgtaccggaacgaccgtacccgaacgaccggggtccccggtaccccgggttcggggtacccttcccggggtacccggttacgggttaccccggtaaaacgggttacccccttttaaccccgtttaaccccgttaaccttaaccgttacggtccggtaccgttacgggaacccgggggtccgggtccgggtaccggggtaacccggaaacgggcccggtaaccgtaaaggttcgacgngacnncgcgngn

SEQ ID NO: 154431 - DNA, 896 bp, Homo sapiens
  misc_feature: GYAE6OF01B7W2E.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagtttggctgagtcgttgggttttccttgttgacttatttacgaaaaggtgtccactgtgtaggttcaacgtggtggagacgtgggaggaggtctggactccgacggccggtcgggggtcctgagtcctcgtccgtgtacgcgtcgtccgttcgtacgggttcaggactactacgaaggtaaaccactaacgtacgtaccggaccgtcgggccccgtacgacggaccgtaccggaaggggtaacggggtcgtagggtacggttacgggtcgttacgtaagtttaacgtaacggaaacgtaggtacggttcggaactaacggtaactatttaacgtttacgttaccgtacggttaaccgtaccgggtaacgggtaaccgggttcccggtttaaccctacccgttaccgtaccggaaagtaccgttaaccctaacccttaaaccaaacgttaacctagttttaccttacgtttaacctaccgttttacccaaactttcggaaacctacgtaaaaaccgtcgttacgtaacggaacggtttaaacccggaccccgggtaaaaccgtacccgtaaaccccgggttaccctaaaaccgttttttacgttaaacgggtttcccgaaagggcccggttaaccccgtaaaaggttacggtttaacccggtaaaccgtttaaccccccggttagttaaaccccgtttaacgggttttaccccgggggaaccgggggttaaacccgggaaacccggggtttaaccccccggg

SEQ ID NO: 154432 - DNA, 711 bp, Homo sapiens
  misc_feature: GYAE6OF01DGNQQ.10.38.D05.1.454.CMB.1.raw
  modified_base (177)..(177): a, c, t, g, unknown or other
  misc_feature (177)..(177): n is a, c, g, or t
  modified_base (448)..(448): a, c, t, g, unknown or other
  misc_feature (448)..(448): n is a, c, g, or t
  modified_base (496)..(496): a, c, t, g, unknown or other
  misc_feature (496)..(496): n is a, c, g, or t
  modified_base (525)..(525): a, c, t, g, unknown or other
  misc_feature (525)..(525): n is a, c, g, or t
  modified_base (538)..(538): a, c, t, g, unknown or other
  misc_feature (538)..(538): n is a, c, g, or t
  modified_base (547)..(547): a, c, t, g, unknown or other
  misc_feature (547)..(547): n is a, c, g, or t
  modified_base (561)..(561): a, c, t, g, unknown or other
  misc_feature (561)..(561): n is a, c, g, or t
  modified_base (572)..(572): a, c, t, g, unknown or other
  misc_feature (572)..(572): n is a, c, g, or t
  modified_base (630)..(630): a, c, t, g, unknown or other
  misc_feature (630)..(630): n is a, c, g, or t
  modified_base (640)..(640): a, c, t, g, unknown or other
  misc_feature (640)..(640): n is a, c, g, or t
tcagcatagtagtgcacgaccggtgctcgatttagtatctgataggttggggtttggggggggtctcaggaggcagcgctctcaggacgtccaccaccatcggcctgggctctgctccctcctcaccctcctcactcagggcacgacgggtcctgggcccagtctcgccctgactcncgcctccctccggcgtccgggtctccgtacgggactacgtcacgtaccaaccctacttcctcctcgacctaacgtaccggaacccgataccgagttacggttacttttggtacctattaacttaactagtccgttcctccggtaaggtacccactacccaaccgaacccgtaggaaccaaacccgtcccccctaattttccgttttaggttaggacgtacgtaacggtaccgccgtcctacggaggtcctacccgtgtaccgttccggttnaccggttccaccgtacgtacgtcgacggacctaaccggcccgtacccncgttcgaccgttgtcggccgtcgaaccgngtacgtagaacgngtggacgtntacgttaacttcgngaacgtgaccntaactagttccacggaaccgccgtaaggtgggttcgggacgggtcaacgggcggtaanccgggtaccngtcggtaccgaacggaccgtcggtcgtcccccgtacgtccgtaacctgttccccgacctcccgtactaccc

SEQ ID NO: 154433 - DNA, 644 bp, Homo sapiens
  misc_feature: GYAE6OF01AUZ0H.10.38.D05.1.454.CMB.1.raw
tcagcatagtagtgcacgaccggtgctcgatttagtatctgatagttggggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctccgtggtaccagccaccacccaggccaaacgcccccaaattccttgttttgaggtcagtaagccgcctgaggacgtccctgactcggttctctgcctcaagtctgcacgacggcctccgtgaccgtctcgtcgggcctccgaggctggaggatggacggtctgtactttacgacgtgaccgagcgactaagttctacgacggacccctaagtacgggttgttcgggcgggtacggtaacgtaacgggtcgtacccgtccgtcggtaccgacgacccgaacggtccgtaccgtcccccgtcggtaccctaccgttccgttccggtttaccccccgcccgttacccctaccgtaccgttaaccgtacgtccgtccgttaggacggtcccgggtacgtacgggtacccgtaaacgggtccaacgtacgtcgctcg

SEQ ID NO: 154434 - DNA, 662 bp, Homo sapiens
  misc_feature: GYAE6OF01CS0S6.10.38.D05.1.454.CMB.1.raw
  modified_base (272)..(272): a, c, t, g, unknown or other
  misc_feature (272)..(272): n is a, c, g, or t
  modified_base (385)..(385): a, c, t, g, unknown or other
  misc_feature (385)..(385): n is a, c, g, or t
tcagcatagtagtgcacgaccggtgctcgatttagtatctgataggttgggttgggggggagaggagcccagcactgggattccgaggtgtttccattcggtgatcagcactgaacacagaggactcaccagtggtagttttggctgagtcttgggttttccttgttgtctatttacaaaagtgtccactgtgtaggttcaacgtggtggagacgtggaggaggctggactccgacggccggtgggggtccctgacgacttctcctgtgacncgtctcgttcggtcagctatcaagtaacgacacagtcgaccgtcggcccgcgacggcgtacggaggggaacggtcgtgggtacggtcggtctcgtagttagtaaggaacagtntacggactacgtactattacgttatctacgtcgtacggtacggacggttcccgtacctacctcgtacgacgtaactctaactaccaactaactcttcttagtctaccttacacgttatacgactacgtaatccgagtacggtacgtacccggaccgtaaccgtaccggtacctttaacctaaggtttacgtcggttaccacgggtaaacctcgttacgtacgtaccctactaccgttacgtaccgtttacgggacccgggacggtcggtaaccccgg

SEQ ID NO: 154435 - DNA, 690 bp, Homo sapiens
  misc_feature: GYAE6OF01CT7D9.10.38.D05.1.454.CMB.1.raw
  modified_base (298)..(298): a, c, t, g, unknown or other
  misc_feature (298)..(298): n is a, c, g, or t
  modified_base (658)..(658): a, c, t, g, unknown or other
  misc_feature (658)..(658): n is a, c, g, or t
  modified_base (669)..(669): a, c, t, g, unknown or other
  misc_feature (669)..(669): n is a, c, g, or t
  modified_base (672)..(673): a, c, t, g, unknown or other
  misc_feature (672)..(673): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (687)..(688): a, c, t, g, unknown or other
  misc_feature (687)..(688): n is a, c, g, or t
  modified_base (690)..(690): a, c, t, g, unknown or other
  misc_feature (690)..(690): n is a, c, g, or t
tcagcatagtagtgcacgaccggtgctcgatttagtatctgataggttggggtttggggctttgcctgggtctcctggacagtcagtcaccatctcctgcactggaaccagcagtgactttgtgcttaatactatgtctcgtggtacagcaccaccgaggacaacgcccaattcttgtttgagtcagtagcgctgagcgtcctgacgttcgtctctcgtcctacgagttcgcggacaacgccggtcccttccgtagtaccgttctcggtacgggtcctacggaaggtcgtaggaaggntcggaacggttctaagtaacttacgtacgtcgacgacggcctattacgttacgttaccgaaccggtaacccgtaagggtggggtttcggttccggggacgggtaacggtaacgtaacggtccggtaacccggtcgtacgggtaaccgacgtacccggtaagtcccgttacccgtcccccggtttagacccttaccgttcccggtttacccggttccccgtaccccttaccctaaccgttaaccgttaccgttaacgttccggtaccggtacgggtaacggttaccgggacggttaaccggtaacgggaaccggtacgaccgtaaagtccgacgtcgatggtcgtcgacgtacgtagacgngcgacgcgagncanncncngctcanangnngn

SEQ ID NO: 154436 - DNA, 778 bp, Homo sapiens
  misc_feature: GYAE6OF01ECMZW.10.38.D05.1.454.CMB.1.raw
  modified_base (642)..(642): a, c, t, g, unknown or other
  misc_feature (642)..(642): n is a, c, g, or t
tcagcatagtagtgcacgaccggtgctcgatttagtatctgatagttggggtttggggggagaggagcccagcactgggattccgaggttgtttccattcggtgatcagcactgaacacagaggactcaccagtggtagtttgctgagtcgttgggttttccttgttgcttaagttacgaaaggtgtccacgtgtgtaggttcaacgtgggtggagtacggtgggaggtggcgtaggactccgacgggtccgggtcggggggtccctaggaccgttaccttccgtcgtaggtcgaccgtacggtccgttcggttgggttaccacggtcctaagttaccgtaaacggtaaaccgaacctacgtaccggtaccggtacccgggtcccgggaccccgacggtacgggcccgtaacgggggaaacggggtcgggcgtacggggtacgggttggttaccctagttaaggtttagaaacggaacgtggtaggtacgacctaagttaactaattacgtttactcgtacgttaaccggtaccgggttaaggacccggggttcccttaccctacccgttcacgtaacgtacctaaccctaccctaaactaaccgtaacttactttacgttacgtactttaccgactaactntacccgtaatacctatcggtacgacgtaccgggaacaccggaaccgtaccgtacctagtttagtcgttaggactccggagtatactacgacgtacctgttaccgtaggtaccgggtacgggccgaacggtacccgg

SEQ ID NO: 154437 - DNA, 824 bp, Homo sapiens
  misc_feature: GYAE6OF01EFLEU.10.38.D05.1.454.CMB.1.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
tcagcatagtagtgcacgaccggtgctcgatttagtatctgatagttgggggtttgggggggggtctcaggaggcagcgctcgtcgggacgtctccaccatggcctgggctctgctattcctcaccctcctcactcagggcacgagggtcctgggacccagtctgccctgactcagcctgactccgtgtcgtgggtctccgtggacagtcatcactatctcctgactactggccacaggcagtcaacngtaggtntacttatacgttatcgtcctccgtaggtacacgaccaacccgaccgaacggaaccaaaacccgtacccctaacgtttcggtttttaggttttacggacggtaccgaacggtaacggtcccggtaccccgtagtaacgggtccggttaccctggtaaccgtttccgggtttacttccgtaccgtaccgttaccgtacggttaccgtacggggaacctaaaccccgggtccggtaccccttacccgttcccggtacccggttactcccgggtccgggtaccctacggggtacgtcggttaacgggtaacgtaggtacgggtacgtacggtttaactactacgtaccgaccgttagacctaccgtacgtaacgttaacgtaccgggtaacccgaacccggttaacgggtacgggtttcgggtacggggtaaccgggtaaccgggtaaacgggtacgggttaacccgggtcccggttaaacggttcgggtacccggaacggttaccccgggaaaccggttcccccgtccggttccccccgaagggtttcccttccgtaccccggttcccccgg

SEQ ID NO: 154438 - DNA, 817 bp, Homo sapiens
  misc_feature: GYAE6OF01BAH4M.10.38.D05.1.454.CMB.1.raw
  modified_base (200)..(200): a, c, t, g, unknown or other
  misc_feature (200)..(200): n is a, c, g, or t
  modified_base (244)..(244): a, c, t, g, unknown or other
  misc_feature (244)..(244): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctctggacngtcagtcacatctcctgcactgaaccagcaggtgtactttggtnacttaataactatcgtctccgtacggacctagccaacccaccgacggaccaaaaccgacccccctaaattccgttttgttttacggacggtactaaggtaacgccggtaccctcgaaggtccgttcctgtacgttccggttactccgtcgtccctacgaacggtccgtacggacctaaaccgcccgtcccttaccccgtcggtaccccgttctccggttaccggggccttaccgacggttccgtacgggtaacgggacgtagggtaccggtcgttaacggtttaacttaaccgttaccgttcgacgtaacgggtccctacgttactaaagtttaccccgggaaccggtaaccccgtaacgggttacggggttcgggttccggggacggggtaccggggttaccggttaaacgggtcccgggtaacccggtccggttaaccggggtaccgtaacccgggtaccccggtaaacccggggtcccttacccccggggtacccccgtttacccgggtacccttacccggttacccggtttcccccccttttaccccgtaaccccccggttaacccccg

SEQ ID NO: 154439 - DNA, 834 bp, Homo sapiens
  misc_feature: GYAE6OF01EXNV6.10.38.D05.1.454.CMB.1.raw
  modified_base (222)..(222): a, c, t, g, unknown or other
  misc_feature (222)..(222): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctctcacgtcagggcacgagggtcctgggcccagtctcgccctgactcacgtccctcccgtccggcggtccgggtctccgtggacagtcagtcacctntcctctgccacgtacggaacctagctagttcgtacttttgtcgtacttaataactatcgtccgtccgtacgtaccgacgaccaacccaaccgtacggaacccaaaccccgtaccccctaaactttccgttttaggttttacggtaggtaccgtaaggtaaccggtcccggtacccgtacgacggtaccgttcccgtaggtaccgttccgttacctcgtaccgtcctacggtaacgtccgtacgtacccgtaaccggtcccgtacccgttcccgtacggttacccgttccggtaccggttccggggtccctacgggtacgggtcgtacgggtacggaaggttcggtacggtacgttaggttaaccttacgtacgtcgaccgtaggtcctacgttacgttacccgtaaccggcccgggtaaaccacggggtttggggttaccggttacgggggacccggttaacgggtaacgttacgggttacccggtacccgggttcgggtaccgggttaccgacccggtacccgggtaccggtcccgttaccccgggccccggtttaccgttcccgaccccggtttacccgttccccggttacccccgtcccgttaaccccg

SEQ ID NO: 154440 - DNA, 826 bp, Homo sapiens
  misc_feature: GYAE6OF01A43R3.10.38.D05.1.454.CMB.1.raw
  modified_base (706)..(706): a, c, t, g, unknown or other
  misc_feature (706)..(706): n is a, c, g, or t
  modified_base (732)..(732): a, c, t, g, unknown or other
  misc_feature (732)..(732): n is a, c, g, or t
  modified_base (776)..(776): a, c, t, g, unknown or other
  misc_feature (776)..(776): n is a, c, g, or t
  modified_base (783)..(783): a, c, t, g, unknown or other
  misc_feature (783)..(783): n is a, c, g, or t
tcagcatagtagtgcacgaccggtgctcgatttagtatctgatagttgggtttgggggaggaggagcccagcactgggattccgaggtgtttcctagttcggtgatcagcactgaacacagaggactcaccagtggtaggttttggctgagtcgttgggttttccgttgttgtcttatttactaaaaggttcgtacctactggtgtaggttacctaacgttgggtacggaggtacgtaggggagggacggcgtagggcgtaccgacgggtccgggttacgggggttcccgtaggaccgtaccgttccgttcccgtggtacggcgtaccggtccgttccggttacgggtccgaacggtctaacgtacgtaacggtaaaccgtaaccgttaactacgttccggaccggccgggtcccccgccgtaccggtcccgtaacccgggaagggggtaacgggtcgtacggggtaggttcgggtacgttacggttaacgttagtaacgtaaaacgtacgaacggtacggactacctaagttactttagttaccttcgttaccggtacgttaccgggtaacggttaccggggtaccctttcccgaacccgttaccctaccggaaccgtaaccgttaaccttaacccggtaacccaaaactaaccttaccggtttacttacgtttaacctccgtaacctacgtacttcacgttaanaactggtaacaggtaccgtacgaacnccgtaaccgtctaactagttccgtagtaccgggactaccgggtntaacgtntaacccgtcgaaccttcgtaacgtggcggtaccgcggtacccg

SEQ ID NO: 154441 - DNA, 801 bp, Homo sapiens
  misc_feature: GYAE6OF01BONIO.10.38.D05.1.454.CMB.1.raw
  modified_base (683)..(683): a, c, t, g, unknown or other
  misc_feature (683)..(683): n is a, c, g, or t
tcagcatagtagtgcacgaccggtgctcgatttagtatctgatagttggggtttggggggggagaggagcccagcacgtgggattccgaggttgtttccatttcggtgatcagcactgaacacagaggactcaccatggtagttttggctggagcgttgggtttttccttgttgcttatttacaaaaggtcgtccactgtgtagttcaacgtgggtggagacgtgggagggaggcgtggactccgacggtcccgggttcgggggggttccctaggacgtaccttccgttccttggtcgccgacggtcccgttcggttcggggtttcacgcctaacgtaccgtaaacggttaaaccggtaacctaactaacgttccgggacccccggttccgggggccccccgaccggaccgggtcccggtaccggggaaggggggggaacgggggtccggttgggggtacgggttcgggttccttacggttaaggttttaagtaacgggtaaaacgaggtaagtccggtaactaaccttaataatttaatttacttcgtacgtaccgttccgggtacggggtaacccggggttcccgttaccctaccccgttcgtaccggaacgaaccgtaaccctaacccgttaaccccaaacgtaccttacgtttacgtttacgtactttcctacaacgtntaaccgactaactatcgtagacggtacgtacgaccgtacgccgtacctattattgttcggcgccgtactagtcgtacgtcaccgtctacgtacggtcgggacgggacgacgggtaccg

SEQ ID NO: 154442 - DNA, 707 bp, Homo sapiens
  misc_feature: GYAE6OF01BUW7G.10.38.D05.1.454.CMB.1.raw
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctctcactcagggcacacgggtcctgggcccagtctcgccctgactcacgtcctcccgtccgcgtcccgggtctccgtggacagtcagtcacctntcctcctgccacgtaggaaccagcctagttgtacttttggtntacttaataccttatntcctacgtcggtaccagccaaccgaccacggaccaaacccgtaccccctaaaacctttcgttttacggttttacgtacggtaccgtaaggtaaccggccggtaccctacggacggtaccgtcccgtacggtacgttccggttctccgtcggtaccctacgtaacgtccgtacggaccaaccgccgtcccgtccgtacgtccgtcgtccgtcggcctacgcggtcgttaggagtcgtgacggtcttggtaactttcgtacgtcgaacgtacgcgactacgttacgtacggaaccgtaccgtaacggtcggggtttcggttcgggacggtacggttaccgtacgggtctaccggtacggtcggtccgaacgtcccggaacggtcccgaccgtccccgtacggtacctccttccgtcccgtcccgtcccctaccg

SEQ ID NO: 154443 - DNA, 766 bp, Homo sapiens
  misc_feature: GYAE6OF01DW88B.10.38.D05.1.454.CMB.1.raw
  modified_base (232)..(232): a, c, t, g, unknown or other
  misc_feature (232)..(232): n is a, c, g, or t
  modified_base (391)..(391): a, c, t, g, unknown or other
  misc_feature (391)..(391): n is a, c, g, or t
  modified_base (756)..(756): a, c, t, g, unknown or other
  misc_feature (756)..(756): n is a, c, g, or t
  modified_base (761)..(761): a, c, t, g, unknown or other
  misc_feature (761)..(761): n is a, c, g, or t
tcagcatagtagtgcacgaccggtgctcgatttagtatctgatagttggggtttgggggctctgctcctcctcaccctcctcactcagggcacgagggtcctgggcccagtctcgccctgactcacgccctccctccggccgtccgggtctccgtaggacagtcagtccaccatcctcctgctacgtacggaaccaggctagttcgttattttggtctactttaactaactnttcgttacctccgttacggtaaccacgacccaacccgaaccgacggaaccctaaacccgtaccccctaacttttccgttttaggttttacggacgtacaacggttacggcccggtaccgtacgacgggtccttaccgtgtaccgttcgttctccgtacnccgtacagtcgacgaccaccgacccgtcctccgtacgtacctcgtcggtccggacctaccggaggtcgaggaacgtagtacggacgttctaagtaaccttcggacgtgacgtacgacgtatacgttacgtaccgacccggtaaccgtaggttacgggttcggtacgggccgggtaacggttaccggtacgggtccggtacccggtcggtacgacccgacgtaccgaccgtccgtaccccgccgttacgtacccttccgtcccgttcccgttacccctcccgtaccgtacccgtacttaccgtacgtacgggccgtagggtaccggcgggtaccgtacggacccgggtaacggcttaaaccgggtntacgngtacg

SEQ ID NO: 154444 - DNA, 740 bp, Homo sapiens
  misc_feature: GYAE6OF01A7EBO.10.38.D05.1.454.CMB.1.raw
  modified_base (200)..(200): a, c, t, g, unknown or other
  misc_feature (200)..(200): n is a, c, g, or t
  modified_base (531)..(531): a, c, t, g, unknown or other
  misc_feature (531)..(531): n is a, c, g, or t
tcagcatagtagtgcacgaccggtgctcgatttagtatctgatagttgggtttgggggggggtctcaggaggcagcgctctcaggacgtcaccaccatggcctgggctctgctattcctcaccctcctcactcagggcacagggtcctgggcccagtctgccctgactcagcctgcctccgtgtctgggtctcgtggacngtccatcaccatcctcctgacactcggaaccccactattactagtttacggtaataatgtaattattcgttcctccgtacggtaccacgccaacccaccgaacggaccaaacccgtaccccctaaaactttccgtttttacggttttaggacggttacaaggtaaccgccggtaccctaggacggtaccgtcccgtagtacgttcgttacctctccgacctacgtacgtacgtcggaccaaccgtcccgtccctacccgtacgacccgttctccggtacggccttaccggaggtccgtaggagtagtgacgtcgttagtacttacgtacgngacgcgtctactactttacgaccgaaccggtaccccgtagggtcgggtttaggttaccggggccgggtacgggttaacggtaacggtcccgggtacccgttacggttccggggtacccaaccgggtccccggtagggtccccgtaccccggtaccccggttccgttaccctacccggttcccgttaccccccgttccccgtaccccccg

SEQ ID NO: 154445 - DNA, 712 bp, Homo sapiens
  misc_feature: GYAE6OF01BYV6C.10.38.D05.1.454.CMB.1.raw
  modified_base (414)..(414): a, c, t, g, unknown or other
  misc_feature (414)..(414): n is a, c, g, or t
  modified_base (647)..(647): a, c, t, g, unknown or other
  misc_feature (647)..(647): n is a, c, g, or t
tcagcatagtagtgcacgaccggtgctcgatttagtatctgataggttgggtttgggggagaggagcccagcactgggattccgaggtgtttccattcggtcgatcagcactgaacacagagactcaccagtggtagttttggctgagtcgttgggttttccttgttcgacttatttacgaaaaggtgtccacgtgtgtaggttcacgtggtgagacgtgggaggacggctggactccgacggtccggtcgggggtcccagacgtacctccgtccgtgtcgcgtacgtcgttcgtggtcagctactacgtaacgtaaccgtactactacgtccgaccggtccggacccgacggacggtccgtacgggaagggaggtcggtaggacggtggtcctaggttagttagtacgaacgnggtagtacgacctaagtactaagtttacttacgttcgtacgtaccgtcgtacgggtaacccggtcccgttaaccgtacccttcgaccgtaacgtaccgtaccgtaaccttaacccgaaactaaccgttactttacttacgttaccttaccgttacaactatacgtactaactaactcgtacggacgaccgtaccgaacggacctaccgtacctacttattacgttcgaccggngaccggtactacgtacaccctacgtaccgttcgtaccgtacgggtccgacccgggtacgtacccg

SEQ ID NO: 154446 - DNA, 764 bp, Homo sapiens
  misc_feature: GYAE6OF01E3BU3.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccggtctcgtggacagtcagtcaccatctcctgcactggaaccngctagtgtacttttggtgactttaataaaccttatcgttaccttccgtaggtacccagcaacccacccaggaccaaacgacccccaaacttccgttttacgtttttgacggtcaaggtaacgccggccctacgaacgggtacttaccccgtagtaacgtacggtttctccgtcgtcccctacgtaaagtccgtcggaaccaacgaccggtccctcccgtacgtaccgttcgtcgtccgggccttaccggaggtcctaggaggaacgttagggacggtcttacgggtaaactttaccgtacgttcgaccgaccggtaacggacttaaacgttacttacccggaaacccgggtaacccccctaaagggtacggggttacgggttttaccgggcgggttaccggggtaaccgttaagggtcccgtaacccggtccgtaggggtacccgtacgaccccggtaaacggtccgtaccccggtacccccgttcgggtacctacccggttaccgttcccggtacccccgtcccgtttaaccccg

SEQ ID NO: 154447 - DNA, 732 bp, Homo sapiens
  misc_feature: GYAE6OF01DME8U.10.38.D05.1.454.CMB.1.raw
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagcatagtagtgcacgaccggtgctcgatttagtatctgatagttgggtttggggggggtctcaggaggcagcgctctcaggacgtcaccacatggcctgggctctgctcctcctcaccctcctcactcagggcacagggtcctgggcccagtctcgccctgactcacgccctccctccgccggtccgggtctccgtggacagtcagtccaccatcctcctgacacgtcggaaccagcaagtgttacgtttgttagtactttaactaacttattcgtccttccgtacggtaccaagccaaccaccgaacgaccaaacccgcccctaaacttcttttaggtttgacggtacaggtacgcgacctgacgtcncctgtacttcgtcncgtctacctacgtacgtcgacgaccaacgtccgtacctccgtcgtaccggttccgcgtcgggtcctccgaaggtccgtaggaacgtcgtaggacgttacgttacgttaactttaaccgtcgtagccgtacggtactacttaagtaccgtccgaaaccccggtaccgtaagggtttcggggttacggtaggggacccgggttagggttacggtaccgggttccgaacccgggttccggtacggaccgtacccggggacccgtaacggtccccgtacccccggtcccggtttaacccgttacgttccccgttaacccggttccccaacccccttccgttaacccccgg

SEQ ID NO: 154448 - DNA, 884 bp, Homo sapiens
  misc_feature: GYAE6OF01A8CP4.10.38.D05.1.454.CMB.1.raw
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacgacgggtcctcgggccccagtctcgcccctgactcagccctccctccggccggtccgggtctccgtggacacgtcgacgtccaacctacttccgtcccgtcgcaccgtacgggaaacccagtccgaagttgttaaccgttttgttacgtactttaactaaaccttgtcgttcctccgttacggtaccacggaccaacccaccgaacggacctaaacccgacccccttaaactttccttttggttttacgacggtactaacggtacgtccggcctagacgggtactcccgtagtacgttccggttactccgtacgcccgttacgacgttccgacgacccgtaaaccggtcccggtacccctttcccgggtacccgtacccggttccttacccgggtacggggtcccgtttaacccggcgggttaacggtagggttaaacggggctttaaccggggacgttaaccgttaacgttaaccgttaaccgttcgacggtcgtaccgaccggttaacaactttaaccggggtacctaccccgggtaaaccccggtttggggtaacccgggggttttgttaacccgggggacggggtacccggttaacggtttaaccggggtacggtaccccgttacgggggtaacgtaccggccccgggtacccgtacggtcccgtaccccgggtacccccgttcggttaacccctacgtttacccttaccccccggttacccctaccccggtttacccc

SEQ ID NO: 154449 - DNA, 599 bp, Homo sapiens
  misc_feature: GYAE6OF01BAV51.10.38.D05.1.454.CMB.1.raw
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
  modified_base (495)..(495): a, c, t, g, unknown or other
  misc_feature (495)..(495): n is a, c, g, or t
  modified_base (570)..(584): a, c, t, g, unknown or other
  misc_feature (570)..(584): n is a, c, g, or t
  modified_base (586)..(599): a, c, t, g, unknown or other
  misc_feature (586)..(599): n is a, c, g, or t
tcagcatagtagtgcacgaccggtgctcgatttagtatctgatagttgggggtttgggggctttgcctgggtctcctggacagtcagtcaccatctcctgcactggaaccagcagtgactttgttgcttataactatgtctcctggtaccagcaccacccaggcaaagcccccctaaactcctttgtttttgaggtcagtaagcggccctcaggagtccctgatcggttctctgcctcgagtctggacaacaccggtcctcccngaccgttcncgtgggctccgaggctgagctgacgctgtattactacnggtcagtcgactattatccgaccggtacccccaaagggtgggttccggttcgggggaccgggacgggtaacgtaacgggttaccggacccgtttcgggtacgggtaccgaccggtaaccccggtaaggtcccgtccccggtaccccccgttcggtaccgtacctttccctaccgtttacccccnccccgttaccctccctaacctacgtactcgtcgcgggtaccggccgggtcgtaggaccgtacggcacagtacagnnnnnnnnnnnnnnngnnnnnnnnnnnnnn

SEQ ID NO: 154450 - DNA, 760 bp, Homo sapiens
  misc_feature: GYAE6OF01ANN9Q.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcgttgggttttccttgttgacttatttacgaaaaggtgtaccactggtgtaggttcaacgtgggtaggagacgtgggaggaggcgtggactaccgacggccgggttcggggggttccctaggacgtaccttccttccgttggtcgtcgtacggtcccgttcggttacgggttccgagtactactacgaacgtaaaccgtacctacgtacgtcgtaccgtccgggcccgtccggacgtccgtacggaggggagggtcgtagggtggttcggtcgtacgttagttagtaaggaacgaggacgtacggactacgtactacttattacttcgtacggtaccgtacggtacgggtaaccgggtcccgttaccgttaccccgtaccgtacggtaacgtaccgttaacctccgttaaaacccaacgttaattaccgttttagtttaccgtacttaccctactagtactccgaactaacgtacgttagacgtacgtaacccggtaccaccggaaaccgttacccgtacgtaaccttttacgtacgtccggtacggtacgacctaagttcgtaacctccggtactactaccggttagccgggtacgggacggcggtacccg

SEQ ID NO: 154451 - DNA, 840 bp, Homo sapiens
  misc_feature: GYAE6OF01BWLSE.10.38.D05.1.454.CMB.1.raw
  modified_base (706)..(706): a, c, t, g, unknown or other
  misc_feature (706)..(706): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccagtggtagtttggctgagtcgttgggttttccttgttgtcttatttacaaaggtgtccactgtgtagttctaacgtggtggagacgtagggagggaggcgtaggactccgacggtccggtcgggggtcctaggtacgtactcgtccgtggtacgccgacggtcctacggttcgggttcaacgtactacgtacgaacgtaaccgaccgtaactacgtccggtacccgtccgggaccccgtccggtaccggtccgtaccgggaacgggggtacgggcggttacgggacggttcggttacgttaccgtaagttaacgttaacgaaacgtacgtagtacgactacgtaactaagttacgttatacgtacgtaccgttacggtacggtaccggtcccgttaccgtacccttaccgtacgaagtaccgtaaaccctacgttaaaccaaccgtaacttacgttaccgtttacgtacttaccttaacgaaccttgtaccgtaacctaacgttaagttcccgtaaggtaacgggttacccgtaaccgtaacccgaacccggacccgtttaccgtaaacccgttttntaaacccgggttggtaacccggtaacccggtaccttaaaccgttggaaccggtttaaacccccgacccccgtttaaagggtaccccgtttaaacgggtttcccggggtaaaccggggcccggttaaacccgggg

SEQ ID NO: 154452 - DNA, 750 bp, Homo sapiens
  misc_feature: GYAE6OF01EQP5Z.10.38.D05.1.454.CMB.1.raw
tcagcatagtagtgcacgaccggtgctcgatttagtatctgatagttgggtttggagggggtctcaggaggcagcgctctcaggacgtcaccaccatggcctgggctctgctcctcctcaccctcctcactcagggcacgagggtcctgggcccagtctcggccctgactcacgccctcccgtccgcgtccgggtctccgtggacagtcagtccaccatcctcctgcctacgtcggaaccagcctagttcgtacttttgttacgtactttaattaacttatcgttacctccgtacgggtacccagacccaacccgaacccgaggtaaccccaaaccgtacccccctaaacgtttccgttttcggttttacggacggttacgaacggttaccggcccggtaccctacggacggtccgttcccgtagtacgttccggttcctcgtaccgtccctacgtaacgtcgacgaccaacgcccgtccctccgtacgtacccgttcgttcggacgtccgccgaggtctaggaggttgcggtaggtacttagtaccgttacgtacgtacgctacgacgactataccgtaccggaacccgaccggtaagggttcgggttacggttcggggaaccgggtacgggtaaccgtagggtacccgtcccgggtacggttacggccccgtacggacccggtacggtccccgttcccgaccccccggttgacccttaccgttccccttcccggtacccctacccccg

SEQ ID NO: 154453 - DNA, 860 bp, Homo sapiens
  misc_feature: GYAE6OF01CHIKQ.10.38.D05.1.454.CMB.1.raw
  modified_base (618)..(618): a, c, t, g, unknown or other
  misc_feature (618)..(618): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcaccatggtagtttggctgagcttgggttttccttgttgtcttatttacaaaggtgtccactgtgaggttacaacgtggtggagacgtgggaggaggcgtaggacgtccgacggtccggtcggggggtcccctggaacgtaccttccgttccgtcggtacgccgtacggtccgttcggttcgggttacacgacctaactaccgaaacggtaaaccgaaccttaaccacgtaccggaacccggtccggggaccccgccgaacgggtccgtaccgggaagggggaacgggtcggtagggacggttcggtacgttacgtaaggttataaggaaacaggtacgtggacctaaacgttaactaagtttacttaacgtctacgtaaccgtcggtaacggaaccgggttccctaccacccttacgtaccgaacgtaacgaaccccttaaccttaacccctaaactaacttacgttaccgtttacttaacttcccttaanaccgttacgtcgaacctaaacgtttaacgtcggttaacgtaagggtaacccggttaccgaacccggtaacccgtaaccccgttacccttaaaccgtttaacggtttaggtttcccggtaacgggtacccgttaacgggaacctttaaggtaaccccggttaaacccgtaaaccgtttcctaaaccggtttaaccggttaccgggggttacccgggaaaccgggtaccgggggtaaccccccg

SEQ ID NO: 154454 - DNA, 711 bp, Homo sapiens
  misc_feature: GYAE6OF01BVVO2.10.38.D05.1.454.CMB.1.raw
  modified_base (696)..(696): a, c, t, g, unknown or other
  misc_feature (696)..(696): n is a, c, g, or t
tcagcatagtagtgcacgaccggtgctcgatttagtatctgatagttggggtttggggtctttgcctgggtctcctggacagtcagtcaccatctcctgcactggaaccagcagtgactttgtgcttataactatgtctcctggtaccagcaccaccaggcaaagcccccaaatccttgttttgaggtcagtaagcggcctcaggagtccctgatcggttctctgcctccaagtctaggcaacaccggccttccctgacccgtctctgggcctcgaggctgacggactgacggcctgacttactacgtgcagtcgacagtattccgaggtcccccaagtaggggttcgtttgggacggtcgggactaaacgggtcgaacccggttccgtggggttaccacgggccccaaagggtaccctcggtaccccccctcggggtaacctcccgtaccgtttccgttccccccggtcccctacccttacccccgtaacctttaaccgttaagttccgggacccttaggggaaccggtacccggggggtcccttttacgggggacccaaacggggccggtttacccaaagggttaaccgttggaacccaggttacgacgttctacggcaacttagggtccaagggttcccaaatttaccgggtccgaaacgtagtacgtacgtacgtacgccgtacgtacgtanacgtccgtacgtacg

SEQ ID NO: 154455 - DNA, 831 bp, Homo sapiens
  misc_feature: GYAE6OF01AKHZ9.10.38.D05.1.454.CMB.1.raw
tcagcatagtagtgcacgaccggtgctcgatttagtatctgatagttggggtttggggggagaggagcccagcactgggattccgaggtgtttccattcggtgatcagcactgaacacagaggactcaccatggagttttggctgagtcgttgggttttccttgttgcttatttacaaaaggttcgtccactgtgtagttacaacgtggtaggacgacgtggaggaggcgtggactccgacggtccggtcgggggtccctgacgtacctcctccgtgtcgccgacggtcccgttcggttcgggttacacgtactacgtaccgtaacgtaaccgtaaccgtaacacgtaccggtacccggttcccggggaccccgtaccggacggtacccggtaccggggaacggggggtaacggggtcggttacggggtacgggttccgggttaccgttacggttaaggtttaaaggtaacggtaaaacgtaggtacgtacggaacctaacgttaacttaatttacgtttactcgtacgtaccgtcgggtacggtaccgggtaccgttcctacccgtcgaccgagaactaccctaacctaacaaactacgttacttacgttcgtacctacgtaccatacgtacgaactaacgtacgtgacggtacggtaaccggtaccgtaaccggtaacctaaccccgggttacctaaactttacggtttcgtacgggtacccgaccggtaaccaccggttaagttaccccgtaacccgtaaccggtcgtttaaaccccgtacggggttaccccgggaccgggtaacggtaaacccggggtaccccccgg

SEQ ID NO: 154456 - DNA, 706 bp, Homo sapiens
  misc_feature: GYAE6OF01B8UDE.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggttttccttgttgctatttcaaaaggtgtccactgtgaggttcaacgtggtggagacgtgggaggaggcgtggactccgacgccggtcggggggtccctggacgtacctcctccgtggtcgcacgtccttcgttgggttcagcctatacgaacgtaaccgactacacgtcgaccgtcgggccccgaccgacggccgtaccggaagggggacgggcgtagggaggtcgggtctacgtagttagtaacgaaacgagtacgtacggactaactactatttaactttagttcctacgtaccgttccggtaacggtaccgggtacccgttaccctaccctccgaccgacgaccgtaaccctaccttaacccaaactactacttcgtttactactttaccctactaactatacgtaactaaccttagtccgtaggaaccggtacgtacgaccgtaccgaccgtaccttacgttagttacgttggaccgtacgtacgaatacgtaccgaccttacgacctttaacgtacggttaccgggacgggtccgaacgggtaccccg

SEQ ID NO: 154457 - DNA, 815 bp, Homo sapiens
  misc_feature: GYAE6OF01BPFO0.10.38.D05.1.454.CMB.1.raw
  modified_base (727)..(727): a, c, t, g, unknown or other
  misc_feature (727)..(727): n is a, c, g, or t
tcagcatagtagtgcacgaccggtgctcgatttagtatctgatagttgggtttgggggggagaggagccagcactgggattccgaggttgtttccattcggtgatcagcactgaacacagaggactcaccagtggtagttttggctgagtcgttgggttttccttggttgtcttatttacgtaaaaggtcgtcctacgtgtggtaggttacaacgtgggtgggagacgtgggagggaggcgtggactccgacggtccgggtcggggggtaccctaggacgtaccgttcgtccgtggtcgaccgtacgtccgtttcggttacggggttaccacggtactacgtaaccgtaaacggtaaaccgtaactaacgtacgtacggtaccccggtcccggggaccccgccggtaccggtacccggtaccggggaaggggggacgggtcggtgggtagggttcgggttctacgttagttaacgtaaggaaacgtaggtacgtacgtactacgttaacgtaatttacgttacttcggtacgtaccgtacgggtacgggtaccgggttcccgttacctacccgtcgtaccgaacgtacgtaccctactaacaaacctagttcttacgttataccttcactaacgttagcgtaacagtacgttacgaaggtaccggacgtaaccggtacaacccgtaccgtaaccttatttacgggttcgttacgtcgaacccgggtntaacccttaggtaacccggtaccttacgggtacccgttaaacgtttcccgggtaaggggtcccgggggaaccgtcgggggtaaccccc

SEQ ID NO: 154458 - DNA, 681 bp, Homo sapiens
  misc_feature: GYAE6OF01A5PJZ.10.38.D05.1.454.CMB.1.raw
  modified_base (611)..(611): a, c, t, g, unknown or other
  misc_feature (611)..(611): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgagactctcctgtgcacgcctcgtgggttcagcatcaagtaacgactacatcgaccgtcgggccccgcaggcctccgaaggggaaggggccgtgggtaggtcgggtctacgtaggtttaacgttaggaaaaccgtaggagtcgggtacctaacgtaactaattaatttattccgtagtacccgtaccggtaggaaccgggtcccggttacccgacccttcacccaagacgaccctaacttaccccaaacaactacgttactttacgtacttccgttacaacctatacgactaactaacttcgtaggaacgtacggtaccgacgaaccaccggtacccaaccgttattacgtttgccggcgtacccgtaanacgttccgtaaacccgtacgtacccttaacgtaacggtttcccggacggggtcccgagggtaacccccgg

SEQ ID NO: 154459 - DNA, 789 bp, Homo sapiens
  misc_feature: GYAE6OF01BDD5Z.10.38.D05.1.454.CMB.1.raw
  modified_base (172)..(172): a, c, t, g, unknown or other
  misc_feature (172)..(172): n is a, c, g, or t
  modified_base (442)..(442): a, c, t, g, unknown or other
  misc_feature (442)..(442): n is a, c, g, or t
  modified_base (775)..(775): a, c, t, g, unknown or other
  misc_feature (775)..(775): n is a, c, g, or t
tcagcatagtagtgcacgaccggtgctcgatttagtatctgatagttgggtttggggggggtctcaggaggcagcgctctcaggacgtcaccaccatggcctgggctctgctcctcctccaccctcctcactcagggcacgagggtcctgggcccagtctcgccctgactcncgccctccctcgccgtccgggtctccgtggacagtcacgtccaccacttcctcctgccaacgtacggaacctagctacgtcgttacttttcggttacgtactttaataacttgttcgttacctccgtacggtaccacgacccaccgacccgtacggaccaaacccgaaccccctaacgtttccgttttaggttttacggacgttacgaaggtaaccggcccggtacctacgtaacggtacccgttcccgtagttacgtttccggtttccnccggttcgtacctaccgtagttccgacgaccctaaaccggtcccgtacccttccgtccgtacccggttcgtccggtacggtctacgcggtcgaggtacgagtggacgtctagttactcgtgtacgcgcgctacttaacgtactaccggaccgtaaccgtaggggttacggggtttcggacgggtcccggaacgggggttaactacggggttcccggtcccgggttacggtaccgggttaaccgcccgggtaccccggaacccggttccccgtccccggtttaccccgtaccgtttacccggtacccgttttaccccacccccgtttacccccnccccggttttaacc

SEQ ID NO: 154460 - DNA, 768 bp, Homo sapiens
  misc_feature: GYAE6OF01DAHCT.10.38.D05.1.454.CMB.1.raw
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
  modified_base (604)..(604): a, c, t, g, unknown or other
  misc_feature (604)..(604): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcacatggtagttttggctgagtcttgggttttcttgtgcttattacgaaaggtgtccactgtgtaggttcaacgtgggtggacgacgtgggaggagggctggacnccgacggccgggtcgggggtcctggacgtcttcctccgtgtcgcncgtccgtgtcggttacagactacgtacgtaacgtaacgacctactagtccggacccggtcgggcccccgacgtacggcgtaccgggaggggagggtcggtagggtcggttcggtctacgttaagttagtacgaaaacgtcgatacggtacctacgtaaacttatttaactttaccgttcgtaaccgtaccgtaccggggtaaggggttaccccggggtttacccgtaccccgtaccccttccgaacccgaagggaacccttaaccccgaaaccttaaaccccaaacttaaccttactttacggttacctaactttcccttaaccactntaccgaactaacttacgtagtacgtacgtaacgtaccgaacccgtaaccgaacccgttacccttagttattacggaccggtcgaaccggtccgaacttagtaccgtaaccgtctaaccgttacgttaacggtccgggggtaccgccgggaaacgggtcccccgg

SEQ ID NO: 154461 - DNA, 788 bp, Homo sapiens
  misc_feature: GYAE6OF01AQKMF.10.38.D05.1.454.CMB.1.raw
tcagcatagtagtgcacgaccggtgctcgatttagtatctgatagttggggtttgggggggagaggagcccagcactgggattccgaggtgtttccattcggtgatcagcactgaacacagaggactcaccatggtagttttggctgagtcgttgggttttccttgttgcttatttacgaaaaggtcgtccactggtgtaggttacaacgtgggtaggagtacgtgggagggtaggcgtaggactccgacggtccggttcggggggtccctaggacgtaccttcctccgtggtcgtccacgtccgttcggttcgggttacaggtacaacttacgaacggtaaaccgtactaacacgtaccggtacccggtccggggcccccgaccgaccgggtccgtaacccgggaaggggggtaaccggggtcgtaggggtacggtttcggggtaccttacgtaaggtttagttaacggaaaacggtaggtaacggtacggaacgtaacttaacgtaatttaacgttttacgtttaccgtacggtaccgttccgggtaacgggtaaccgggtccccgttaccctaccctacgtaccgaagaccgtaacctacctaacccgaaactacttcgttacttagtacttactacactagtcgactaactacttacgtagagtacccgacgaccgacgacccggtactacgttagttcggtcgtacgaccggactagtacttacggacccttaacgaccgttaactacggtttaccgggaccggggtccaacggggtaccccg

SEQ ID NO: 154462 - DNA, 869 bp, Homo sapiens
  misc_feature: GYAE6OF01D6I1X.10.38.D05.1.454.CMB.1.raw
  modified_base (248)..(248): a, c, t, g, unknown or other
  misc_feature (248)..(248): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacgagggtcctgggcccagtctcgccctgactcacgccctccctccggcgtccgggtctccgtaggactacgtcacgtccaacctactcctccctgcacgtaggaaccngctaggttcgtacttttgtcgtacttaataactattcgtcctccgtacggtaccagaccacccaaccgacggaaccaaaccgaccccccttaaactttccgttttaggtttttacggacggttaccgtaaggtaaccggtcccggtccctacggaacggtaccgtcccgtacggtacgtttccgttcgtccgttaccgtcccttacgtaacgtcgtaccggaccctaaaccggtcccgtcccttaccccgtaccgggttacccggttccgtttaccggtccgggtacccgtacccggtacgggttacggtacggggtaacgggtacgttaccgggtaacgggtcttaacggttaaaccttttaaccgggacttcgggaccgtacggaccgtacgttaacgtttacctaccgggaacccgttaaccccggtaaggggttcggggtttcggtttaccggggcggggtaaccggttaccgtacggggttacccgtccggttacggttcccgggtacaccccgggtaaccggtaccgggtccccctacccgggtaccccccgtttacggtaccccttacccggttccccgttttaccccccgtacccccttccccgttaaccccg

SEQ ID NO: 154463 - DNA, 801 bp, Homo sapiens
  misc_feature: GYAE6OF01A50MQ.10.38.D05.1.454.CMB.1.raw
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
tcagcatagtagtgcacgaccggtgctcgatttagtatctgataggttgggtttggggggagaggagcccagcactgggattccgaggttgtttcccagttcggtgactcgacgcactagaaccacagagacctcacctagtgggtagttttggctgagtcgtttcgggtttttccttgttgtacttagtttacgaaaaggttctcccgtatggtggtaacgggtttaccaacggttgggtagggaacggtacgggtaggggaacgggcgggtcgtcgggtaacctcccggtaccgggtcccggggtttcccgggggggtcccctagggtaacctcccgttcccttcggttcggacggccgaccgttccggttcggttaccggtacgctacacgtaccgtaacgtaacaacgtacacgtccggacccgtccggccccgtacggacgtccggacgggaggggtacggcggtagggtgtccggtntacgtagttaagtacgaagngtgagtacctatactatttacgtacgtcgtaacgtccgtacgggtacgggttaacccgggtcccttaccccgtactacccgtacggaacgtaaccctaacccgttaacctaaacccctaaataccttacttaccgttacgttaaccttctaacctactacggtctaaccgtatagtcgtaacgaggtacccgaacgtaccgaccgtaaccgtctaaagtttcgtgtacgccgacgcctaaagtccttacgacctagtcccgttaggtacccggtccgggccggagggtccctacccgg

SEQ ID NO: 154464 - DNA, 703 bp, Homo sapiens
  misc_feature: GYAE6OF01CBYWR.10.38.D05.1.454.CMB.1.raw
  modified_base (178)..(178): a, c, t, g, unknown or other
  misc_feature (178)..(178): n is a, c, g, or t
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagcatagtagtgcacgaccggtgctcgatttagtatctgataggttggggtttggggggggtctcaggaggcagcgctctcaggacgtcaccaccatggcctgggcctctgcctcctccctccaccctcctcactcgagggcacgagggtcctgggcccagtctcgccctgactcncgcctccctcgcgtccggtctcgtgacngtcagtccacctatccncctgccgtacgtacggaaccngtacgtagttgttacttttggtactactttaacgtaacttgttcgttcctccgttacggtacccgacgacccgaaccaacccgcggtaaccaaacccgtacccctaaacgtttccgttttaggttttacggacggtacaaggtacggtcccgtacctacgacggtaccgtcgtacgtagttccgtctcctccgtccgtaactacgtctcggacaaccgccggtcctccgagtccctcggtctcgggcctcggcgtacgtgaggtacgtggacgtagtacgtaacttacgcgtacgtacgtagactctaacgtcgtaccgaaccgaccgtacgggttggttacgtcgggacggacggtacgtacgggtcgtaccggtcggtcgaccgtccgaggtaaccggtcccgtcccggtacccggttcgtaccgtcgttaccccgttccgccccgttcctaccccg

SEQ ID NO: 154465 - DNA, 895 bp, Homo sapiens
  misc_feature: GYAE6OF01BPQQK.10.38.D05.1.454.CMB.1.raw
  modified_base (265)..(265): a, c, t, g, unknown or other
  misc_feature (265)..(265): n is a, c, g, or t
  modified_base (576)..(576): a, c, t, g, unknown or other
  misc_feature (576)..(576): n is a, c, g, or t
  modified_base (625)..(625): a, c, t, g, unknown or other
  misc_feature (625)..(625): n is a, c, g, or t
tcagcatagtagtgcacgaccggtgctcgatttagtatctgataggttggggtttggggggggtctcgaggaggcagcgctctcgaggacgtcaccaccatggcctgggctctgcctcctcctccaccctcctcacgtcgagggccacgtacgggtccgtcgggcccagttctcgccctgacctcgacgtccctcccgtccggtccggttacccgggtcttaccgtcggaactcgtaccgacgtaccctaccgtactccttccgngacctacgtacgggaacctgacgtaggtcgttacgttttggtacttacttaaactaacgtttctcggttaccccttaccgggtacggtaaccacgaaccccgtaaccctaaccgggaacgtaaccccgtaaaaacccccggaccccctttaaacgttttccggttttttaggttttacggaaccggttacaaacgggttaccgtcccgggacctaacggtacgggtacttcccgtagtacgttccggtactccgtacgtaaccctagtaacgtcgtcggaacctaccgccgtaccctccgtgtaacccgtnttccgggcgtaccgacggtcggtcgtaggggacgtgtacggtaccggtnttaacgttacgttaacgtcgtacggcgtaacggtacctacttaacggtttcccgacccgggtaaccgggtaaccccgtaaaggggtttccggggtttaccggacgggggtacccgtaacggggttaaacgtccgggtaacccggtacccggtttcggggaacccgccgtaaccccgggtaggaaccccgttcccggtcccccggttaaccccgtttccgggtacctaccccgtttaccccggtacccctaccccggttcccctaaaccgg

SEQ ID NO: 154466 - DNA, 785 bp, Homo sapiens
  misc_feature: GYAE6OF01EDZ7W.10.38.D05.1.454.CMB.1.raw
  modified_base (170)..(170): a, c, t, g, unknown or other
  misc_feature (170)..(170): n is a, c, g, or t
  modified_base (201)..(201): a, c, t, g, unknown or other
  misc_feature (201)..(201): n is a, c, g, or t
  modified_base (756)..(756): a, c, t, g, unknown or other
  misc_feature (756)..(756): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcncgccctccctcgcgtccggtctccgtggacngtcacgtcaccactcctcctgccacgtcggaaccagcgtagtgtacttttgttagtacttaattaactagttcgtccttaccgtacggtaaccacgcccaacccaacccgaggaaacccaaacccgtaccccccttaaaacgttttccgttttaggtttttacggacgggttacaacgggtaaccgccggtccctacggtaacggtaccgttcccctaggttaccgtttccggttccttacgtccgtacctacgtacggtcggtacgaaccaaccggtccgtccctccgtaccggtaccgttccgttcggtacggtccctacggacggtcgtaacgggtagtcgtaggacggttcttacgtaacctttaacgcgtacgtacgacgtcgtacgttataccggtacccgaccgggtaaccgtagggttgggttaccgggttacgggacgggtaacggtaccggttaggtcccggtaccggtcggtacggacccggtaccggacggtaccggtcctaccccgggttaccccggtacgttcccttacccggtttacccnccccgtttccccccgacccgtttaccccg

SEQ ID NO: 154467 - DNA, 825 bp, Homo sapiens
  misc_feature: GYAE6OF01EWVGE.10.38.D05.1.454.CMB.1.raw
  modified_base (190)..(190): a, c, t, g, unknown or other
  misc_feature (190)..(190): n is a, c, g, or t
  modified_base (549)..(549): a, c, t, g, unknown or other
  misc_feature (549)..(549): n is a, c, g, or t
tcagcatagtagtgcacgaccggtgctcgatttagtatctgatagttgggtttggggtacgatttgatgttacctgatgcttagaggcttttcctggaagcagggctatttgttgcttcagcaccgtagtgcctcgtcatcacgcctcagtccttgtactttttccggtattttcgcctaggaaaacccncgaccctaaccccggaccgttaaaacccggggaccaaccggtcccgccccggaccaaacatacgtcccttcctcccgttccccccttcgacaacgtaacaccaagtacaggaattacttaaccttcgttccactcgacctacgtcctttccgcctcgtccgttaggggtccactccacccctcgtaccccgtaatttaaccggttcggaaccgtaccgggtaacccgtttcgggtccgtttcccgggcggtacgtccggggttccttttccgacccgttcgttttactccgtttacttagtcgtacacgtctacttccgcttactttcgtcgtactaccctccgagtctatccgtcccncaccgacgacctaaccacctttcaacccgtaggtaccttaaaccggaccgtaacccgttaccccctacccccctaaacccaaaccgtaacccgacctaaacgttaaccgcccgggttaccacccggttacccggacccggttacgtacgttccgggttttaccggtacgtaccgtttacggtttccgggtttaacccgttaccccggttaccttaccccgtttcccccgttacccgtacccgttactttaccggttactacccgttaacttaacgg

SEQ ID NO: 154468 - DNA, 895 bp, Homo sapiens
  misc_feature: GYAE6OF01CMF6L.10.38.D05.1.454.CMB.1.raw
  modified_base (845)..(845): a, c, t, g, unknown or other
  misc_feature (845)..(845): n is a, c, g, or t
tcagcatagtagtgcacgaccggtgctcgatttagtatctgatagttgggtttgcggggagaggagcccagcactgggattccggaggtgtttccattcggtgatcagcactgaacacagaggactcaccatggtaggttttggctgagtcgttgggtttttccttgttgcttatttacgaaaggtgtccacgttgtggtaggttcaacgtgggtggagcgtgggagggaggctggactccgaggtccggtcggggggtccctggacgtacctctccgtggtcgcgacgtcccgttcggttcggggttacacggtactaacgttaccgtaaacggttaaaaccgaccgttaactaacggttccgggtaaccccggttcccgggggacccccgtaccggtaccgggaccggtacccgggaaaggggggaacggggggtcgtacgggggtacgggtttcggggttaccttacggtaaggttttaacgttaacggaaaacggtagtagttaccgggaaccttaaccttaaagtacttttaaattttacgttaccgttacgggtaaaccccgttccggggttaacggggtaaacccggggttccccggtttaaccccgtaccccttaccggttaacccgaaaacggggtaaccttaacccccgttaaaccctttaaccccaaaacccgttaaaccgttaccttttacgtttaccggtttaaccttaaacccccggtttcaaaccgttaacgttacgtaacccgaaactttacgtacgtacggaaacgggtcctaccggaaccgaaccgtccggtaccctaacttgttacgtggccgtaccgacgtaacngtacaccgtcgtaccgttacgtacggtttccgggacgggtccgtaacggg

SEQ ID NO: 154469 - DNA, 711 bp, Homo sapiens
  misc_feature: GYAE6OF01E3AXQ.10.38.D05.1.454.CMB.1.raw
  modified_base (291)..(291): a, c, t, g, unknown or other
  misc_feature (291)..(291): n is a, c, g, or t
tcagcatagtagtgcacgaccggtgctcgatttagtatctgatagttgggtttgggggctctgctcctcctcaccctcctcactcagggcacacgggtcctgggcccagtctgccctgactcagcctccctccgtgtctgggtctcctggacagtcggtcaccatctcctgcacgtcggacccagcacgtgagttggttcgggactattaacttaaccgtttcgtcctaccgtggtataccaaaccaaccgcccaagaaccaaaccgccccacacttcgttagtactttanagtaagtcgtaagaacgccggaccgtacgtacggggttttctacggtcgtccttcgtcgtcgtcctacgtaacgtctcggtaaccaaccgaccggtcctacccgagaacctaacgttctacggtcggtacctacgacggtcgtacggtaacgacgtacgggtactaggtaaacttacgttacgcgtacacgtactacgaagttagttcgtaagtcgttcggttctccgtttacgtttacggttacgggtttcggacgggtacggacgtcggtctacgtaccgtacgtagaaccacgaccgtaacgtccgtacccggtccctacgtcctacgtcccgttaccctacccctacccgtaccctccaaacgttccgttccgtacgtacggtacggacgggaccggccgtagggaccgtaacggg

SEQ ID NO: 154470 - DNA, 960 bp, Homo sapiens
  misc_feature: GYAE6OF01EBP51.10.38.D05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactggaaccagcagtgactttgtgctttataactatgtctcctgtacagcaccaccaggaccaaacgccccctaaaacttccgtttgttttacgaggtctaaggtaacgcggccctacgaggtacgtccctagtacgttccggttactccgtaccgtccccgttaccgaaacggttcccgttcgggaccctaaaaccccggtcccgggtaccccctttacccccgtaccgggttaacccccgttccggtttaccggttccgggggttaccccttacccggtaacggggttaccccgtaaggggtaacgggttaaaccggttacgggtaacggggttaacccgtttaggggttaaacctttttaacccgttaacgtttaccgggtacccggtaacgtcccgggtaacgtaaaccgttttaaccgttaaccccggtaaccccgggtaaccccccccgtaaaaggggtttacggggggtttttaccggggttttaccgggggtacccggggggtaaccgggttaaccggggttaaaaccggggttcccgggttaaacccccgggggttcccggtttaaaccggggtaccggaaaccccggtaaacccccgggttaaccggggttcccccttaacccccccggggttcccccccgggtttaccgggtttaccccttaaaccccgttttcccccggtttaccccccggttttacccccccgttaaacccccccggttttccccccg

SEQ ID NO: 154471 - DNA, 279 bp, Homo sapiens
  misc_feature: GYAE6OF01DE53Y.10.38.D05.1.454.CMB.1.raw
  modified_base (125)..(125): a, c, t, g, unknown or other
  misc_feature (125)..(125): n is a, c, g, or t
  modified_base (140)..(140): a, c, t, g, unknown or other
  misc_feature (140)..(140): n is a, c, g, or t
  modified_base (239)..(240): a, c, t, g, unknown or other
  misc_feature (239)..(240): n is a, c, g, or t
  modified_base (242)..(279): a, c, t, g, unknown or other
  misc_feature (242)..(279): n is a, c, g, or t
tcagcatagtagtgcacgaccggtgctcgatttagtatctgatagttgggtttgggtgccgaagttgctggaggtcaccgtctccccagcctccaccaaggcccatccggtcttccccctggccnccctgctccaggacncaccctccgagagcacagccggccctgggctgcctggtcaaggtacctaccttcccactactatgctggacggcgggctgggacaacggcgacagtagnngnnnnnnnnnnnnnnnnnnnnnnnnnnnnnnnnnnnnnn

SEQ ID NO: 154472 - DNA, 1021 bp, Homo sapiens
  misc_feature: GYAE6OF01CGDYE.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcacgtccctcccgtccgccggtccgggtctccgtggactacgtcacgtcacctattcctcctgacacgtacggaaccagctagttgtacttttgttcgactttaactaactattcgttccttccgtaccggtaaccgacgaccacccgaaccgtaacggaccaaaccccggtaccccccaaacttaccgtagttacggtttacgttttttacgacgtttacggttaccgtaacggtttaccgttcccgggtaccccgtttacggggttaaccggggtttttaccgtaacggtttcccggtttacctttaccgtccggttcccggttacccgttaaaccggtaaccggttccgttaaccgggtaaaccgtaaccccgggtaacccccggttaccccgttacccgttaaccgggtaaaccttaaccggtttccggttaaccccgggttccgggtacccgtttaacccgggaccggggttaccgttaaccggggaaaacccgggtacggtaaaccggggttaccgttaaacgggttaaactttttaaaccggtttaacccgacgggtaaccgttacggtacccgtttaaccgtaaaggtttcggtttaaacggggtacgttaacgggtttccgggtttaacccgtttacccgtttttaaccgggtttttaccggggttaaccggggtttccggggtaacccgggggtaacccgggtaaaccgggttaccgggttccccgttaccgggtaaacccccgggtttaccgtaaccgggttaaccccaacccggggttaacccccgtaaccggggtttccccgtaccccccggtttacccgggttccgttaacccccgg

SEQ ID NO: 154473 - DNA, 822 bp, Homo sapiens
  misc_feature: GYAE6OF01CAUOX.10.38.D05.1.454.CMB.1.raw
tcagcatagtagtgcacgaccggtgctcgatttagtatctgatagttgggtttgcgggggagaggagcccagcactgggattccgaggtgtttccattcggtgatcagcactgaacacagaggactcaccatgggtagttttggctgagcttggggtttttccttgttgctatttcaaaaggtgtccactgtgaggttcaacgtgggtggagacgtgggaggaggcgtggatcccgagccggtcggggggtccctggacgtactcctcgtgtcgcgagtccttcggtggttaccagccagtaccgtaagaacgtactacagtcgacccggtccggggccccgaccggaccggaccgtacccggaaggggggtaacgggtcggtagggaacggttcgggggtccttaggtagtttaagttacggaaaacgtaggtaagtacggacctaaactaaccgttaaagtttaatttaacgtttaccgtacgtacccgttacggggtaacgggttaaaccggggtccccgttttcccaaccccgttccgaccctagggaaccgtaccccttaacccttaaacccaaaaccgtaacttacccttaccgtttaagttaacccttcccttaccgaacttaacacggttaaccaacgtaacttaccgtacggtaaacgggtacgttacggaaaccccgtaaccgggtccctaaacctaccgtttaacgttacgttaccggccggtaccgtaacgggtacctaacgtacccggtaacctcccgttaactactttaaccgggtcccggggttccggggaacggaaaccccggggg

SEQ ID NO: 154474 - DNA, 738 bp, Homo sapiens
  misc_feature: GYAE6OF01A218T.10.38.D05.1.454.CMB.1.raw
  modified_base (491)..(491): a, c, t, g, unknown or other
  misc_feature (491)..(491): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcgagggcacagggtcctgggcccagtctcgccctgactcacgcctccctccgcgtccgggtctcctggacagtcagtccaccatcctcctgccacgtagaaccagcagtgtacttttgtgtcttaataactattcgtcctccgtaggtaccagccaacccgacccgaaggtaccaaacccgacccccctaaacttccgttttggttttagacgttcaaggtaaccgccggtccctaggacggtacttccctgtacgtttccggttctcgtcgtaccttccaaggttccacggtaacccaaccgcccggtcccctccgtcgtacccgttctcggtccggtcctcggaggtctaggaggtntcggacgtcttaagtacgtttaccactcggacacggtcctaatactccgtaccgacccggaacccttaagggtccggggtttaggttaccgggaccggggtaacgggtaacgttaccggggtcccgtaacccggttccggggtacggtacgtacccgaaccccgggtacggtccccgttacccgggccccccgttggttaacccctcggtttccccgtcccggttaccccccgtccccgttaccccg

SEQ ID NO: 154475 - DNA, 846 bp, Homo sapiens
  misc_feature: GYAE6OF01EP02H.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcacgccctccctccgcgtccgggtctcctggacagtcagtccaccatctcctgcacgtaggaaccagcagtcgtacttttgtgtacttaataactatcgtcctccgtacggtaccacgccaaccaccgaaggaccaaaccgtacccccctaaactttccgttttaggtttttacggaacgggttaccgtaaacgggttaaccggcccggtacccccgtacggtaacgggtacccgtttaccccgttaggtaccggtttccgggttttccctccggttccggtaccccttaaccgtaacggttccgtacgggaaccctaaacccggtcccggtccccttacccgtaccggtaccccgttccgttccgggtccggggtccctaccggaacgggtccgtagggtaacgggtacgtacggacggtaccgttaggttaacctttaaccgtacggtcggaccgtacggtaccggtacttaacggttaccgttaccggaacccgggtaaccccgtaaagggttgggggtttacgggttacggggaccggggtaccgggtaacggtaacgggtccggtacccggttcgggtcggtaaccgaccggtaccggtaccggcccgttacccggtcccccgtacggtacccttacccgtccggttccccgttcccctccccgttaacccg

SEQ ID NO: 154476 - DNA, 884 bp, Homo sapiens
  misc_feature: GYAE6OF01CBC9W.10.38.D05.1.454.CMB.1.raw
  modified_base (720)..(720): a, c, t, g, unknown or other
  misc_feature (720)..(720): n is a, c, g, or t
tcagcatagtagtgcacgaccggtgctcgatttagtatctgataggttgggtttgggggggagaggagcccagcactgggattccgagtgtttccattcggtgatcagcactagaacacagaggactcaccagtggtagtttggctgagtcgttgggttttccttgttcgtacttagtttacgaaaggttcgtaccacgtggtgtaggttacaacgtgggtaggacgacgtgggaggacggcgtaggacgtaccgacggtccgggttcggggggttccctaggtaacggtccttccgttcccgttaggtacggaccgtaacggtcccgtttacggttcgggttaccgaacgtactaacgtaccgtaaacggttaaaccgacttaacgtacgtaccggtaccccggtccgggacccccgaccggtacggtaccgtaccgggaagggggtaacggggtccgttaggggtacggttcgggttacctaagttaacgtttaagtaacggaacgtaggtagtacgaactaactaacgtattttaactttacgttcgtaacgtaccgttaccggtacgggtaacccgggttcccttaacccgtaccccttacgacccggtaaagtacccgttaaaccctaacccctttaaaacccaacggtttaacctaccgtttttacgttaacggtttaccttccgttaacgaacgttacgaacgtaaccctaanacgttacggtaagggtaacccgaccgggttaaccggaaaccgtacccgtaacccggttcccttaaatttcggttacgttccgacggaccgtaactacgtacgttaccgacccgttcctacgtacggttaccgtcggggtacggaacccgggtagtaacccccgg

SEQ ID NO: 154477 - DNA, 808 bp, Homo sapiens
  misc_feature: GYAE6OF01DRL5I.10.38.D05.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (271)..(271): a, c, t, g, unknown or other
  misc_feature (271)..(271): n is a, c, g, or t
tcagcatagtagtgcacgaccggtgctcgatttagtatctgatagttgggtttggggggggtctcaggaggcagcgctctcaggacgtcaccaccatggcctggctctgctcctcctcaccctctcactcagggcacgagggtccgtcgggcccagtctcgccctgacctcacgccctccctccgcgtccggtctccgtggacngtcacgtccaccgtatcctcctgactacgtacggaaccngctagttgtacttttgtagtactttaanaacttcgtcgttcctccgtaggtacccagtaccacccaccgacggaaccaaaccccgtaccccccttaaacgtttccgtttttacggttttaggaccggttacaacgggttaaccgccccggtacccgttcggaacggttcccgttcccgtaggtacctttccggttcctccgtccgtacccctacgtaacggtcccgtacggacctaacccggtcccggttaccctccccgtacgtacccgttccgtcggtacgggtacccgtcggacgtcgtaggggacgtcgtacggtcgtcttaacggtaccttacgctacgggcaccgggctacttacgtacgtacccggaccggtacccgtaagggtcgggggtttacgtcgggggaccggtaaccggggttagtacggggttaccccgccgggtttacggccggtaaccgacccgggtacccggacggtccccgtttcccccggtccccggttaccggtacccttacccgttccccgtttacccccgggtcccccttcccccgttacccg

SEQ ID NO: 154478 - DNA, 1025 bp, Homo sapiens
  misc_feature: GYAE6OF01EYZMC.10.38.D05.1.454.CMB.1.raw
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
tcagcatagtagtgcacgaccggtgctcgatttagtatctgatagttgggggtttggggggggtctcaggaggcagcgctctcaggacgtcaccacatgctggctctgctcctcctccaccctcctcactcagggcacgagggtcctgggccctagtctcgccctgactcacgccctccctccggccgttccgggtctccgtggactgtcagtccacctatcctcctgcctaacgtcggaaccngccagtcgtactttgtctacttaataacttntcgtcctccgtacgtaccagtaccaacccaccgacggtaaccaaaaccgtacccccttaaactttccgttttacggttttacggacggttaccgtaacggtaaccgggtcccggtacccgtacgtaacgggtaccgttaccccgtaggtacgtttaccgggtttacctccggtaccgtaccccgttaaacgtaacggttaccgtaccgggtaaccctaaaccgggtaccccgggttacccttacccccgggttacgggtttaaccccgttcccggttacccgggtttacccgggggtaacccttacccggggtaaccgggtttaccggagggggttaaacggtaaccgggttacgggtaaccgggtaacgtttaacgggttaaccctttaaccggttaaccggtaccggaacgttaacccggtaccggtttaaccgttaaaccgtttaaccggttaaccccgggaacccgggttaaaccccggttaaacgggggttcggggggttttttaccggggtaaccggggacccggggggttaaacccgggttaaacggtttaacccgggggacccgggttttaccccggggtttacggaaccggggttaacccggtaaccccgggtaccgggttaaacccgggttcccccgtaccccccgggggtttacccccttaacccgggttacccggttaacccccgttttccccggtttaacccccggtttacccccccggtcccttaaacccccccgg

SEQ ID NO: 154479 - DNA, 928 bp, Homo sapiens
  misc_feature: GYAE6OF01BAB01.10.38.D05.1.454.CMB.1.raw
tcagcatagtagtgcacgaccggtgctcgatttagtatctgatagttgggtttgggggggagaggagcccagcacgtgggattccggaggtgtttccattcggtgatcagcactgaacacagaggactcaccatggtagttttggctgagtcgttgggtttttccgtttgttgtacttaattttacgtaaaaaggttcgtcctacgtggtggtaggtttcaaacgttgggtgggagtacgtagggaggaggcgtggtatccgacggtccgggttcggggggtccctggaacgtccgttccttcccgtggtcgacgtacgcccgttcgttggggttacacggctattaccgaaacggtaaaccgtactaacgacgttaccggaccccggtccggggtcccccgccggtacgggaccgtaccggggaaacggggggaacgggggtccggtggggtacgggttcgggttaccttacggttaagttttaagttaacggaaaacgtagaaggttacggtaacctaaccgttaaattaattttaagttttaccgtttaccggttaccggttaccggtttacccgggttacgggggtaaaaccggggttccccggtttaaccctacccccgttcgttaaccgaacggtaaccgttaaccctaaccctttaaaccccgaaacttaaaaccttgttttccgtttaacgtttacctttaccttaccgtaacttacgtacgaaccctaacttacggttcgtaaggtaaaccggttacggacccggttaaacccggacccgtaaccggtacccttaacgtttacgtttacgtcgggtaccggcccgtaacggtattaaccggcgttaacccgttaacgtacccttaaacggttacggttacccggggaccgggggaacccgggtaaggggtccccccggg

SEQ ID NO: 154480 - DNA, 845 bp, Homo sapiens
  misc_feature: GYAE6OF01AYAYE.10.38.D05.1.454.CMB.1.raw
  modified_base (209)..(209): a, c, t, g, unknown or other
  misc_feature (209)..(209): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcgagggcacgacgggtcctcgggcccagtctcgccctgactcacgccctccctccggcgtccgggtctccgtggacngtcacgtccacctactcctcctgaccacgtacggaaacctgcgtaagttcgtactttgtgtactttaataactagttcgtccttccgtacggtaccacgaccaacccgaaccgaacggacccgaaaacccgtaccccccttaaacgtttcccgtttttggtttttacggacggttaccaagggttaacgcccggtccctacgacggacgttccccgtaagtccgtttaccggttcttccgtacgtaccttacccgaggttccgtaacgggaccaaccgtcccgggtaccccttcccgcggtaacccgttcgtacgggtcggtcctaccggcggtgtacggaggtcgttacggaaccggtcgttacgtaacgttcgttaagtccgacgtacgcgtaacttaacgtaccgttaaccggaccccggtaacccttaaggggtcggggtttacccgggtttacggggacccgggtaacgggttaaccggttaccgggtccgggtttaaccccggttcgggaaacccgggtccgtacccgggaacccggttacgggcccccgttaccccggtccccccgttacgggtacccctttcccggttaccccgggttaccccccggtttccccacccccggttcccc

SEQ ID NO: 154481 - DNA, 921 bp, Homo sapiens
  misc_feature: GYAE6OF01CCOE5.10.38.D05.1.454.CMB.1.raw
  modified_base (857)..(857): a, c, t, g, unknown or other
  misc_feature (857)..(857): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcgtttgggtttttcctttgtttcgtctttaattttaacgaaaaacggttcgttaccctacgttggtaggtaacggtttacctaaacggttggggtagggaagacggtggggaagggacggtccggtcggtaaccgtccggaaccgggtcccggggttaccgggggggttccctaggtaacgtacccttccgttccggttggtcgccgtacggtcctttccgggttcggttacgacggtcctaagtaaccgtaaacggtaaaccgtacccttaacgtacggttaccggtacccggttacccgggccccgtaccggtaaccgggtaccggtaccgggaaggggggtaaaccgggcggtttaaggggtcgggtttcgggttacttaacggttaacggttttaagtaacgtaaaacgaggtacgtacggtaacctaacttaaacgttagtttaacttttacgttacgttacccggtaaccgttaccgggtaacggggttaacccgggttacccgtttaccccgtaacccgttaccccttaaccggaacggttaaacccgtaacctaaccccgttaaaccaaaccgttaacctttaacgttttccgttaacgttcctttaccttaaccgtaacctactaccgaacttaactacgtagtacgaacgtacgtaccaaccgacctaccgtacctacttattcgtcgtcgaccgtanaacgttcgtacgaccctagtaccgtaacgtaccggtttcggaccgggtaccggacgaccccggg

SEQ ID NO: 154482 - DNA, 716 bp, Homo sapiens
  misc_feature: GYAE6OF01CTNZO.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtgggaggaggcgtggactccgacggccggtcggggggtccctggacgtacctcctccgtgtcgccacgtccgttcgttggggttcacgctaatacgaacgtaaaccgacctaacacgtcggaccccggtccggggcccccgccgacggccgtaccggaaggggaggggcgtgggaggtcgggtctacgtagttagtacgaaacagacgtcgactaactactaatttatttactctacgtaccgttccggtacggtaacgggtcccgttacccaccccgtctacccgaagtaccgtaaccctacccttaaaccccaaactaactacgttctttacgtacttccgttacactatcgacaactaacgttcgtaagacggtacgtaccgaaccgacccgaccggtaccctaacgtttatttacgttcgtcggacccgacgtaacacgtacggaaccctacgtccgttaacgtacgtttccgggacggggtcccgtaacggggtaccccg

SEQ ID NO: 154483 - DNA, 822 bp, Homo sapiens
  misc_feature: GYAE6OF01APK9J.10.38.D05.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagcatagtagtgcacgaccggtgctcgatttagtatctgatagttggggtttgggggggtctcaggaggcagcgctctcaggacgtcaccaccatggcctggcgtctgctcctcctcaccctcgtcactcgaggcacgcgggtcctgggcccagtctcgccctgactcacgcctcctccgcgtccggtctccgtgacngtcgagtccactatctcngcacgtacggaacngctagtcttacgtttgttnacttaatactntcgtctcgtacgtaccacgtccaacccgaccacggtaaccaaaccccgtacccccttaaactttccgttttaggttttacggacgtacgaacggtaccgccggtccctagacggtacctcccgtgtacgttccgttctactccgtcctaacgtgtccgtacgaccctaccgtccggtcccttacccgcgttaccctcgtccggtacggtaccctcggtaaggcgtttacgggaacggtcgttaggaccgttcgtaaacgtttaccgttacgtaccgtcggtaccgtaacgggtacctacgtttaacgttaacccggacccgtaacccgggttaaccccggtaggggtttaccgggggtttccgggtacgggggtaccccgggaaccggtttaacgggtccgggttaaccgggtacccccgttttcgggggaacccgtaccggaacccccgggttaccgaaacccggtttccccggttccccccgtaaccccgggttacgttacccctttaccccgggtttcccgtttaccccccgttaccccctacccggttttaacccc

SEQ ID NO: 154484 - DNA, 826 bp, Homo sapiens
  misc_feature: GYAE6OF01ER932.10.38.D05.1.454.CMB.1.raw
  modified_base (176)..(176): a, c, t, g, unknown or other
  misc_feature (176)..(176): n is a, c, g, or t
  modified_base (208)..(208): a, c, t, g, unknown or other
  misc_feature (208)..(208): n is a, c, g, or t
  modified_base (275)..(275): a, c, t, g, unknown or other
  misc_feature (275)..(275): n is a, c, g, or t
  modified_base (691)..(691): a, c, t, g, unknown or other
  misc_feature (691)..(691): n is a, c, g, or t
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
tcagcatagtagtgcacgaccggtgctcgatttagtatctgatagttggggtttggggggagaggagcccagcaacgtgggattccgaggttgtttccattcggtgatcagcactagaacacgagaggactcaacagtggtagttttggctagcgtcgttgggttttccttagttncttattacgaaagtcgtacactggtgtagtanacgtgggtggacgacggtgggagggtacggcgtagactccggacggtcccggggtcgggggttcccngggaactccgttctacgtggtcgaaccgtcgttcccgttgggttacggttacgaacgtacgtaacttaaccggtaaaccgttaaaccgtaaccgttactaaaccggtcccgggtcccggtaaaccccgggccccggaaccggtaccggtccggtaccggggaaaaggggggtcggtacggtgggggtacggtttcggggtaccttacgttaaaggttaacgtaacggaaagtcggtaacgttaaccggacctaacgtttacgtaaacttttaacgtttacgtttaccaaccggttaccggttacggttaaccgggggtaaccccgttccccgggtaacccttaaccccgtacctacggtaacctacggtaaccttacccgtaaactaaccgtaaaccttgtaccttgttactctanaccgtanactanaccctgtactacggacagtaaccgcgaacgtacccacttaacgtttatcgtagcgtacgacgtactctacggacctacggtacttacgtacgtaccggggtacgaacccgggtcgaacccggg

SEQ ID NO: 154485 - DNA, 865 bp, Homo sapiens
  misc_feature: GYAE6OF01EXWPE.10.38.D05.1.454.CMB.1.raw
  modified_base (142)..(142): a, c, t, g, unknown or other
  misc_feature (142)..(142): n is a, c, g, or t
  modified_base (248)..(248): a, c, t, g, unknown or other
  misc_feature (248)..(248): n is a, c, g, or t
  modified_base (854)..(854): a, c, t, g, unknown or other
  misc_feature (854)..(854): n is a, c, g, or t
tcagcatagtagtgcacgaccggtgctcgatttagtatctgatagttggggtttggggggggtctcaggaggcagcgctctcaggacgtcaccaccatggcctggctctgctcctcctccaccctcctcactcagggcacgngggtcctcgggccagtctcgcctgactcacgtccctcccgtccgccggtccgggtctaccgtggactacgtcagtccacctactcctcctgacacgtacggaaccngctaggtcttacgttttgtacgtacttaagttacttacgtcgttccgtccgttacggtaaccacggacccacccgaaccgacggaacccaaacccgtaccccttaaacgtttccgttttaggttttacgacggttacaacggtaccggccgtacccgtagacggttaccgttccgtagtaccgttccggttctccgtacgtacccttacggtacgttccgtacggtaaccctaaccgggtcccgttacccttacccgtacggttaacccggtttccgtccgggtaccgggtacccttacgggaccggttaccggtagggaacgggtacgtacggggttacgtacgttaacgttaaccgtttacgtaccggtacgaaccggttaccggcttaacgttaccgtttaaccgtacccggaccccggtaaaccgttacggggtttagggtttaccgggtacggggtaacccggtacggggttaaccgttaacgggtccgttacccgggtttacgggccggttaaaccggtccggaaaccgggttcccgtcccgggttaacccccgttccgacggtttaccctccggtttaccccttcccggttaacccccncggtttacccc

SEQ ID NO: 154486 - DNA, 749 bp, Homo sapiens
  misc_feature: GYAE6OF01BMBFI.10.38.D05.1.454.CMB.1.raw
  modified_base (278)..(278): a, c, t, g, unknown or other
  misc_feature (278)..(278): n is a, c, g, or t
tcagcatagtagtgcacgaccggtgctcgatttagtatctgataggttgggggtttggggggggtctcaggaggcagcgctctcaggacgtcaccaccatggcctgggctctgcctcctcctccaccctcctcactcgagggcacgtagggtcctgggcccagtctcgccctgactcacgccctcccgtcgcgtccggtctcctggacagtcagtccactatcctctgactacgtacggaaccagcgtagttcgttactttggtctacttaatacttntcgtctcgtacgacacgccaaccgacgtaaggacccaaaccgtccccttaatttccgttttggtttacgacgtacgtaggtaacggcccgtcctacggacggtaccttccgtacgttacgttccgttcctacgtcgtacccctacgtacggtcgtacgaccgtaaccgccgtccctccgcggtcccgtcgtcggtcgactccggtaggcgttaacggggacgtcgtagggtaccggtctaccggtttaacttaccgtcgtcggaccgtcgaccttaccgtattaccggtacccggacccggtacccgtagggtcgggggtttgaccgggggcgttaaccgggtaactacgggttccgtaacccgggttcggtacggtaccggacgtacccggtacgggttccccgacccggttcccccggtagtaccccgtttccgtaccccgttccccgttacccctacccgtttccccg

SEQ ID NO: 154487 - DNA, 856 bp, Homo sapiens
  misc_feature: GYAE6OF01BJ5JW.10.38.D05.1.454.CMB.1.raw
tcagcatagtagtgcacgaccggtgctcgatttagtatctgataggttggggtttgggggggggtctcaggaggcagcgctctcaggacgtcaccaccatggcctgggctctgcctcctcctccaccctcctcactcgacggcacgacgggtccgtcggcctagttctcgccctgacctccgaccgtcccctccccgtccggtcccggttcccgggttcctccgtacggacacgttcgtacgtaccctacctacttcctccgtcgtaccgtaacggttaccggaaccgtagtaccgttaacggttcgtttaacgtttttggttacgttaacttttaaaacgttaaccgtttgttaccgtttcccgtaccggttaacccggtaacccgtaccggacccctaacccgacccggaaacggaaccccgtaaaaccccctaccccttaaccgttttcgttttacggtttacggacggtacgtacggtaccggccgtacctacggacgttccgttacggtgttacgttccggttacctcgtccgtaccgtacgtacgcggtaccacaccgtccgtccctaccgcgtaccgtcgttcggccgtcgtccgtacggcggtagacggtcgacggtacgtacgtacttacgttactacggtacgacgccgtacgtaacgttactaccgtaccggcccggtaacccgtaggggttaccgggtcggttacgggtaccggggtaacggtaacggtaccgggtccggttaacccgtcgggtaccggaccggtaccggaccggtacccggtcccgttcccggtcccgtcccggttactcccgttaccgttccccctacccctcccgtacccg

SEQ ID NO: 154488 - DNA, 614 bp, Homo sapiens
  misc_feature: GYAE6OF01AXOBZ.10.38.D05.1.454.CMB.1.raw
  modified_base (306)..(306): a, c, t, g, unknown or other
  misc_feature (306)..(306): n is a, c, g, or t
  modified_base (403)..(403): a, c, t, g, unknown or other
  misc_feature (403)..(403): n is a, c, g, or t
  modified_base (502)..(502): a, c, t, g, unknown or other
  misc_feature (502)..(502): n is a, c, g, or t
  modified_base (569)..(569): a, c, t, g, unknown or other
  misc_feature (569)..(569): n is a, c, g, or t
  modified_base (609)..(609): a, c, t, g, unknown or other
  misc_feature (609)..(609): n is a, c, g, or t
  modified_base (613)..(614): a, c, t, g, unknown or other
  misc_feature (613)..(614): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctcctcgcgtccgggtctcctggacagtcagtcaccatcctctgcactggaaccagcagtgtactttgttgtcttaataacttatgtcttcctggtaccagccaaccacccaaggacctaaacgaccccctaaaattcccgttttggtttttcgacggttccaggttaaagccggtaccctnagggtactaccctgattccggtctcgtcgcctaccaacgttcgtcggactaaccgccggtccctccgtcgacctctcgtggccctcgaggctgaggntcgaagtcctagtacgttactcacgtacacggtcactattacgtcgaccgcccaagtcgggttgttcgggagtccggtaagtacgggtacacgttccgnggtacacgtacgaagctccgaccgtccgtactacgtccttccgtcccgtacctccgtaccacttacncgttacgccgtggtagcccggtcgtagcgttaacgcgtantcgnn

SEQ ID NO: 154489 - DNA, 757 bp, Homo sapiens
  misc_feature: GYAE6OF01BJQEK.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagtcttgggttttccttgttgctatttacaaaaggtgtcctactgtgaggttcaacgtgggtggagacgtgggaggaggcgtggactccgacggccggtcggggggtccctagacgtaccgtcctccgtgttcgcgtacgtccttcgttcgggttcacgctatacgaacgtaaccgactacacgtcgtacccggtccgggccccgcgacggccgtccggaaggggaacgggtcgtgggtagggttcgggttctacgtaagttacgtaacggaaacgtagtagtcgtactacgtaagtaattactttacttctacggtaccgtcggtaacggtaccgggttcccgttaccgtaacccttccgtaaccgacgtaactacccgttaaccttaacccaaactaaccttcgtttaccgtttagttaccttacctacgtacttaagtcgtacctaaactacgttaccgtagggaacgtaccggtaccgggaaccgtaacccggcccgttacccttaacgttacttttaggtcggaaccgtccgaacgtaacctggttaacctaaccggttactcccgttaacgtcggttaccgggccggggaaccggtacggggacccg

SEQ ID NO: 154490 - DNA, 698 bp, Homo sapiens
  misc_feature: GYAE6OF01E059W.10.38.D05.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (493)..(493): a, c, t, g, unknown or other
  misc_feature (493)..(493): n is a, c, g, or t
  modified_base (630)..(630): a, c, t, g, unknown or other
  misc_feature (630)..(630): n is a, c, g, or t
  modified_base (687)..(687): a, c, t, g, unknown or other
  misc_feature (687)..(687): n is a, c, g, or t
tcagcatagtagtgcacgaccggtgctcgatttagtatctgatagttgggggtttgggggggggtctcaggaggcagcgctctcaggacgtcaccaccatggcctgggctctgctccctcctcaccctcctcactcagggcacagggttcctcgggcccagtctcgccctgactcacgtccctcccgtccgcgtccgggtctcctggacngtcagtcacatctctgcacgtacggaaccngacaggtgtactttgtgtacttataactatcgtcctccgtacggtaaccagaccaacccaccgaacggtaaccaaaacccgtaccccctaaactttcgttttacgttttaggacggtacgtaacggtaacggcccggtaccctagacggtacgtcccgtagtacgttccggttactccgtacgtccctacgtacgtcgtacgaccgtaaccgccgtccctccgcgtaccgtcgttcggtacggtcctaccggnggtctacggtagtagtacggaggtctagttaacttactacgtcgactacgctattacttacgtacgaccggtacccgagtgggttcggtcgggacggacggtactacgggtccggtacccgttcggacgggtacccnggacccgtagtcccgtccccgaacccggttctaccgtccttccgttacccgtccccncccgttacccg

SEQ ID NO: 154491 - DNA, 740 bp, Homo sapiens
  misc_feature: GYAE6OF01AGZW0.10.38.D05.1.454.CMB.1.raw
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacgagggtcctgggcccagtctgccctgactcacgcctccctccgcgtccgggtctccgtggacagtcagtcaccatcctcctgcacgtcggaaccagcagtgtacttttggtgtacttaataacctagttcgtccttccgtggtaacccagacccaaccaacccgaacggaacccaaaaccgacccccctaaaacgtttcccgttttaggttttacggaacggttacgtaaggtaacggtcccggtccctacggaacgggtacctcccgtagtacgttccggttacctcgtcgaccctaccgtaagtcgacggacaaccgccggtccctccgtcgaccgtctcggtcggcctaccgaggctaggaggtagtacggaggtctaggttaacttaccgtacggtcgacgtacgtcacgttataccgtccgaacccggtaacccaaggttcggggttcggtacgggaccgggtacggaaccggttaagggtccgtaccggttccggtacgggtcgaaccggtaccccgggtaaggtccccgtaccccggtccccgtacggttccctaccggttccgttacccggtcccccggtcccttaccccg

SEQ ID NO: 154492 - DNA, 1049 bp, Homo sapiens
  misc_feature: GYAE6OF01D0WUB.10.38.D05.1.454.CMB.1.raw
tcagcatagtagtgcacgaccggtgctcgatttagtatctgatagttggggtttgggggggagaggacgcccagcacgtgggattccgaggttgtttccattcggtgatcagcactagaacacgagaggactcacagtggtagttttggctgagtcgttgggtttttccttgttacgtacgtttaagtttacgtaaaaaggtcgtacctacgttgttaggtacggtttaccaacgttgggtagggtacgtaaccggtggggaagggtacggcgttagggacctaccgtaccgggtcccgggttcggggggtccctaggacgtaccttccgttccgtcgtcgcgtaccgtcccggttacggttacgggttacaacggtactaacgtacgtaaacgtaaaccgtacgttaacgtacgtccggtacccggtcccggcccgtaccggacggtaccggtacgggaacgggggtaacggggtcgttacgggaggttccggttacgtacgtttaagtttaacgttaacgaaacggtaggtaacgtaaggtaaccttaaagttaacttaagtttaactttacgtttacggtacgttaacccgggttacgggttaaccggggtaacccgggtttccccggtttaacccctacccgtttacccgtaaaccgtaaacgggtaacccttaaacccgtttaaccccttaaacccttaaaaccggtaaacccttttaggttttacccccgttttaaggttaacccgttttttaccccaagttaacccgtaccgttttaacgaacccgtttaaacgttaacccggtgttaaaccggggtacgtaaccgggtaaccccgtaacccgaacggtttaacccccccggtacctttaaaacccggttggtttttaaacgtccccgggtaaccgtaacccggtaaaccgggttaacttaaccgggtaaacccgttacccggtttaacccccggaagttttacccccggtttaaggggtacccccgggggtaccgggtaaaccccggggtaccccggttaaacccccgggg

SEQ ID NO: 154493 - DNA, 742 bp, Homo sapiens
  misc_feature: GYAE6OF01DF3NR.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttcaaaaggtgtccatgtgaggttcaacgtggtggagactgggaggaggctggatccgagccggtcgggggtccctgacgtactcgtcctgtcgcacgtcccgttcgttacgggttcaagctacgtacaacgttaacgacctaacgatcggaacccgtccgggggaccccgaccggacggtccgtacccggaagggggaacggggtcgtaggggtaacggttcgggtactacgtaaggttacgttaacggaaaccgtagtagtcggtacaacgttactaaattactttaacttcgtacgtaccgtaccggtacggaaaccggggttcccgttaccaccccttacgaccgtaagaaccgtaacctaacgttacccaaactaaacgtcttacgttagttaccttcctaacgtactaacgtcgaacctaactaaacgtcgtaacggtaacgaacggttaccgaacccgaagtaccccgtaaccctaaacctttagttaaagttcggacgaccggtacaacggtacttacggacctaccgtctaacttaccggttgggaccggggccctaaacggggg

SEQ ID NO: 154494 - DNA, 812 bp, Homo sapiens
  misc_feature: GYAE6OF01ER17P.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagtcgttgggttttccttgtttgcttatttacaaaaggtcgtccactgtgaggttcaacgtggtggagacgtgggagggaggcgtggactccgacggtccggttcggggggtccctagacgtaccttccgtccgtgtcgacgacgtccgttcggttcgggttccgagcgtaacgtaccgtaaacggtaaccgtaacgtaccgtaacgtaccggtaccccggttcccggggacccccgaccggtaacgggtaaccggtacccggggaaacgggggggtaacggggtcggtaggggtacgggttacgggttaccgttacgttaacggttttaagttaacggaaacgtacggtaacgtaccggacgtaacttaaactatttaacgtttacgttaccgttacgtaccgttacccgggtacggtaaccggggttccccgttaccgtaccccttcgtaaccgacgtaaccgaccttaacccgtacccaaacgtacgttactttccgttacgtacttcctacacctataccactaactacgtcgaggtacgacgtaccgtaaccgccgtaaccgacccttacgttaattcgttacggacgtaccgacgttaagtactacggtacctacgtaccgtaacgttaggttacccggcgggtaccggacgggtacccgg

SEQ ID NO: 154495 - DNA, 775 bp, Homo sapiens
  misc_feature: GYAE6OF01CLJGP.10.38.D05.1.454.CMB.1.raw
  modified_base (241)..(241): a, c, t, g, unknown or other
  misc_feature (241)..(241): n is a, c, g, or t
  modified_base (321)..(321): a, c, t, g, unknown or other
  misc_feature (321)..(321): n is a, c, g, or t
  modified_base (701)..(701): a, c, t, g, unknown or other
  misc_feature (701)..(701): n is a, c, g, or t
tcagcatagtagtgcacgaccggtgctcgatttagtatctgatagttgggtttggggggagaggagcccagcactgggattccgaggttgtttccattcggtgatcagcactagaacacagaggactcaccagtggtagttttggctggagtcgtttgggttttccttgttgcttattacgaaagtcgtacctatgtagtaggttcaacgtgggtaggagacgtgggaggaggctaggacnccgtacggccggttcgggggtcctagtacggtccttccgttctaggtcgacgtcgtccttggtcggtcactcgtacgtanaacgtacctacacgtcgtaccgccggtcccgggccccacggacggtccggaccgggtagggggaacgggtcggtacgggtacggtggttccttaaggtagttaaacgttacggaaacgtaggacggttacacgtaaaccttagttaatttaccgtttacttacggtaccggttaccgtacggggacggtaccccgggtttccgttaccccgtaccgtacccggtacgaaggtaaccctaccgtaaccccttaaccccaaagttacctacggtttcttaccggtacctttacgtcctaacgtactcgtaacccaattcgcgtttaacggacggtaacgtacccgaacgacgggtaccctacttactaacgtttggtcccgngtacgtctagttaccaacgttacgtacccttacggtaccggtacgttacgggggtcccgacgggttcgacccgg

SEQ ID NO: 154496 - DNA, 848 bp, Homo sapiens
  misc_feature: GYAE6OF01BW927.10.38.D05.1.454.CMB.1.raw
  modified_base (177)..(177): a, c, t, g, unknown or other
  misc_feature (177)..(177): n is a, c, g, or t
  modified_base (199)..(199): a, c, t, g, unknown or other
  misc_feature (199)..(199): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgaggtcctgggcccagtctgccctgactcagcctcccnccgcgtccggtctccgtggacngtcagtccacctactcctctgacctacgtcggaaccagccagttcgtacttttgttggtactttaataacgttacttcgttccgtccgtacggtaccacgaccgaacccaacccgtaaggaaccctaaaccgaaccccccctaaacgtttccggttttagtttttaggacggttaccgaggttaaccggccggtccctacgtacggtaccgttccgtcgtacgtttcccggtttctccgttaccgtccgttaaccgaacggttccgttacggaccgaaacccggttacccggtccccgttaccccgtcggttaccccgttccgttaccgggtcgggtcccttaccgacgggtaccttagggggtagtaacgggtaccggtacggtacgtttaacggtaactttaccgtaacggtcgaaccgtcggtaaccgcgttaaagtttaccgtacccggaaccggtaccccgggtaaggttacgggggtttcggttacggggtcccggggtaacgggtaccgtttaagggcccgttacccgggttcgacggggtacccgtacggtaccccggaggttcccgaccccgggttacccccgtcggttacccgtacccgttccccgggtttacggccccccgtttaccccccgttaccg

SEQ ID NO: 154497 - DNA, 966 bp, Homo sapiens
  misc_feature: GYAE6OF01AE59G.10.38.D05.1.454.CMB.1.raw
tcagcatagtagtgcacgaccggtgctcgatttagtatctgatagttgggtttggggggggtctcaggaggcagcgctctcaggacgtcaccaccatggcctggctctgctcctcctcaccctcctcactcagggcacgagggtcctcgggcccagtctcgccctgactcacgcctcccgtccgccggttcccggtctccgtggactagtcacgtcaccatcctcctcgaccaacgtacggaaccacgacgtaggtacgtacgttttggttcgtacttttaagtaacttacgttccgttccttacccgtacgggtaccgaacgtacccaacccgaacccgacggaacccgaaaccccgtaaccccccgttaaaccgtttcccgtttttacggttttttacggacggttaccgtaaacggttaccggtacccggtaccccgttacggacgggttacccgttccccgttacggtaccggtttcccggtttcccgttaccgttacccggttaccccgttaaccccggttaacgttcccggtaacccggaaccccgtaaacccggttacccccggtcccccgttacccccggttacccggttaaccccccggtttccggtttcccgggtcccgggtaccccgttaccggtaccgggtaccggttacgggaacgggttacgggtacggtacgggtaccgttacgttaaaccgtttaccgtacggtagaccgacggtaccgtacgtaacttaaccggtaccggacccggtaacccggtaagggttacggggtttcggttacggggaccgggggtaacccggtacgggttaaccgggttaccggtcccgggttaccggtaccgggtaaccgtacccggaccggttacccggtcccgtcccccggtacccccggttcggtacccttacccggttccccgttaccccgtttccccccgtaccccgtttacccccg

SEQ ID NO: 154498 - DNA, 696 bp, Homo sapiens
  misc_feature: GYAE6OF01DWCTM.10.38.D05.1.454.CMB.1.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
tcagcatagtagtgcacgaccggtgctcgatttagtatctgataggttgggtttggggggggtctcaggaggcagcgctctcaggacgtcaccacatggcctgggctctgctcctcctcaccctcctcactcagggcacagggtcctgggcccagtctgccctgactcagcctccctccgcgtccggtctcctggacagtcagtcaccatctcctgcactgaaccngcagtntactttgtgcttataactatntctctggtaccagcaccaccaggacaaacgccccctaaacttcctttgtttttgacggtcagtaacgccggtccctcgaggactcccgtgtacgttccggttctccgtgacccttaccgaaacgttcgtcggaccaaccgaccggtccctcccgtacgacccgttcgtccgtacgggcctccgaggtctaggacggtagtggaggtctagtacttactagtcgacgagcgtactaagttacctccgaacggacccctaaggtacggggtttcggtttcggggaccgggtaccggggtaacgttaacgggtcgtacccggttcccggtaggggttacccgaaccggttaaccccggaacgggttcccgttacccgggtcccccccgttaacgggtcccttaaccgttcccgttccccgttaccccccggtccccttaacccccg

SEQ ID NO: 154499 - DNA, 752 bp, Homo sapiens
  misc_feature: GYAE6OF01AVOFU.10.38.D05.1.454.CMB.1.raw
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (565)..(565): a, c, t, g, unknown or other
  misc_feature (565)..(565): n is a, c, g, or t
tcagcatagtagtgcacgaccggtgctcgatttagtatctgatagttggggtttggggggagaggagcccagcactgggattccgaggtgtttccattcggtgatcagcactagaacacagaggactcaccagtggtagttttggctgagtcttgggttttccttgttgcttagtttacaaaaggtctccatgtgtaggttcaacgtggnggacgacgtggaggaggctggactccgacgtccggtcggggtccngacgtctcgtctgcncacgtctacgtggtcagactacacgtagtaacgactacgagtcggtacccggtccggaccccgaccggcggtacccgtacggaagggggacgggtcgtagggtacgggttcggtacttacggtaacgtttaacgtaagaaaaccgtaggtacggtacgactaacctaacgttaatttacgttttacctcgtaccgtaccgtacgggtacggtaaacccgggttcccgtacctacccgtctaaccgacgtaccaaccttaccctaacaaacttctagttccttagttaccttaccnctatctacgaacctaataacgtccgtaaaggacaaccggtacgaacccttacccgacgttaaccccgtttataacgttttcggggcgaccggttcccgaaacgttaccgtacggttccgttaaccgtacccttacggtaaccccttagggtttccccggggacgggaaccgtacccggggtaccccc

SEQ ID NO: 154500 - DNA, 921 bp, Homo sapiens
  misc_feature: GYAE6OF01BAIQ9.10.38.D05.1.454.CMB.1.raw
  modified_base (235)..(235): a, c, t, g, unknown or other
  misc_feature (235)..(235): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggtagtttttggctgagtcttgggtttttccttgttgcttatttacaaaaaggttgtcccactgtggtaggttacaacgtgggtggagacgtgggaggaggcgnggatccgacgtccggtcggggggtcccctaggacgtaccgtccttcccgtaggtcggcctacggtcccttacggttcggggtttaccacggacctaacgttaccgtaaaaccggttaaaaccgtaaccttaaacctacgtaccggtaaccccgggttcccgggggaccccccgaccggaccggggtacccgtaccccgggggaaacggggggaacggggggtccgttaggggtacggggttcggggttccgtttaaccgttaaaggtttttaacgttaacggtaaaaccgtacgggtaacgttcggaaccttaaacgtaaaccttaatttaacttttaacttccgtaacgttacccggttacccgggttaacgggaaacccggggtttcccgtttaaccccacccgtttcctacccggaaggttaacccgtaaaccctttaaccggttaaccccaaaacctaacttactttaccggttttattaccgtttacccttactaactactcctaacaacgtaacttgaacgtacggtaaccgttacccggaaccgtaccgaaccggtacccttaacgttaattcgggtttacaccgggtacccgtaccgtaacacggttacccaccgttaaccggtccttaacccggttaggttccccggggtacgggacccgggtacgggtacccccgg

SEQ ID NO: 154501 - DNA, 837 bp, Homo sapiens
  misc_feature: GYAE6OF01CH2KE.10.38.D05.1.454.CMB.1.raw
  modified_base (578)..(578): a, c, t, g, unknown or other
  misc_feature (578)..(578): n is a, c, g, or t
  modified_base (617)..(617): a, c, t, g, unknown or other
  misc_feature (617)..(617): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccagtggtagttttggctgagtcgtttcgggtttttcctttggtttcgtactttaattttaacgaaaagggttcgtacctacgtggttaggtacggtttacaacggttgggtagggaacgtacggtagggagggacgggcgtacggactccggacgggtcccggggttacgggggggttacccctagggaaccgtaccgttccgttccgtggtcgccgtacggttcccgttacgggtttcggggttaccaaggccttaagtaccggttaaacgtaaccgtacctaacgtacggttccgggtacccggtcccgggggcccccgaccggacggggtccggtaaccggggaagggggggtaacgggtcgggttaggggtacgggttcggggttaccttacgttaaggtttacgttaacgaaacggagacgtacgactaactacttaatactttntacgtcgtccgtacggtaggacccggttccgtacctccncgtacgacgtacgtacctaacctaaccaactactaacttcgtttacgttcttacctactactactaccgactaactaacgtcgtaagggacgtaaccgtaccggaccgaacccgtacggtaccccttaagttacttacggttgacggtaccgacgttaacacggttacaccggtcgttacctacggttaacgtggggacccggtacgggcggtaacccgg

SEQ ID NO: 154502 - DNA, 803 bp, Homo sapiens
  misc_feature: GYAE6OF01EUGLB.10.38.D05.1.454.CMB.1.raw
  modified_base (251)..(251): a, c, t, g, unknown or other
  misc_feature (251)..(251): n is a, c, g, or t
  modified_base (621)..(621): a, c, t, g, unknown or other
  misc_feature (621)..(621): n is a, c, g, or t
tcagcatagtagtgcacgaccggtgctcgatttagtatctgataggttggggtttggggggggtctcaggaggcagcgctctcgaggacgtcaaccaccagtcggccgtggcttctgttcctcctctaccctctcacgtcgaggcaacgtcgggtccgtcggacctcgtctcgccttaggactcgcgtccctccgtccgccggttccggtcctccgtggaacgcggtctacgacctaccgtctccgttccngacctacgtaccggaaactcgacgttacggtctttacgttttgttaacgttaacttttaaactaacgttcgtttcgtcctttaccgtagttaacccggaccggttaaacccaccggtaaccgaaacgacccgtaacccgtaaccccttaaacgtttccgtttttagtttacggtaacgtcgtaacggttcgcccggtcctacgacggtactccgtgtccgttaacggttctacgcgtacctacgcgttacgtacggaaccgacgtccggtcctcccgtcggcccgttcggccttacgggccgttaccgtacggttacggtagtacgtacggtacgcggttacgttacgtactacttacgtcgtacgtcgngtactacgtaccgtaccggaccgtaccggtaacgttcgggcggttaccgggtcggaacgggttacggtacggtacggtaccggttacggtcggaccgtacggcccgtaaaccggtccgttccccgggtaccgtccgttccgttcctacccgttcccgttcccgtccccgttaaccggtaccc

SEQ ID NO: 154503 - DNA, 855 bp, Homo sapiens
  misc_feature: GYAE6OF01C0I3Z.10.38.D05.1.454.CMB.1.raw
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
tcagcatagtagtgcacgaccggtgctcgatttagtatctgataggttggggtttggggggggtctcaggaggcagcgctctcgaggacgtccaaccaccagtcggcctgggctctgctccctcctccaccctcctcactcgagggcacgtcgggtcctcgggaccctagtctcgccctgacctcgacgtccctcccgtccgtccggtcccggtctccgtggactacgtccgacgtaccacctacttcctctcgaccacgtacgaaccagcgtagtcgttactttggtactatttaactaacttcttcgtaccgtcgtacggtaccacggacccaccgaaccgtacggaccctaaacccgtaccccttacgtttcgttttgtttacggacgtacgaacggtaccggccgtacccgtaggaccgtacccgttccgtgtaccgtttccgtctacggtacctctaacgtagttccggacgaacctaccggtccctacccgtcgaccgttacgtcgtaccggccgtaccncggngtgtagggaacgtcgtggtacgtactaacgtttactaccggtcgaacgccgtacgaacgttacgttacggttccaaaccccggggtaccggaaaccggttgggggtttacgggggttaccgggtcccgggggaacggttaacccggggttaagttaaccccgggggtcctacccggggtttaccggacggaacccccgttaccgggaaccccccgggtttggcccccccgttttccccccgggggaacccttacccgttacccggtttacccccgttaccccgtttacccccccgttaaacccccgccccgtttttaaacccccg

SEQ ID NO: 154504 - DNA, 729 bp, Homo sapiens
  misc_feature: GYAE6OF01CCTXH.10.38.D05.1.454.CMB.1.raw
  modified_base (110)..(110): a, c, t, g, unknown or other
  misc_feature (110)..(110): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (603)..(603): a, c, t, g, unknown or other
  misc_feature (603)..(603): n is a, c, g, or t
tcagcatagtagtgcacgaccggtgctcgatttagtatctgatagttgggtttggcggggagaggacgcccagcacgtgggacttccggaggttgtttccagtttcggtnatcagcaacgtagaacacaaggacggacctaccgaaccgtagttgggtacgttttgcgtagcgttcgtttggttttccttgtctacttatttacgaaaggtcgtccagtgtaggtagtacgagtaggnggagtacggtagggacggngcgtacgactccgggacggtccggggtcgggtaccaggtactccgttctacgtcgtacgacgcgtccgttggtcgtcagtctagtaacgaacgtaaccaactcgtacgtccggaccgtcccggaccacgggtacgaccgggtacggaggggtaacggtcggaggtacggttccggtaattacgttaagttaacgaaacgtaacggctagaccgaactactaagtacttactttcgtacgtacgtaaccggtcggtaaccggtaccgttaccgtccctaccgtcgaacgacgtacctacaactaacgactacgtatactagtactcctacgtatacagaactacgtntacgaagtaccgtagaacccgtacgacccgtacttaccgagttacgttcgacgtcgtaccaagtacctaacggtcccacggttaacgtaccgtcgtaaccggtcgggtacggaacccggtaaccgg

SEQ ID NO: 154505 - DNA, 890 bp, Homo sapiens
  misc_feature: GYAE6OF01BUK0S.10.38.D05.1.454.CMB.1.raw
  modified_base (190)..(190): a, c, t, g, unknown or other
  misc_feature (190)..(190): n is a, c, g, or t
  modified_base (817)..(817): a, c, t, g, unknown or other
  misc_feature (817)..(817): n is a, c, g, or t
tcagcatagtagtgcacgaccggtgctcgatttagtatctgataggttggggtttgggggggagaggacgcccagcacgtgggattccggaggttcgtttccattcgggtgatcagacactagaacacgagacggacctcaccgtagtgggttagttttggctgagtcgttttcgggttttccttggttntaccttagttaacgtaaaggtcgtacccgtagtggtaggtacgttaccgaacggttgggtaggacgtacggaggggagggtacggccgttaggtaccgtaccgtacgggtccgggtttgggggttcccttacccgtagggtacctccgttccgttcggttacggtcgtaccgacccggttccggtttacggtcggtacgactacgtaacgttaccgaaacgtaaccgactaacggtcgtaccggacccgggtcccgggaccccgcgtaccgggcccgggtaacggggaacggggggtacgcgggtagggtaccggttcggttacgttaagttaacggtttaagtacggaaacgtggtgtacccgtaataaccgttataatttacgtttaactccggtaacgtttccgggacggttaacgggttacccgggtaccttaccctaacccgtaccgaacgaacgtaacccgtacccgtaaacccgttaaccaaacttaccgttacttacgtttcttacctctaacgtactacgtacgaacttacgtaatcgtacggtacgaaccgtcccgtacgtaaccccgtacggtaccctttaacggttacgttccggttacggacctaccgggtaanacccgttagtaacccgtactttaccggtccttaaacggttccgggtaccgggacggtacccgggtaacccggg

SEQ ID NO: 154506 - DNA, 770 bp, Homo sapiens
  misc_feature: GYAE6OF01EV66E.10.38.D05.1.454.CMB.1.raw
  modified_base (166)..(166): a, c, t, g, unknown or other
  misc_feature (166)..(166): n is a, c, g, or t
  modified_base (208)..(208): a, c, t, g, unknown or other
  misc_feature (208)..(208): n is a, c, g, or t
  modified_base (767)..(767): a, c, t, g, unknown or other
  misc_feature (767)..(767): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctcgcgtccggtctcctggacagtcagtcacatctccngcacgtggaaccagcagtgtactttgttgactttaataactnttcgttcctccgtaggtaccagacctaacccgaccgagggaccaaaccgtcccccctaaaagtttccgtttttaggtttttacggaacggttacgaaggttaaccggcccggacccttacgacggtaccgttccctaggtacgtttccggttactccggtctacctacgtactcgacgtacaccgtaccggtaccctccggtacgtaccgttcgtacggtccggtccctacggtaccggtcgtagggtaacgtaggttacggacggtacgttacgttaaccgttacgtacgtcggacgaccgggacttactaacgtttacgaccggtaacccggtaacccgtaagggttacgggtttacggttacgggaccgggtcggtaaaccgtaggggttcccgtaccggttcggtacggtacgaaccggtacccggtacgggtcccgtaccccgtacccggttcgtaccgttacgttcccgttacccgtccctacccgtcctacctaccttcgtacgacgtccggaggtaccggcgtacgggactaccgaggtaccaagtctcgntcg

SEQ ID NO: 154507 - DNA, 819 bp, Homo sapiens
  misc_feature: GYAE6OF01ATFB9.10.38.D05.1.454.CMB.1.raw
  modified_base (308)..(308): a, c, t, g, unknown or other
  misc_feature (308)..(308): n is a, c, g, or t
  modified_base (454)..(454): a, c, t, g, unknown or other
  misc_feature (454)..(454): n is a, c, g, or t
tcagcatagtagtgcacgaccggtgctcgatttagtatctgatagttgggtttggggggagaggagcccagcactgggattccgaggtgtttccattcggtgatcacgcactgaacacagaggactcaccagtggtaggttttggctgaggcttcgggttttccttggttgcttatttacaaaaacgggttcgtcctacgtggtaggtacgttcgtaactgggtggacgtacgtgggagggagcgtaggatccgacgccggtcgggggtcctagacgtactctcgtgtcgacgcgtctcggtcggttnacgctacgtgtaaccgtaacgtaactaacgacgtaccggtacccggtcgggtcccccggccgaacgggccgtaccgggaagggggacgggggtcggtacgggttacggtggggttcctacggtacggttttaggtaaacggtaacnggtaacgtacgtaccgaaacttacgtaacgtttaatttacgttactacggttacgttaccggtaacgggtacccggtcccgggttacctaccccggtcgttaccgacggttaaccgtaccttaccttaacccgaaacctaaacgttcctttacgtttacgtacgtttaccccgttaaacgtacgttacctacgggtaacttaccgtaaacttcgggtaacgtacgggtaacccgttacaaaaccgggttcaacccggaacctttccgttagtttacgttccgtacggtaaccggtacctatacgtaccgttaccgacgtttaactccggtaacccgttaggtcccggggacgttaacgggcccgg

SEQ ID NO: 154508 - DNA, 868 bp, Homo sapiens
  misc_feature: GYAE6OF01BUFNW.10.38.D05.1.454.CMB.1.raw
  modified_base (196)..(196): a, c, t, g, unknown or other
  misc_feature (196)..(196): n is a, c, g, or t
tcagcatagtagtgcacgaccggtgctcgatttagtatctgatagttgggtttgggggctctgctcctcctcaccctcctcactcagggcacgagggtcctgggcccagtctgccctgactcagcctccctcggcgtccgggtctctggacagtcagtcacatctcctgcactggaaccagctagtgtactttgtntacttaataactatcgtctcgtgtaccacgaccaacccgaccgaggaaccaaccgtaccccctaaacttccgtttagttttacggacggttacaacgggtaacgcccgggtaccctaggtaacggtaccttcccgtaggttacctttccggttccttctacccgtcccgtaccgtaaaccggttcgaccggtaaccctaaccggtacccggtcccttaccccggtacggtaaccccggttccgggtaccccggtcccgtcccggaaggtccgtacggtacggggtacgtaggggtaccgttacgttaacggttaaccttaacggttacgtaccggaccggtacgtaccgtaacgttaacgttaccggttaacccggacccgggttacccggttaacggggttacggggtttacgggttccgggtacggggtacccgggtaacggttaaccgggtacccgggttaccggtaaccggggtcggtacccggtaacccggaccggtacccggtaccggttcccggtacccgttcccggtacccgttaccggttaacccgtttccccggttaccccttaccccgttaccgttaaccctccgttaactcccgttacggtaccgtcgggtaccgggtccggtcggtacggacggaaccgtcgaccggttaagcgcgtgc

SEQ ID NO: 154509 - DNA, 826 bp, Homo sapiens
  misc_feature: GYAE6OF01CB2Z9.10.38.D05.1.454.CMB.1.raw
  modified_base (722)..(722): a, c, t, g, unknown or other
  misc_feature (722)..(722): n is a, c, g, or t
  modified_base (784)..(784): a, c, t, g, unknown or other
  misc_feature (784)..(784): n is a, c, g, or t
tcagcatagtagtgcacgaccggtgctcgatttagtatctgatagttgggtttggggggagaggagcccagcactgggattccgaggtgtttccattcggtgatcagcactagaacacagaggactcaccagtggtagtttgggctggaggtcggtattttccgttgctgtactaaagttttaaagtgtccgagtgtgacgtgcgtaggttgggtaggtaggttcggtaggggggtaggtacgttttggggtaaaccggggtcccgggggggtttaccttaacggtaccttccgtttccgttggttaccgtacgtcccgttcgttggtacttccgagttacgtacctaaccgtaaccggtcctagggtatcggtacggtccggtcgggtccccgaccccggtaaccggtccccgggaagggggtacggggttacggtggggttacgggttcgggttacggttaccgttttaagtaacggaccgtacgaacggtaccgttaggtaggttacgggacggaacctaaggtaacggtaacggtacccgaggttaacgggttaaacgtttaaacgggaaacgggtacgttaacggtaaccgttaccgaccgttacttacgttaacgtaagttaggacgttaagaaacgttaaccggaaaacgtacccgttagtacgttacgtaacgttaaggacgtacggactacggtacggaaccgtagggaaacncgaacgtcaacggacgtatacttagttactagtacctaacgtaacgacgtaccgaacaaggngtaccgagggtacggaggtcgtaggcggacgggtcgtaccgg

SEQ ID NO: 154510 - DNA, 671 bp, Homo sapiens
  misc_feature: GYAE6OF01BVF0D.10.38.D05.1.454.CMB.1.raw
  modified_base (200)..(200): a, c, t, g, unknown or other
  misc_feature (200)..(200): n is a, c, g, or t
  modified_base (630)..(630): a, c, t, g, unknown or other
  misc_feature (630)..(630): n is a, c, g, or t
tcagcatagtagtgcacgaccggtgctcgatttagtatctgatagttgggtttggggctctgctcctcctcaccctcctcactcagggcacagggtcctgggcccagtctgccctgactcagcctcctccgcgtccgggtctcctggacagtcagtcaccatctcctgcactggaaccagcagtcgactttgtgcttaanaactagtgctcctggtaccagcaccaccaggacaaacgccccaaactcttgtttttgaggtcaggtaagcggtcctcagggtactccgtcgattcggttcctctacggccttaccgaagttcgtacggaccaacaccgggtcctccccgtgtacccgtctcgttcggcttccgaggtcctaggaacggacgttggaacgggtctggtaaccttaacgtaacgtggaccgtaagtccgacgtaaacgttcttaccggaaccggtaccccccgaaggttaaccggggtggtttacgggaccgggtacgggtaagttaacgggtcgtaacccgttcggtacgggttaccaggacccgaagccgtaccggccccgtggttaccgacttcccgtacgtcccccacccgttacctcctaccgttaccatcggtacngtacggccgggtactcggacgtagccgacgtagacctgaac

SEQ ID NO: 154511 - DNA, 712 bp, Homo sapiens
  misc_feature: GYAE6OF01EIATP.10.38.D05.1.454.CMB.1.raw
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (277)..(277): a, c, t, g, unknown or other
  misc_feature (277)..(277): n is a, c, g, or t
  modified_base (329)..(329): a, c, t, g, unknown or other
  misc_feature (329)..(329): n is a, c, g, or t
tcagcatagtagtgcacgaccggtgctcgatttagtatctgatagttgggtttgggggggtctcaggaggcagcgctctcaggacgtcaccaccatggcctggctctgctcctcctcaccctctcactcagggccacgagggtcctgggcccagtctgccctgactcagcctccctcgcgtccggtctccnggacagtcagtccaccntctcctgcactggaaccngctagtgacttttgtnacttaataactatgtcctcgtgtaccagtccaccnccagaccaaacgcccctaatcctttaggttttgagttcagtagccgtacctnaggtactcctgactcggttctcgtcgtccctacgtaacgtcgtcggactaaaccgtccggacccttccgtacgtaccgtcctcggtcgggtccctacgacggtccaggtaggtagtggacggtccttagtaaacgttaccgttcgtcggtcgaacgccaagtacttaccgttcggaacccgtaacccggtaagtacggggtttcggttacgggaccgggttacgggtaacgttaccgggcgttaaccccggttccggtggggttaacccgaaccggggttacctaaacccggggttcccttacccccgggtacccccgttacgggtttacccttaaccgtttccccttacccccggtttaccccctaccccccgttaaccccg

SEQ ID NO: 154512 - DNA, 793 bp, Homo sapiens
  misc_feature: GYAE6OF01A4GYD.10.38.D05.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacngtcagtcaccatctctgcactggaaccngcagtntactttgtnacttanactatgtctctgtaccagccaccaccaggaccaaaccgaccccctaaacttcctttagttttagaggtacaacgttaaggcccggtccctacgacgggtacgtccctagtactttccggttctaccgtcgtccctaccgtaacgtccgtacggacctaaccggaccgtccccgtcccgtcggtaccccgtcgttccggtcggtaccctccggacggtccgttaggacggtagtacggacggtcgttacgttaaccgtttacttaaccgttcggaccgtacggtaccgtaccgtaatttaacccgtttaccggaacccggtaccccctaaaggggttacggggtttccgggttttacggggacccggggtaccgggtaaaccggttaacggggtccggttaccccgggttacggtaccggggttacccgaaccggtaccccggtaaacgggtcccgtttaacccccgggtcccccgttaccgggttacccgtaaccgtttcccccggttacccggtttcccccccgtcccccgtttaacccccg

SEQ ID NO: 154513 - DNA, 763 bp, Homo sapiens
  misc_feature: GYAE6OF01DFBJV.10.38.D05.1.454.CMB.1.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
tcagcatagtagtgcacgaccggtgctcgatttagtatctgataggttgggggtttggggggggtctcaggaggcagcgctctcaggacgtcaaccaccatggcctgggctctgcctcctcctcaccctcctcactcagggcacagggtcctgggcccagtctcgccctgacctcagccctccctccgcgtccgggtctccgtggacagtcagtcaccatctcctgctacgtacggaaccngctaggtctacgttttgtntactttataaacttgtcgttcctccgtaggtaaccaacgtacccaaccaacccgaggaacccaaaaccgtacccccctaaaagtttcccgtttgtttttacggaacggttcgtaacggttaaccgccggtccctacgaacgggtccgtccgtagtacgtcccggtttctccgttcgaccccttacgtacggtcctacgggactaaaccggtccgtccccgttccgtaccgtccggttcgtcggttccgggacctcggacgtacgtagggtaacgggtacgttacggacgggtcttaacgtacgtttacgtaccgttacggacgtcgtacgaccttaacttacggtacccgaaccggtacccgtaacgggttggggtcgtccgggggaacggtcggtaccggtacggtcgtacccggtcggtacggtaccgtaccgtaccggacggttccgtccccggtccctacggtcctaccgttcccgtacccgttcccctcccgttaccc

SEQ ID NO: 154514 - DNA, 794 bp, Homo sapiens
  misc_feature: GYAE6OF01CBMY8.10.38.D05.1.454.CMB.1.raw
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
tcagcatagtagtgcacgaccggtgctcgatttagtatctgatagttgggtttgggggctctgctcctcctcaccctcctcactcagggcacgagggtcctgggcccagtctgccctgactcacgccctccctcgcgtccgggtctccgtggacagtcagtccaccatctcctgcactggaaccngcagtgtactttgtnacttataactntcgtctcgtaggtaccagccaccaccgacgacaaaccgtacccctaagttccgtttgttttgacgtcgaagtacgccgcctagacggtacttccgtagtacgttcgttctcgcgtacctaccgagttcgacggaacccaaccgtacccggtcctacccggtcgtacccgttcgtacggccggtccttacggagggtcctagggaacggtagccgggtagttccgttaagtaactttcgacgtacgacgacggtactaactacttacgtaccggaacccgtaccgggtaacggtttagggggtttggttccggggaacggggttaaccggggaagttaaccggggtccggtaacccgttccgggtaacgggactaaccccgggtaaccggaccggtcccgttaacccgtcccccggttaccgttacccgtccgtttacccggttacccccttaaccgttcccgttccccgtaccccggttttaaccaaccccgtttacgacggtttacccggacggttacggggtacccgggtcccgggtacggttaacggacccggtacgggaaccctacggtaatccgtacg

SEQ ID NO: 154515 - DNA, 883 bp, Homo sapiens
  misc_feature: GYAE6OF01AYPAD.10.38.D05.1.454.CMB.1.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
tcagcatagtagtgcacgaccggtgctcgatttagtatctgataggttggggtttggggggggtctcagggaggcagcgctctcgaggacgtccaccaccagtcggccgtgggctctcgcctccctcctccaccctcctccacgtccgagggcacgacgggtccgtcggcccagtcgtcgcccgtgctcgaccncccctccgtccggtccggtcccggtctccgtcggactacgtcgtacgtaccacctagttcctcccgtagaccgtacgtaccgggaaaccncgtacgttagttcgtttacgttttggttacttaacttaacttacgttcttccgttaccgttaccgtaccggtaccgaccgtacccaaccgaacccgaaccggtaaccctaacccccgttaccccgtttaaccgttttcggttttacggtttacggtacgttaccgtaacggtaccggcccgtaccgtaccggtaacggttaccgttccgttacggttcgttccgttaccgtccgttaccgtcccgttaacggttacgtacggacccgtaaccgcccggtacccgtacccttaccgtaccggttccgtcgtaccggtccggtcgtccggtacgtacggtacggacggtacgtcggtcgtacgtacgtaacgtaccgtacggtcggaccgtacgtaccgtacgttacgtacccgtacccggtaccgtaaccgggtacgggttacggggttacgggttacgggtacgggtaccggtacggtccggtaccggtccggttaccggtacggtaccggtaccgggtaccgtacccggtcccggtacccggtccctcccggttacccgttaccgttaccccgttcccggttccccgacccgttaccg

SEQ ID NO: 154516 - DNA, 624 bp, Homo sapiens
  misc_feature: GYAE6OF01AFZ4W.10.38.D05.1.454.CMB.1.raw
  modified_base (68)..(68): a, c, t, g, unknown or other
  misc_feature (68)..(68): n is a, c, g, or t
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (543)..(543): a, c, t, g, unknown or other
  misc_feature (543)..(543): n is a, c, g, or t
  modified_base (560)..(560): a, c, t, g, unknown or other
  misc_feature (560)..(560): n is a, c, g, or t
tcagcatagtagtgcacgaccggtgctcgatttagtatctgatagttggggtttgggggggtcgtcgnggaggcagcgctctcaggacgtccaccaccatcggcctgggctctgccttcctcctccaccctcctcactcgagggcacgacgggtcctgggcccagtctcgcctcgactcgncccgtccnccgtcggtcccggtctccgtaggaccngtcagtcacctctctccgtgacctcgtagaaccacgtntgtcgttatttcggttntacttataactgtnttcctacgtgtaaccgtcgaccctaaccgccgagacctaaccgaccctaaccgttcttgtttcgacgctaggtacgctaccgngtacgtaggtcncgtagttcgttctcgtctctacgatccgtgaaccacggctcccctagtccgcgttccgtcggtacctcgaccggtgtacgtcgaacgnggtagacggngtaccgttaatccgttagaccgtcgactcgaactctaactacgaccgaccgagtcggtgttcggnggtacgtacgaggtccngtaccgtgaccgtcgtacgacggtctccgaccttcggtctaccgtctaccgtcccgtctacccg

SEQ ID NO: 154517 - DNA, 663 bp, Homo sapiens
  misc_feature: GYAE6OF01AMG5R.10.38.D05.1.454.CMB.1.raw
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (504)..(504): a, c, t, g, unknown or other
  misc_feature (504)..(504): n is a, c, g, or t
tcagcatagtagtgcacgaccggtgctcgatttagtatctgataggttgggggtttggggggggtctcaggaggcagcgctctcaggacgtcaccaccatggcctgggctctgctcctcctcaccctctcactcagggcacgagggtcctgggcccagtctgccctgactcacgccctccctccggcgtcccgggtctccgtggacngtcagtccacctatcctccgtgccacgtcggaaccngactagtcgtacttttgtgtacttaataactntcgtctcgtcggtaccagccaccaccgaggaaccaaacccgtcccccttaaacttcgttttggtttagacgtactaggtacggccggtccctacgaaggtcccgtaccgtgtacgtttccggttctctcggtaccctatacggtctacggactacccgccgtcccctcgcgtccgtctcggtcggcctcgtgacgtggagngtacggngtctattaaccgtcgtctcgnacggtcacttagtacctccggaaccgtacccgtaagggttcggggttacggtccggacgggtacgacggtaccgttcgacccggttggaccggccgacggcccgtacgcccgtcccggtcccgtgtcccgttactcccggttccccgtccctcctaccc

SEQ ID NO: 154518 - DNA, 809 bp, Homo sapiens
  misc_feature: GYAE6OF01D2GAR.10.38.D05.1.454.CMB.1.raw
  modified_base (440)..(440): a, c, t, g, unknown or other
  misc_feature (440)..(440): n is a, c, g, or t
  modified_base (534)..(534): a, c, t, g, unknown or other
  misc_feature (534)..(534): n is a, c, g, or t
  modified_base (542)..(542): a, c, t, g, unknown or other
  misc_feature (542)..(542): n is a, c, g, or t
  modified_base (636)..(636): a, c, t, g, unknown or other
  misc_feature (636)..(636): n is a, c, g, or t
tcagcatagtagtgcacgaccggtgctcgatttagtatctgataggttggggtttggggggagaggagcccagcacgtgggattccgaggttcgtttccattcggtgatcagcactagaacacaggagactacacctagtggttagttttgactgagtcggtttcggttttcttggttatacttacgtttaacgaaaggtcgtaccagttgtacggtacgttaccgaaggtgggtacgggaacgtacggtggggaacgggtcggtccgttagggaccgttacccggtacggggttcccggggggttccgggggtaccctaacgggtaaccgttcccttcccgtggtacggtacggaccgtacgttccggttacggttcgggtacacgacctacggtaactaacggtacctataccgtcgccggtaccggtccggaccccncggtaacgtccgggaaccggaagggggccgttacggtgggtacgggttcgtacgtaagtaagttaccaaagacgtaggtccagtactgtaactnttacgttnaccgtgtaccgtccggaggtacccgttaccgccttaccgacgactacgactaaccgtaacctacgtaactactagttacttagttaccgtctanacttagaactactagtactacggtaacgtacgaccgttaacgaccctacgtacccttaacgtactttcgttaacgtccgacggtaacctcgggaactacggttacctacgttaacccgttacgtaaccggggttacgtaccgggtaaccgggccgttaacccggggaccccgg

SEQ ID NO: 154519 - DNA, 218 bp, Homo sapiens
  misc_feature: GYAE6OF02H0VXU.10.38.D05.1.454.CMB.1.raw
  modified_base (217)..(218): a, c, t, g, unknown or other
  misc_feature (217)..(218): n is a, c, g, or t
tcagcatagtagtgcacgaccggtgctcgattagtatctgatagttggttggtgccgaagttgctggaggtcaccgtctcccagcctccaccaagggcccatcggtcttccctggcgccctgctccaggagcacctcagagagcacagcggccctgggctgcctggtcaaggactacttcccactactatgctgagcgggctggcaaggcgcatagnn

SEQ ID NO: 154520 - DNA, 530 bp, Homo sapiens
  misc_feature: GYAE6OF02I3YJ6.10.38.D05.1.454.CMB.1.raw
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactccttgttttgaggtcagtaagcggccctcaggagtccctgatcggttctctgcctccaagtctggcaacacggcctcctgaccgtctctgggctccaggctgaggatgaggctgattactactgcagcgcatattcaggccccaacgagggtgtttggcggcgggactaagggtgaccgtcgtgggtccaggcccaagggcctcgccccctcggtccacgtctcgttcccgccctccc

SEQ ID NO: 154521 - DNA, 532 bp, Homo sapiens
  misc_feature: GYAE6OF02I0CLE.10.38.D05.1.454.CMB.1.raw
  modified_base (382)..(382): a, c, t, g, unknown or other
  misc_feature (382)..(382): n is a, c, g, or t
  modified_base (440)..(440): a, c, t, g, unknown or other
  misc_feature (440)..(440): n is a, c, g, or t
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactcccttgtttttgaggtcagtaagcggccctcaggagtccctgatcggttctctgcctccaagtctggcaacacggcctccctgaccgtcnctgggctccaggctgaggatgaggctgattactactgcagcgcatattcagccccaanagggtgtttgggcggcgggactaaggtcgaccgtctgggtcaggcccaagggctcgccccgtcggtccacttcctcgttccccacccttccc

SEQ ID NO: 154522 - DNA, 166 bp, Homo sapiens; identical to SEQ ID NO: 153952
  misc_feature: GYAE6OF02H8AJR.10.38.D05.1.454.CMB.1.raw
  modified_base (166)..(166): a, c, t, g, unknown or other
  misc_feature (166)..(166): n is a, c, g, or t

SEQ ID NO: 154523 - DNA, 224 bp, Homo sapiens
  misc_feature: GYAE6OF02F5NNH.10.38.D05.1.454.CMB.1.raw
  modified_base (223)..(224): a, c, t, g, unknown or other
  misc_feature (223)..(224): n is a, c, g, or t
tcagcatagtagtgcacgaccggtgctcgatttagtatctgatagttgggtttgggtgccgaagttgctggaggtcaccgtctccccagcctccaccaagggcccatcggtcttcccctggcgccctgctccaggagcacctcagagagcacagcggccctgggctgcctggtcaaggactacttcccactactatgctgagcgggctggcaaggcgcatagnn

SEQ ID NO: 154524 - DNA, 322 bp, Homo sapiens
  misc_feature: GYAE6OF02H3BSL.10.38.D05.1.454.CMB.1.raw
  modified_base (320)..(322): a, c, t, g, unknown or other
  misc_feature (320)..(322): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctcggtcactctgttcccgccctcctccactactatgctgagcgggctggcaaggcgcatagnnn

SEQ ID NO: 154525 - DNA, 522 bp, Homo sapiens
  misc_feature: GYAE6OF02IHMRZ.10.38.D05.1.454.CMB.1.raw
  modified_base (521)..(521): a, c, t, g, unknown or other
  misc_feature (521)..(521): n is a, c, g, or t
tcagcatagtagtgcacgaccggtgctcgatttagtatctgatagttgggtttggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcacggccccaacagggtgtttgggcggcgggactaaggtgaccgtccgtgggtcagcccaaggctcgcccctcggtcactctcgttccccacctcctccactactactcgctgacgcggctggcgaaggccgcgatgnc

SEQ ID NO: 154526 - DNA, 225 bp, Homo sapiens; identical to SEQ ID NO: 153950
  misc_feature: GYAE6OF02I03B2.10.38.D05.1.454.CMB.1.raw
  modified_base (222)..(225): a, c, t, g, unknown or other
  misc_feature (222)..(225): n is a, c, g, or t

SEQ ID NO: 154527 - DNA, 521 bp, Homo sapiens
  misc_feature: GYAE6OF02GQVMJ.10.38.D05.1.454.CMB.1.raw
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
tcagcatagtagtgcacgaccggtgctcgatttagtatctgatagctgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggcccgccaggctccagggaagggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattcgtggggccagggacgcccgaggtccaccgtcctccccagcctccaccaacggcccatccggtccttcccctggccnccatgcctccgaggcnccacctccgagacgcacgacgccggccctgggctcgg

SEQ ID NO: 154528 - DNA, 166 bp, Homo sapiens
  misc_feature: GYAE6OF02JBN65.10.38.D05.1.454.CMB.1.raw
  modified_base (166)..(166): a, c, t, g, unknown or other
  misc_feature (166)..(166): n is a, c, g, or t
tcagcatagtagtgcacgaccggtgctcgatttagtatctgatagttgggtttgggggtgtggtggtctccactcccgccttgacggggctgctatctgccccctcggtcactctgttcccgccctcctccactactatgctgagcgggctggcaaggcgcatagn

SEQ ID NO: 154529 - DNA, 522 bp, Homo sapiens
  misc_feature: GYAE6OF02H2GGA.10.38.D05.1.454.CMB.1.raw
  modified_base (521)..(522): a, c, t, g, unknown or other
  misc_feature (521)..(522): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgccctcaagtctggcaacacggcctccctgaccgtctctgggctccaggctgaggatgaggctgattactactgcagcgcatattcacggccccaacgagggtgtttgggcgggcgggacgtaaggtgaccgtcctgggtccagcccaggctcgcccctcggtccactctcgttcccaccctcctccactactatgctgacgcggctggcgacggcgcatgnn

SEQ ID NO: 154530 - DNA, 225 bp, Homo sapiens
  misc_feature: GYAE6OF02JAMMG.10.38.D05.1.454.CMB.1.raw
  modified_base (223)..(225): a, c, t, g, unknown or other
  misc_feature (223)..(225): n is a, c, g, or t
tcagcatagtagtgcacgaccggtgctcgatttagtatctgatagttgggtttgggtgccgaagttgctggaggtcaccgtctccccagcctccaccaagggcccatcggtcttcccctggcgccctgctccaggagcacctcagagagcacagcggccctgggctgcctggtcaaggactacttcccactactatgctgagcgggctggcaaggcgcatagnnn

SEQ ID NO: 154531 - DNA, 514 bp, Homo sapiens
  misc_feature: GYAE6OF02F88WH.10.38.D05.1.454.CMB.1.raw
  modified_base (513)..(514): a, c, t, g, unknown or other
  misc_feature (513)..(514): n is a, c, g, or t
tcagcatagtagtgcacgaccggtgctcgatttagtatctgatagttgggtttggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtcccctgatcggttctctgcctccaagtctggcaacacggcctccctgaccgtctctgggctccaggctgaggatgaggctgattactactgcagcgcatattcaggccccaacagggtgtttgggcggcgggactaaggtgaccgtcgtgggtcagcccaaggctgcccctggtcactctcgttcccgccctcctccactactatgctgagcggctggcacggcgcatagnn

SEQ ID NO: 154532 - DNA, 324 bp, Homo sapiens
  misc_feature: GYAE6OF02JC9KD.10.38.D05.1.454.CMB.1.raw
  modified_base (319)..(324): a, c, t, g, unknown or other
  misc_feature (319)..(324): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctggtcactctgttcccgccctcctccactactatgctgagcgggctggcaaggcgcatagnnnnnn

SEQ ID NO: 154533 - DNA, 457 bp, Homo sapiens
  misc_feature: GYAE6OF02GOXA4.10.38.D05.1.454.CMB.1.raw
  modified_base (442)..(457): a, c, t, g, unknown or other
  misc_feature (442)..(457): n is a, c, g, or t
tcagcatagtagtgcacgaccggtgctcgatttagtatctgatagttggggtttggggctttgcctgggtctcctggacagtcagtcaccatctcctgcactggaaccagcagtgaatttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctggactccaggctgaggatgaggctgattactactgcagcgcatattcaggccccaacgagggtgtttggcggcgggactaaggtgaccgtctgggtcagcccaaggctgcccctcggtcactctcgttcccaccctcctccactactatgctgagcggctcggcaggcgcatagnnnnnnnnnnnnnnnn

SEQ ID NO: 154534 - DNA, 505 bp, Homo sapiens
  misc_feature: GYAE6OF02H40RT.10.38.D05.1.454.CMB.1.raw
  modified_base (499)..(505): a, c, t, g, unknown or other
  misc_feature (499)..(505): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccagggaagggctggagtgggtctcagttattgaaacagatggcactacatattatctgactccgtgaagggccgttcaccctctccagagacacttccaacaacatcttgtatcttcacatgcacaatctgagagtcgacgacacggccacctatattgtgcgcgacatgactacgctcaattctggggccagggagcccaggtcaccgtctccccagcctccaccaagggcccatcggtcttccccctggcgccctgctccaggacgcacctccgagacgcacagcggccctgggcctgccgtggtaccaacggaccttaccttcccgacttactatcgctgaggcggcgtggccaaggcgacagtagnnnnnnn

SEQ ID NO: 154535 - DNA, 166 bp, Homo sapiens; identical to SEQ ID NO: 153952
  misc_feature: GYAE6OF02GKRDV.10.38.D05.1.454.CMB.1.raw
  modified_base (166)..(166): a, c, t, g, unknown or other
  misc_feature (166)..(166): n is a, c, g, or t

SEQ ID NO: 154536 - DNA, 447 bp, Homo sapiens
  misc_feature: GYAE6OF02H3QM3.10.38.D05.1.454.CMB.1.raw
  modified_base (442)..(447): a, c, t, g, unknown or other
  misc_feature (442)..(447): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctggtcactctcgttcccgccctcctccactactatgctgagcgggctggcaggcgcatagnnnnnn

SEQ ID NO: 154537 - DNA, 576 bp, Homo sapiens
  misc_feature: GYAE6OF02G4M9G.10.38.D05.1.454.CMB.1.raw
  modified_base (425)..(425): a, c, t, g, unknown or other
  misc_feature (425)..(425): n is a, c, g, or t
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagccccaaatccctgttttgaggtcagtaagcggccctcaggagtccctgatcggtctctctcgcctacgtacgtcgcgtacacgaccgtccctccgacgtccgtctcgtacgtacctacgacgtcgtaggacgtgtaggacgtntagtacttacgtgtcgacgcgcgactatctacggacccaccgaggtcggttcggtcggcgggtacgtaacggtagaccgtccgtcggtcggacgaccgaccgacgtccgtcccgtcccgttcgacctccgttcgttcccgtaccctccccg

SEQ ID NO: 154538 - DNA, 606 bp, Homo sapiens
  misc_feature: GYAE6OF02GVORR.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaacgcccccaaaactcccttgttttgagttcagtaagcggccctcaggactcctgatcggttctctgcctcaagtctggcaacacggcctccctgaccgtctcctgggctccgaggctggaggatggaggctgggaacttactacgtgcagccgctatattccacggtaccccaaagtggggttgtttcgggccgggtaccggggactaaaacggggtcgtaaccccggttccgttaggggtaccacggccccgaaacgggcccttccggccccccgttcgggtccaaccgttcccgttacggtttccccccggcccttcccccg

SEQ ID NO: 154539 - DNA, 446 bp, Homo sapiens
  misc_feature: GYAE6OF02G1FCZ.10.38.D05.1.454.CMB.1.raw
  modified_base (432)..(432): a, c, t, g, unknown or other
  misc_feature (432)..(432): n is a, c, g, or t
  modified_base (438)..(446): a, c, t, g, unknown or other
  misc_feature (438)..(446): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagccaaggctgcccctggtcactctgtcccaccctcctccactactatcgctgagcgggctggcaggcncatagnnnnnnnnn

SEQ ID NO: 154540 - DNA, 457 bp, Homo sapiens
  misc_feature: GYAE6OF02GZHZZ.10.38.D05.1.454.CMB.1.raw
  modified_base (445)..(457): a, c, t, g, unknown or other
  misc_feature (445)..(457): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctcctgaccgtctctgggctccaggctgaggatgaggctgattactactgcagcgcatattcaggccccaacagggtgtttggcggcgggactaaggtgaccgtctgggtcagcccaaggctcgccccctcggtcactctcgttcccaccctcctccactactatgctgacgcgggctggcaaggcgcatagnnnnnnnnnnnnn

SEQ ID NO: 154541 - DNA, 544 bp, Homo sapiens
  misc_feature: GYAE6OF02IOXWJ.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactccttgtttttgaggtcagtaagcggcctcaggagtccctgatcggttctctgcctccaagtctggcaacacggcctccctgaccgtctcgtgggctccaggctgaggatgaggctgattactactgcagcgcatattcacggccccaagagggttgtttgggcggcgggactaagggtgaccggtctgggtcacggcccgaaggcctcggccccgtcggtcaccgttccgtcgttccccgcccttcccg

SEQ ID NO: 154542 - DNA, 509 bp, Homo sapiens
  misc_feature: GYAE6OF02HCBGG.10.38.D05.1.454.CMB.1.raw
  modified_base (345)..(345): a, c, t, g, unknown or other
  misc_feature (345)..(345): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccaggggaaggggctggagtgggtctcagttattgaaacngatggcactacatattattctgactccgtgagggccggttcaccctctccagagacacttccaacacatcttgtattctcacatgcacaatctgagagtcgacgacacggccaactattatgtgcgcgacatgacctacgctcaattcgcggggccagggaccg

SEQ ID NO: 154543 - DNA, 560 bp, Homo sapiens
  misc_feature: GYAE6OF02HDLWZ.10.38.D05.1.454.CMB.1.raw
  modified_base (371)..(371): a, c, t, g, unknown or other
  misc_feature (371)..(371): n is a, c, g, or t
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaagcccccaaaactccttgtttttgaggtcagtaagcggcctcaggatccctgatcggttctctgcctcaagtctggcaacacggcctccngaccgtctctgggctccagctgaggatgaggctgattactactgcagcgcatattcacggccccaagagggttgtttgggccggcggggactaaacgggtcgaccggtccgtgggtacaacggcccgaaaggtccgtacgccccccgttcggtcccgaccttccgttcggttccccgccccttaccccg

SEQ ID NO: 154544 - DNA, 166 bp, Homo sapiens
  misc_feature: GYAE6OF02I2RMG.10.38.D05.1.454.CMB.1.raw
  modified_base (164)..(166): a, c, t, g, unknown or other
  misc_feature (164)..(166): n is a, c, g, or t
tcagcatagtagtgcacgaccggtgctcgatttagtatctgatagttgggtttgggggtgtggtggtctccactccgccttgacggggctgctatctgcccctcggtcactctgttcccaccctcctccactactatgctgagcgggctggcaaggcgcatagnnn

SEQ ID NO: 154545 - DNA, 558 bp, Homo sapiens
  misc_feature: GYAE6OF02H73CT.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactcccttgtttttgaggtcagtaagcggccctcaggagtccctgatcggttctctgcctcaagtctggcaacacggcctcctgaccgtctctgggctccgaggctgaggatgaggctgatttactactgcagcgcatattcacggaccccaagtacggggtgtttcgggcggtcgggacgtaagggtcgacccgtcgtgggtcgacggacccgaaggcctcggcccccgttcggtccaccgttccgtcgttcccccacccttcccc

SEQ ID NO: 154546 - DNA, 629 bp, Homo sapiens
  misc_feature: GYAE6OF02JXIPT.10.38.D05.1.454.CMB.1.raw
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactccttgttttgaggtcagtaagcggccctcaggagtccctgatcggttctctgcctcaagtctggcaacacggcctcctgaccgtctctgggctccgaggtctgaggatggagtctgattactactgacacgcgctattacttcgacggacccccaaggtacgggttggtttcgggaccgggtacgggtaacgttaaacggggttcgtacccgggttccgttaggggttaccaacgggtaccccggaaagggtcccgttacccgggtcccccccgttacggggttccctaaccgtttcccgtttacccgggtttccccccgtacccccgtttcccccg

SEQ ID NO: 154547 - DNA, 529 bp, Homo sapiens
  misc_feature: GYAE6OF02JKISO.10.38.D05.1.454.CMB.1.raw
  modified_base (422)..(422): a, c, t, g, unknown or other
  misc_feature (422)..(422): n is a, c, g, or t
  modified_base (509)..(509): a, c, t, g, unknown or other
  misc_feature (509)..(509): n is a, c, g, or t
  modified_base (521)..(521): a, c, t, g, unknown or other
  misc_feature (521)..(521): n is a, c, g, or t
tcagcatagtagtgcacgaccggtgctcgatttagtatctgatagttggggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggacaaacgcccccaaactccttgttttgaggtcagtaagcggcctcaggagtccctgatcggttctctgcctcaagtctggcaacacggctccctgaccgtctcgtggctccgagctgagatgagtctgacttacactgcagccntatattcacggaccccaagtacgggtgttacggcggcggtagtacggtgaccgtcgtgggtcacggccaggcctcgcccctggtccnctctcgttcccnccttaccc

SEQ ID NO: 154548 - DNA, 551 bp, Homo sapiens
  misc_feature: GYAE6OF02H51Y7.10.38.D05.1.454.CMB.1.raw
  modified_base (505)..(505): a, c, t, g, unknown or other
  misc_feature (505)..(505): n is a, c, g, or t
tcagcatagtagtgcacgaccggtgctcgatttagtatctgatagttgggtttggggggggtctcaggaggcagcgctctcaggacgtcaccaccatggcctgggctctgctcctctcaccctcctcactcagggcacagggtcctgggcccagtctgccctgactcagcctccctccgcgtccgggtctcctggacagtcagtcaccatctcctgcactggaaccagcagtgacttttgttgcttataactatgtctcctggtaccagcaccaccaggcaaacgccccaaatccttgttttgaggtcagtaagcgcctcaggagtccctgactcggttctctcgcccttcaagtctggccaacgacggccctccctcgacccgtctcgtcgggctccgaggctggaggatgaggctagattactactgcagcgacatacttcgacggacccaagtagggttgtttcgggcggtcgggacgtaagggtcgaccgtcgtcgggtcncgccgaggcctcgccccgtcggtccactctcgttccccgcttcccc

SEQ ID NO: 154549 - DNA, 457 bp, Homo sapiens
  misc_feature: GYAE6OF02G3QZK.10.38.D05.1.454.CMB.1.raw
  modified_base (447)..(457): a, c, t, g, unknown or other
  misc_feature (447)..(457): n is a, c, g, or t
tcagcatagtagtgcacgaccggtgctcgatttagtatctgatagttggggtttggggctttgcctgggtctcctggacagtcagtcaccatctcctgcactggaaccagcagtgactttgttgcttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctagtcagcccaaggctcgcccctcggtcactctgttccccaccctcctccactactatgctgacgcgggctggcaaggcgcatagnnnnnnnnnnn

SEQ ID NO: 154550 - DNA, 529 bp, Homo sapiens
  misc_feature: GYAE6OF02F971W.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggtttcgtgttaggctattcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcaggttattgaaacagatggcactacatattattctgactccgtgaacgggccgtttcaccctctccagacgacacttaccaacaacattcttagtattcttcacatcgcacaatctgagagtcgacgacacggccactattatgtgcgcgacatcgactacgctactaagttcgtacggggccaggggtacccg

SEQ ID NO: 154551 - DNA, 517 bp, Homo sapiens
  misc_feature: GYAE6OF02FVTS2.10.38.D05.1.454.CMB.1.raw
  modified_base (431)..(431): a, c, t, g, unknown or other
  misc_feature (431)..(431): n is a, c, g, or t
  modified_base (502)..(502): a, c, t, g, unknown or other
  misc_feature (502)..(502): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaaggggctggagtgggtctcgagttattgaaacagatggcactacatattattctgactccgtgaagggccggttcaccctctccagagacacttccaacaacatctgtatcttcacntgcacaatcagagagtcgacgacaccggccacctattacttgtgcgtcgacatcgactacgctcaattcgnggggaccagggaccg

SEQ ID NO: 154552 - DNA, 521 bp, Homo sapiens
  misc_feature: GYAE6OF02IA6NM.10.38.D05.1.454.CMB.1.raw
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
  modified_base (507)..(507): a, c, t, g, unknown or other
  misc_feature (507)..(507): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctgggagtgggtctcagttattgaaacagatggcactacatattatctgactccgtgaacgggccgttcaccctctccagagacacttccaaacaacatcttgtatcttcacatgaccanaatctagagacgtcgacgacacggccaacctattattgngcgcgacatgactacgctacaattcgngggaccagggaccg

SEQ ID NO: 154553 - DNA, 510 bp, Homo sapiens
  misc_feature: GYAE6OF02I00BH.10.38.D05.1.454.CMB.1.raw
  modified_base (509)..(510): a, c, t, g, unknown or other
  misc_feature (509)..(510): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgacccgtctctgggctccaggctgaggatgaggctgattactatgcagcgcatattcaggccccaagagggtgtttggcggcgggactaaggtgacgtctgggtcagcccaggctgcccctcgtcactctcgttcccaccctcctccactactatcgctgagcggctggcaggcgcatagnn

SEQ ID NO: 154554 - DNA, 509 bp, Homo sapiens
  misc_feature: GYAE6OF02FHEPL.10.38.D05.1.454.CMB.1.raw
  modified_base (346)..(346): a, c, t, g, unknown or other
  misc_feature (346)..(346): n is a, c, g, or t
  modified_base (496)..(496): a, c, t, g, unknown or other
  misc_feature (496)..(496): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtcccctgagactctcctgtgcagcctctgggttcagcatcagtaacgactacatgacctgggcccgccaggctccagggaaggggctgggagtgggtctcagttattgaaacngatggcactacatattattctgactccgtgaagggccgttcaccctctccagagacacttccaacaacatcttgtatcttcacatgcacaatctgagagtcgacgacacggccacctattattgtgcgcgacatgactacgctcaattcnggggccagggacg

SEQ ID NO: 154555 - DNA, 508 bp, Homo sapiens
  misc_feature: GYAE6OF02JFKLF.10.38.D05.1.454.CMB.1.raw
  modified_base (344)..(344): a, c, t, g, unknown or other
  misc_feature (344)..(344): n is a, c, g, or t
  modified_base (495)..(495): a, c, t, g, unknown or other
  misc_feature (495)..(495): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctccagggaaggggctggagtgggtctcagttattgaaacngatggcactacatattattctgactccgtgaagggccggttcaccctctccagagacacttccaacaacatctgtatcttcacatgacacaatctagagagtcgacgacacggccactattatgtgcgcgacatgactacgctcaattcgngggccagggaccg

SEQ ID NO: 154556 - DNA, 330 bp, Homo sapiens
  misc_feature: GYAE6OF02HBRCT.10.38.D05.1.454.CMB.1.raw
  modified_base (327)..(330): a, c, t, g, unknown or other
  misc_feature (327)..(330): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattattactgtcagtcctatgacagtaggctgagtctttgggtgttcggcggagggaccaagctgaccgtccttcgtcagcccaaggctgccccctggtcactctgttccccaccctcctccactactatgctgagcgggctggcaaggcgcatagnnnn

SEQ ID NO: 154557 - DNA, 574 bp, Homo sapiens
  misc_feature: GYAE6OF02JBE9U.10.38.D05.1.454.CMB.1.raw
  modified_base (366)..(366): a, c, t, g, unknown or other
  misc_feature (366)..(366): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgccccaaactccttgttttgaggtcagtaacgccggccctcgaggagtccctgatcggttctctcgcctcaagtctgcaacncggcctccctgacccgtctcctgggcctccgaggctggaggatggagctgattactacgttgcagcgcatacttcacggcccaagagggttgttgggcggtcgggacgtaagggtcgaccggttccgtgggtaccacggcccgaagggtcccttaccgcccccgttcggtcctaccgttcccgttccgttccccctaccccgttcccc

SEQ ID NO: 154558 - DNA, 545 bp, Homo sapiens
  misc_feature: GYAE6OF02GE4PT.10.38.D05.1.454.CMB.1.raw
  modified_base (537)..(537): a, c, t, g, unknown or other
  misc_feature (537)..(537): n is a, c, g, or t
  modified_base (540)..(541): a, c, t, g, unknown or other
  misc_feature (540)..(541): n is a, c, g, or t
  modified_base (543)..(545): a, c, t, g, unknown or other
  misc_feature (543)..(545): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcaccctctccagagacacttccaacaacatcttgtatcttcacatgcacaatctgagagtcgacgacacggccacctattattgtgcgcgacatgactacgctcaattctggggccagggacgcccgaggtcaccgtctccccacgcctccacccaacgggcccaacgtccggtcctttcccccgtcggcccgcccctcgcctccgaggacgccaccctccgagacgcacgacgcggccctgggcctcgcccgtggtaccgaacggacctaccttcccaacttacctactcgctgacggccgggctcgggccaacgggtccgcagtagnacnncnnn

SEQ ID NO: 154559 - DNA, 516 bp, Homo sapiens
  misc_feature: GYAE6OF02GTB8H.10.38.D05.1.454.CMB.1.raw
  modified_base (435)..(435): a, c, t, g, unknown or other
  misc_feature (435)..(435): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaaggggcgtggagtgggtctcagttattgaaacagatggcactacatattattctgactccgtgacgggccggttcaccctctccagacgacacttccaacaacatcttgtatcttcacatncacaatctagagagtcgacgacgaccggccacctattacttgtgcgcgacatcgactacgctctaattcgtgggccacggg

SEQ ID NO: 154560 - DNA, 619 bp, Homo sapiens
  misc_feature: GYAE6OF02JGQJ6.10.38.D05.1.454.CMB.1.raw
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
  modified_base (439)..(439): a, c, t, g, unknown or other
  misc_feature (439)..(439): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctggcccagtctgccctgactcagcctccctccgcgtccgggtctcctggacagtcagtcaccatctcctgcactggaaccagcagtgtactttgttgcttataactatgtctctggtaccagccaccaccaggaccaaacgccccaaacttccttgttttgaggtcagtaacgcggcctnaggacgtccctgatcggtctcngcctacagtctgcaacacggtcctcctgaccgtctcgtcggtctccgacggctaggacggagtggacggctagtaacttactacgtcgacncgccactatacgttcgaacggacccctaacgtaggggttacgtttcgggacgggtacgggtaacgttaacgggtcgacccggttccgtagggtaccgacggtacccgaaacgggccgttaccgcccccggttacggtcctaaccgttcccgttaccggtttacccccacccgttaccccg

SEQ ID NO: 154561 - DNA, 545 bp, Homo sapiens
  misc_feature: GYAE6OF02GVKLL.10.38.D05.1.454.CMB.1.raw
  modified_base (323)..(323): a, c, t, g, unknown or other
  misc_feature (323)..(323): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgccccaaactccttgttttgaggtcagtaagcggccctnaggagtccctgatcggttctctgcctccaagtctggcaacacggcctccctgaccgtctcgtcgggctccgaggctgaggatgaggtctgattactactgcagcgcatacttcacggccccaacgngggttcgtttggcggngggtactaagggtcgaccgtcgtgggtcaggcccaaggcctcgcccccgtcggtcaccgtctcgttccccgcccttcccg

SEQ ID NO: 154562 - DNA, 555 bp, Homo sapiens
  misc_feature: GYAE6OF02I72QI.10.38.D05.1.454.CMB.1.raw
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagccccaaactccttgttttgagtcagtaagcggccctcaggactccctgactcggttctctgcctccaagtctggcaacacggccctccctgacccgtctcgtgggcctccgaggctgaggntgaggctgattactactgcagcnctatattcacggcccaagngggttgttcgggccggcgggactaagggtcgaccgtcgtgggtccacggcccgaaggcctccggcccccgttggtcccaccgttccgtcggttccccgcccttccccg

SEQ ID NO: 154563 - DNA, 555 bp, Homo sapiens
  misc_feature: GYAE6OF02HRAQ3.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccaccagcaaagcccccaaatccttgttttgaggtcagtaagcgcctcaggagtccctgatcggttctctgcctcaagtctggcaacacggcctccctgaccgtctcgtcgggcctccgaggctgaggatgaggctgattactactgcagcgacatacttcgacggacccaacgtagggtgtttaggcgggtcgggaactaagggtcgaccgtccgtgggtcacggtcccgaacgggcctccgaccccttcggtcctaccgttccttcgttccccacccttcccg

SEQ ID NO: 154564 - DNA, 522 bp, Homo sapiens
  misc_feature: GYAE6OF02GEBVQ.10.38.D05.1.454.CMB.1.raw
  modified_base (226)..(226): a, c, t, g, unknown or other
  misc_feature (226)..(226): n is a, c, g, or t
  modified_base (362)..(362): a, c, t, g, unknown or other
  misc_feature (362)..(362): n is a, c, g, or t
tcagcatagtagtgcacgaccggtgctcgatttagtatctgatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacttttgttgcttataactatgtctcctggtaccagcaccacccaggcaaacgccccaaactccttgttttgagtcagtaagcggcctcaggagtccctgatcggttctctgcctccaagtctggcaacncggcctcctgaccgtctctggctccaggctgagatgaggctgattactactgcagcgcatattcacggcccaagagggtgttggcgcggactaaggtgaccgtcgtgggtcacgcccgaaggcctcgccccgtcggtccacctctcgttcccgccctccc

SEQ ID NO: 154565 - DNA, 593 bp, Homo sapiens
  misc_feature: GYAE6OF02H2OPE.10.38.D05.1.454.CMB.1.raw
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (175)..(176): a, c, t, g, unknown or other
  misc_feature (175)..(176): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (197)..(198): a, c, t, g, unknown or other
  misc_feature (197)..(198): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcggtggtttcgtgtaggcattnaagntcnngnagtnangtgngatgagngnngancagcctggggccngngactctctgngcagcctctggtcagcatcagtaacgactacatgacctggggcccacnggctccgaggggaagggctgggagtgggtctagagttatcgaaaagngagngacactatagtattatctcgtaccgtcggtaggtaccgggtcccgttaccaccctctaccgagacgacctactaccaaactaactcttcttacgtacttccttacacgtagtcgtacactactacgtacgtacgtacggtacgaaccgaaccgaccgtaaccgtaaccttaacttacgttacggtacggtccggtaccgaacgtaacgtacgtaaccgtaccgtaccgtaaccttaaccgttaccggttaccgggtaccggtaacggg

SEQ ID NO: 154566 - DNA, 525 bp, Homo sapiens
  misc_feature: GYAE6OF02JDPUZ.10.38.D05.1.454.CMB.1.raw
  modified_base (323)..(323): a, c, t, g, unknown or other
  misc_feature (323)..(323): n is a, c, g, or t
  modified_base (443)..(443): a, c, t, g, unknown or other
  misc_feature (443)..(443): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactccttgtttttgaggtcagtaagcggccctnaggatccctgatcggttctctgcctccaagtctggcaacacggcctccctgacccgtctcgtgggctccaggctgaggatgaggctgattactactgcagcgcatattcaggccccaagngggtgttggcgcgggactaaggtgaccgtctgggtcagcccaaggcctcgccccctggtccacctctcgttcccaccctccc

SEQ ID NO: 154567 - DNA, 562 bp, Homo sapiens
  misc_feature: GYAE6OF02JVKUF.10.38.D05.1.454.CMB.1.raw
  modified_base (319)..(319): a, c, t, g, unknown or other
  misc_feature (319)..(319): n is a, c, g, or t
  modified_base (411)..(411): a, c, t, g, unknown or other
  misc_feature (411)..(411): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacttttgtgcttataactatgtctcctggtaccagcaccaccaggcaaacgccccaaactccttgttttgagtcagtagcgcctnaggactccgtgactcggttctctcgcctccaagtctggcaacgaccggcctccctgacccgttctcgtcgggtcctccgaggtctggacggngttggagctgtacttactacgtgcgagccgacattacttcgaccggacccaacgtacgggtgttcgggcggtacggactaagggtcgaccgtcgtgggtacacgccgaagcctacgccccgtaggccaccgttctccgttcccgccctccg

SEQ ID NO: 154568 - DNA, 225 bp, Homo sapiens; identical to SEQ ID NO: 153950
  misc_feature: GYAE6OF02HGZ0R.10.38.D05.1.454.CMB.1.raw
  modified_base (222)..(225): a, c, t, g, unknown or other
  misc_feature (222)..(225): n is a, c, g, or t

SEQ ID NO: 154569 - DNA, 469 bp, Homo sapiens
  misc_feature: GYAE6OF02JKOR0.10.38.D05.1.454.CMB.1.raw
  modified_base (451)..(452): a, c, t, g, unknown or other
  misc_feature (451)..(452): n is a, c, g, or t
  modified_base (455)..(469): a, c, t, g, unknown or other
  misc_feature (455)..(469): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcacggccccaagagggtgtttgggcggcgggactaaggtcgaccgtcgtgggtcagcccaaggctcgccccctcggtcactcgtcgttcccaccctcctccactactatcgctgagcggctcggcaaggcgcagtagnngcnnnnnnnnnnnnnnn

SEQ ID NO: 154570 - DNA, 447 bp, Homo sapiens
  misc_feature: GYAE6OF02F8ZJA.10.38.D05.1.454.CMB.1.raw
  modified_base (438)..(447): a, c, t, g, unknown or other
  misc_feature (438)..(447): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagcccaaggctgcccctggtcactctgttcccacctcctccactactatgctgagcgggctggcaggcgcatagnnnnnnnnnn

SEQ ID NO: 154571 - DNA, 520 bp, Homo sapiens
  misc_feature: GYAE6OF02H1JY4.10.38.D05.1.454.CMB.1.raw
  modified_base (497)..(497): a, c, t, g, unknown or other
  misc_feature (497)..(497): n is a, c, g, or t
  modified_base (500)..(520): a, c, t, g, unknown or other
  misc_feature (500)..(520): n is a, c, g, or t
tcagcatagtagtgcacgaccggtgctcgatttagtatctgatagttggggtttgggggcgtttgcctgggtctcctggacagtcagtcaccatctcctgcactggaaccagcagtgactttgttgcttataactatgtctcctggtaccagcaccacccaggcaaagcccccaaactcccttgttttgaggtcagtaagcggcctcaggagtccctgatcggttctctgcctccaagtctggcaacacggcctcctcgaccgtctctgggctccaggctgaggatgaggctggattacactgcagcgcatattcacggccccaacgagggttgtttgggcggcgggaactaaaggtcgaaccgtccgtgggtcgacggtacccaaacgggctacgccccccgtgggtcccacgtccgtccgttccccggccccttcccgtaccctaccgtactacgtgcccgtgacggtcgggctacgggcaacggcgcagtacgncgnnnnnnnnnnnnnnnnnnnnn

SEQ ID NO: 154572 - DNA, 452 bp, Homo sapiens
  misc_feature: GYAE6OF02HLS9L.10.38.D05.1.454.CMB.1.raw
  modified_base (441)..(452): a, c, t, g, unknown or other
  misc_feature (441)..(452): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagcccaaggctgcccctggtcactctcgtcccgccctcctccactactatgctgagcgggctggcaaggcgcatagnnnnnnnnnnnn

SEQ ID NO: 154573 - DNA, 515 bp, Homo sapiens
  misc_feature: GYAE6OF02FNSIU.10.38.D05.1.454.CMB.1.raw
  modified_base (514)..(515): a, c, t, g, unknown or other
  misc_feature (514)..(515): n is a, c, g, or t
tcagcatagtagtgcacgaccggtgctcgatttagtatctgatagttgggtttggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaacagcaccacccaggcaaagcccccaaactccttgttttgaggtcagtaagcggccctcaggagtcccctgatcggttctctgcctccaagtctggcaacacggcctccctgaccgtctctgggctccaggctgaggatgaggctgattactactgcagcgcacattcaggccccaacagggtgtttggcggcggggactaaggtgaccgtcctgggtcagcccaaggctgcccctcggtcactctgttcccaccctcctccactactatcgctgagcggctggcaaggcgcatagnn

SEQ ID NO: 154574 - DNA, 226 bp, Homo sapiens
  misc_feature: GYAE6OF02FKMNB.10.38.D05.1.454.CMB.1.raw
  modified_base (224)..(226): a, c, t, g, unknown or other
  misc_feature (224)..(226): n is a, c, g, or t
tcagcatagtagtgcacgaccggtgctcgatttagtatctgatagttgggtttgggtgccgaagttgctggaggtcaccgtctccccagcctccaccaagggcccatcggtcttccccctggcgccctgctccaggagcacctcagagagcacagcggccctgggctgcctggtcaaggactacttcccactactatgctgagcgggctggcaaggcgcatagnnn

SEQ ID NO: 154575 - DNA, 514 bp, Homo sapiens
  misc_feature: GYAE6OF02GXK6O.10.38.D05.1.454.CMB.1.raw
  modified_base (373)..(373): a, c, t, g, unknown or other
  misc_feature (373)..(373): n is a, c, g, or t
  modified_base (471)..(471): a, c, t, g, unknown or other
  misc_feature (471)..(471): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaacgcccccaaatcccttgttttgaggtcagtaagcggccctcaggacgtccctgatcggttctctgcctcaagtctgcacacgcctcctnaccgtctctggctcaggctgagatgagctgatactactgcagcgcatattcacggcccaagagggtgttggcggcggactaaggcgacgtcgtggtcngacccaggctcgccccgtcggtcacctctcttcccaccctccc

SEQ ID NO: 154576 - DNA, 550 bp, Homo sapiens
  misc_feature: GYAE6OF02HWRIC.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactccttgtttttgaggtcagtaagcggccctcaggagtccctgatcggttctctgcctcaagtctggcaacacggcctccctgaccgtctctgggctccaggctgaggatgaggctgattactactgcagcgcatattcacggaccccaagagggttcgtttgggcggcgggacgtaagggtcgaccggtcgtgggtaccacggacccgaagggcctcgcccccgtcggtccaccgtccgtcgttccccgcccttcccg

SEQ ID NO: 154577 - DNA, 552 bp, Homo sapiens
  misc_feature: GYAE6OF02FVU4S.10.38.D05.1.454.CMB.1.raw
  modified_base (277)..(277): a, c, t, g, unknown or other
  misc_feature (277)..(277): n is a, c, g, or t
  modified_base (551)..(551): a, c, t, g, unknown or other
  misc_feature (551)..(551): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctnaggagtccctgatcggttctctgcctccaagtctggcaacacggcctccctgacccgtctctgggcctccaggctgaggatgaggctgattactactgcagcgcatacttcacggccccaacgtaggggtgtttgggcgggcggggactaagggtcgaccgtccgtgggtcacgcccaaggctcgccccgtcgtccactctcgttcccaccctcctcccaccttactactcgtctcggacggccgggcgttcggccgaaggccgacgatacggnc

SEQ ID NO: 154578 - DNA, 558 bp, Homo sapiens
  misc_feature: GYAE6OF02HLHUS.10.38.D05.1.454.CMB.1.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (378)..(378): a, c, t, g, unknown or other
  misc_feature (378)..(378): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgactttgtncttanaactatgtctcctggtaccagcaccacccaggcaaagcccccaaactccttgttttgaggtcagtaancggccctnaggatccctgatcggttctctgcctccaagtctggcaacacggcctcctgaccgtntctgggcctccaggctgagatggaggctgattactactgcagcgcatattcacggccccaagagggtcgtttgggcggccgggtaactaaggtcgacccgtcgtgggtccaacggccctaaggccctcggacccccgttcggtcctaccgttcccgtcggttacccccaccccttccccg

SEQ ID NO: 154579 - DNA, 583 bp, Homo sapiens
  misc_feature: GYAE6OF02JEU5Q.10.38.D05.1.454.CMB.1.raw
  modified_base (379)..(379): a, c, t, g, unknown or other
  misc_feature (379)..(379): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggtttccgttgttagctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaagggctgggagtgggtctcgagttattagaaacagatggcactacatattatctgactccgngaagggccgttcacctctccagagacacttccaacaacatcctagtactcttacacatcgcacaactctagagagtccgaacgtaaccaccggaccctaaccttatttacgttggtacggtccggtacggtaacctagttacggaacccttaccggacttaccgtaaacgtttccggtacgggggacccgaggggtaaccccgg

SEQ ID NO: 154580 - DNA, 518 bp, Homo sapiens
  misc_feature: GYAE6OF02JB4KT.10.38.D05.1.454.CMB.1.raw
  modified_base (451)..(451): a, c, t, g, unknown or other
  misc_feature (451)..(451): n is a, c, g, or t
tcagcatagtagtgcacgaccggtgctcgatttagtatctgatagttgggttttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccaggggaaggggctggagtggggtctcagttattgaaacagatggcactacatattattctgactccgtgaacggggtccgtttcaccctctccagagacacttccaacaacatcttgtatcttcacatgcacaatctgagngtcgacgacacggccaacctattatgtcgcgcgacatgactcgctcaattcgcggggccagggaccg

SEQ ID NO: 154581 - DNA, 625 bp, Homo sapiens
  misc_feature: GYAE6OF02G6N4Q.10.38.D05.1.454.CMB.1.raw
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttaataactatgtctcctggtaccagcaccacccaggcaaacgccccaaactccttgttttgaggtcagtaacgcggccctgaggacgtccctgatcggttctctcgcctcaagtctggacaacgccggcctcccgtcgacccgttctcgtcgggcctccgaggtctgaggatgaggctagtacttactacgtcgcagccgactactattcgaaccggtaccccaaagtcggggttcgtttcggggccgggacggggtaacgttaacggggtcgaacccggttccgttaggggtaccaacggtaccccgtaagggtcccttacccggcccccgttcgggtacctacccgttccgttacccgttacccccaccccttccccg

SEQ ID NO: 154582 - DNA, 450 bp, Homo sapiens
  misc_feature: GYAE6OF02GLBRS.10.38.D05.1.454.CMB.1.raw
  modified_base (325)..(325): a, c, t, g, unknown or other
  misc_feature (325)..(325): n is a, c, g, or t
  modified_base (434)..(434): a, c, t, g, unknown or other
  misc_feature (434)..(434): n is a, c, g, or t
  modified_base (440)..(450): a, c, t, g, unknown or other
  misc_feature (440)..(450): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgtatattcaggccccaanagggtgtttggcggcgggactaaggtgaccgtcctgggtcagcccaaggctcgcccctggtcactctgtcccgccctcctccactactatgctgagcggctggcaggcncatagnnnnnnnnnnn

SEQ ID NO: 154583 - DNA, 324 bp, Homo sapiens
  misc_feature: GYAE6OF02IMSQA.10.38.D05.1.454.CMB.1.raw
  modified_base (316)..(316): a, c, t, g, unknown or other
  misc_feature (316)..(316): n is a, c, g, or t
  modified_base (319)..(324): a, c, t, g, unknown or other
  misc_feature (319)..(324): n is a, c, g, or t
tcagcatagtagtgcacgaccggtgctcgatttagtatctgatagttgggtttgggaacctatgaacattctgtagggccactgtcttctccacggtgctcccttcatgcgtgacctggcaacacggcctccctgaccgtctctgggctccaggctgaggatgaggctgattactactgcagcgcatattcaggcccaacagggtgtttggcggcgggactaaggtgaccgtcctgggtcagcccaaggctgcccctggtcactctgttcccgccctcctccactactatgctgagcgggctggccaaggcgctanagnnnnnn

SEQ ID NO: 154584 - DNA, 456 bp, Homo sapiens
  misc_feature: GYAE6OF02F1S0Y.10.38.D05.1.454.CMB.1.raw
  modified_base (448)..(456): a, c, t, g, unknown or other
  misc_feature (448)..(456): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcacggccccaagagggtgtttggcggcgggactaaggtgaccgtccgtgggtcagcccaaggctcgccccctcggtcactctcgttcccaccctcctccactactatgctgagcgggctggcaaggcgcatagnnnnnnnnn

SEQ ID NO: 154585 - DNA, 521 bp, Homo sapiens
  misc_feature: GYAE6OF02G029G.10.38.D05.1.454.CMB.1.raw
  modified_base (396)..(396): a, c, t, g, unknown or other
  misc_feature (396)..(396): n is a, c, g, or t
  modified_base (515)..(515): a, c, t, g, unknown or other
  misc_feature (515)..(515): n is a, c, g, or t
  modified_base (520)..(521): a, c, t, g, unknown or other
  misc_feature (520)..(521): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcacggccccaanagggtgtttggcggcgggactaaggtcgaccgtcgtgggtccagcccaaggcctcgcccctcggtccacttctcgttcccaccctcctccactactatgctgcgcggctggcgaggccncatgnn

SEQ ID NO: 154586 - DNA, 552 bp, Homo sapiens
  misc_feature: GYAE6OF02GW9RA.10.38.D05.1.454.CMB.1.raw
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccncaggctccgagggaagggctggagtgggtctcagttatgaaacngatggcactacatattattctgactcgtgaacgggccgttcaccctntccagacgacacttaccaaacaacattcttgtaattcttacacatgacacaatcctagagacgtcgaacgacaaccggccaaccgttattacttaggtcgaccgcgactatcggaacttaccggcttccgaaagttccggacggggtcccaaggggtacccg

SEQ ID NO: 154587 - DNA, 473 bp, Homo sapiens
  misc_feature: GYAE6OF02I4GP9.10.38.D05.1.454.CMB.1.raw
  modified_base (459)..(473): a, c, t, g, unknown or other
  misc_feature (459)..(473): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgaccgattctctggctccaagtctggcacctcagcctccctggccatcagtgggctccggtcgaggatgacgctgattatactgtgtagcatgggatgacagcctgagtgcttatgtcttcggaactgggaccaaggtcaccgtctacgtcacgcccaaggcccaaccccactcgtccactcttcgttccccgccctttcttcactacctatgctgagccgggctggacaaggcgacatagnnnnnnnnnnnnnnn

SEQ ID NO: 154588 - DNA, 524 bp, Homo sapiens
  misc_feature: GYAE6OF02GHEEE.10.38.D05.1.454.CMB.1.raw
  modified_base (397)..(397): a, c, t, g, unknown or other
  misc_feature (397)..(397): n is a, c, g, or t
  modified_base (476)..(476): a, c, t, g, unknown or other
  misc_feature (476)..(476): n is a, c, g, or t
  modified_base (518)..(518): a, c, t, g, unknown or other
  misc_feature (518)..(518): n is a, c, g, or t
  modified_base (523)..(524): a, c, t, g, unknown or other
  misc_feature (523)..(524): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtcccctgatcggttctctgcctccaagtctggcaacacggcctccctgaccgtctctgggctccaggctgaggatgaggctgattactactgcagcgcatattcaggccccaanagggtgtttggcggcgggactaagggtgaccgtcgtgggtcacgcccaaggctcgccccgtcggtcactctcgttcccnccctcctccactactatcgctgacgcggtctggcaagggccnatagnn

SEQ ID NO: 154589 - DNA, 575 bp, Homo sapiens
  misc_feature: GYAE6OF02GDWIW.10.38.D05.1.454.CMB.1.raw
  modified_base (452)..(452): a, c, t, g, unknown or other
  misc_feature (452)..(452): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactgggaggaggctggatccagcctggggggtccctgagactctcctgtgcagcctctgggttcagcatcagtaacgactacatgacctgggcccgccaggcctccgaggggaaggggctggagtgggtctcagttatgaaacagatggcactacatattattctgactcgtgaagggccgttcaccctctccagagactacttaccaacaactatcttgtaatcttcactatgacacaattctagganacggttcgaccgtaacacccggcctaaccttatttacttggtgcccggacgtaacctacgttggaacccttaccggccttaccgtaaacgtttcccgtggggggaccccctagggggtacccg

SEQ ID NO: 154590 - DNA, 558 bp, Homo sapiens
  misc_feature: GYAE6OF02I2F67.10.38.D05.1.454.CMB.1.raw
  modified_base (365)..(365): a, c, t, g, unknown or other
  misc_feature (365)..(365): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaacgccccaaactccttgttttgaggtcagtaagccggcctcaggagtccctgatcggttctctgcctaccaagtctggcaacncggcctccctcgacccgtctcgtcggcctccgaggcctaggacggatcggagtctgactttactactgcagcgcatacttcgacggccccaagtgggtgtttcggcggcgggactaaggtcgaccgtccgtgggtcacggcccgaaggcctccggccccgttcggtccaccgttcctcgttccccaccttccc

SEQ ID NO: 154591 - DNA, 500 bp, Homo sapiens
  misc_feature: GYAE6OF02I9NJ5.10.38.D05.1.454.CMB.1.raw
  modified_base (494)..(500): a, c, t, g, unknown or other
  misc_feature (494)..(500): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccaggggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaattctggggccagggagcccaggtcaccgtctccccagcctccaccaagggcccatcggtctcccctggccgccctgcctccaggacgccacctccgagagcacacgcggccctgggctcgcctggtcaaggactactcccactactatcgctgacgcgggctggcaaggccgacagtagnnnnnnn

SEQ ID NO: 154592 - DNA, 549 bp, Homo sapiens
  misc_feature: GYAE6OF02IUXMW.10.38.D05.1.454.CMB.1.raw
  modified_base (343)..(343): a, c, t, g, unknown or other
  misc_feature (343)..(343): n is a, c, g, or t
  modified_base (448)..(448): a, c, t, g, unknown or other
  misc_feature (448)..(448): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaatcccttgttttgaggtcagtaagcggccctcaggcgtccctgatcggttcnctgcctcaagtctggcaacacggcctcctgaccgtctcgtgggcctccgaggctgaggatggaggctgacttactactgcagcgctatacttcacggccccaagngggttgttcggcgggcgggacgtaagggtcgaccgttcgtcgggtcacggacccaaggcgtcggcccctcggtcctaccgtcgtccgttcccaccctcccg

SEQ ID NO: 154593 - DNA, 632 bp, Homo sapiens
  misc_feature: GYAE6OF02IWK5V.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttaataactatgtctcctggtaccagcaccacccaggcaaacgccccaactccttgttttgagtcagtagcgcctcagacgtcctgatcggttctctcgcctcagtctcggacaacgaccggtccctcccgtcgacccgtctcgtcgggctccgaggtctggaggtactggaggtctagtaacttactacgtgacgacgccgtactatacttaccgaccggacccctaaggtacggggtttcggtttcggggaccgggtacgggtaacgttaagggtccgtaacccggttccgttacgggtaccgtaacggttaccgaacgggtcccgtacccggtcccccgttacggtcctacccgttccgttcccggtttcccccgcccttccccg

SEQ ID NO: 154594 - DNA, 561 bp, Homo sapiens
  misc_feature: GYAE6OF02IX95S.10.38.D05.1.454.CMB.1.raw
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactccttgtttttgaggtcagtaagcggccctnaggatccctgatcggttctctgcctcaagtctggcaacncggcctcctgaccgtctctgggctccaggctgaggatgaggctgattactactgcagcgctatattcacggaccccaagnggggttntttgggccggtacgggacttaagggtcgaccggttccgtgggtaccaggccccaagggcctccggcccccgtcgggtcctacctccgtccgttcccccacccttaccccg

SEQ ID NO: 154595 - DNA, 616 bp, Homo sapiens
  misc_feature: GYAE6OF02I88P3.10.38.D05.1.454.CMB.1.raw
  modified_base (416)..(416): a, c, t, g, unknown or other
  misc_feature (416)..(416): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggacaaacgccccaaactccttgttttgagtcagtaagcgcctcaggacgtccctgatcggttctctgcctccaagtctggacaacgaccggccctccctcgacccgtctcgtcgggcctccgaggtcctggaggtanggaggctagtacttacgtactgcagccgactactacttcgaaccggaccccaaagtacggggttcgtttcgggcgggtacgggtaacgtaagggtcgtacccggttccgtgggtaccgacggtaccccgaagggcccgttaccgcccccggtttacggtccctaccgttccgttcccgttaccccctaccccgttccccg

SEQ ID NO: 154596 - DNA, 538 bp, Homo sapiens
  misc_feature: GYAE6OF02HG1PU.10.38.D05.1.454.CMB.1.raw
  modified_base (402)..(402): a, c, t, g, unknown or other
  misc_feature (402)..(402): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgagatgnggctgattactactgcagcgcatattcaggaccccaagagggttgtttgggccgggcgggaactaagggtcgacccggtcccgggtcacggcccaaggctcgccccctggtccacgtcctcgtccccgcctctacc

SEQ ID NO: 154597 - DNA, 543 bp, Homo sapiens
  misc_feature: GYAE6OF02FV4H6.10.38.D05.1.454.CMB.1.raw
  modified_base (227)..(227): a, c, t, g, unknown or other
  misc_feature (227)..(227): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagcaccacccaggcaaagcccccaaactccttgttttgaggtcagtaagcggcctcaggagtccctgatcggttctctgcctcaagtctggcaacacggcctccctgaccgtctctgggcctccgaggctgaggatggaggctagattactactgcagcgcatacttcacggacccaacgagggttgttggcggcgggactaagggtcgaccgtccgtgggtacacggcccgaaggcctcgccccctgggtccaccgttctcgttccccgcctccccg

SEQ ID NO: 154598 - DNA, 631 bp, Homo sapiens
  misc_feature: GYAE6OF02H0VPK.10.38.D05.1.454.CMB.1.raw
  modified_base (376)..(376): a, c, t, g, unknown or other
  misc_feature (376)..(376): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagccaccacccaggaccaaaacgcccccaaacttcctttgttttgaggtcagtaagccggccctgaggacgtccctgacttcggttctctcgcctcagtctggacaacncggccctccctcgacccgtctcgtcgggcctccgacggctggaggagtggagctgtacttactactgcagccgactatacttacgaccggacccctaaggtaggggttcggtttcgggaccggggtacgggtaacgttaaacgggtcggtacccggttccggttacgggtaccgacggaccccgaacgggtcccgttccggcccccgttcgggtacccgtaccgttcccgttccgttcccccgtccccttccccg

SEQ ID NO: 154599 - DNA, 524 bp, Homo sapiens
  misc_feature: GYAE6OF02GGE05.10.38.D05.1.454.CMB.1.raw
  modified_base (348)..(348): a, c, t, g, unknown or other
  misc_feature (348)..(348): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggcctccgagggaaggggctgggagtgggtctcagttatgaaacngatggcactacatattattctgactccgtgaagggcccgttcaccctctccagagacacttccaacaacatcttagtatccttacactatcgacacaatctagagagtcgacgacaccggccaacctattattgtgcgcgacatcgactacgctcaattcgtcgggccagggaccg

SEQ ID NO: 154600 - DNA, 540 bp, Homo sapiens
  misc_feature: GYAE6OF02I0QUD.10.38.D05.1.454.CMB.1.raw
  modified_base (242)..(242): a, c, t, g, unknown or other
  misc_feature (242)..(242): n is a, c, g, or t
  modified_base (494)..(494): a, c, t, g, unknown or other
  misc_feature (494)..(494): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtncttataactatgtctcctggtaccagcaccacccaggcaaacgcccccaaactcccttgttttgaggtcagtaagcggccctcaggagtccctgatcggttctctgcctccaagtctggcaacacggcctccctgaccgtctctgggcctccgaggctgaggatgaggctgacttactactgcagcgcatattcacggccccaagcgggttgtttcgggcggcgggtactaaggtcgaccgtcgtgggtccngcccaaggcctcgccccgtcggtcacctctcgttccccgccctccc

SEQ ID NO: 154601 - DNA, 545 bp, Homo sapiens
  misc_feature: GYAE6OF02HNDQ6.10.38.D05.1.454.CMB.1.raw
  modified_base (485)..(485): a, c, t, g, unknown or other
  misc_feature (485)..(485): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaagcccccaaactccttgttttgaggtcagtaagcggccctcaggagtccctgatcggttctctgcctcaagtctggcaacacggcctccctgaccgtctctgggctccgaggctgaggatggagctgattacacttgcagcgcatattcacggccccaagagggttgttggcggcgggactaagggtcgaccgtcgtgggtcncggtcccaagggcctcggcccccgtcggtccaccgttccgtcggtttcccgcccttcccg

SEQ ID NO: 154602 - DNA, 546 bp, Homo sapiens
  misc_feature: GYAE6OF02IDWBU.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggtttttccttgttgctatttcaaaaggtgtccactgtgaggttcaactggtggagactggaggaggctggatccagcctgggggtccctgagactctcctgtgcagcctctgggttcagcatcagtaacgactacatgacctcgggccccgccaggcctccgaggggaaggggctgggagtggggtctcagttattgaaacagatggcactacattattattctgactccgtggaacgggtccgttcaccctctcccagagaccacttaccaacaacattcttgttactcttcacatgacacaatctgagacgtcgaaccgacaccggaccacttattattcggtcgcgcaactatcgaacttccgcttaccaacgtttcgacggggccaacgggg

SEQ ID NO: 154603 - DNA, 522 bp, Homo sapiens
  misc_feature: GYAE6OF02IO7WZ.10.38.D05.1.454.CMB.1.raw
  modified_base (247)..(247): a, c, t, g, unknown or other
  misc_feature (247)..(247): n is a, c, g, or t
  modified_base (517)..(517): a, c, t, g, unknown or other
  misc_feature (517)..(517): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttanaactatgtctcctggtaccagcaccacccaggcaaacgcccccaaactccttgtttttgaggtcagtaagcggccctcaggacgtccctgatcggttctctgcctcaagtctggcaacacggcctccctgacctctctgggctcaggctgaggatgagctgattactactgcagcgcatattcgacggccccaagagggttgttcggcggtcgggactaaggtcgaccgtctgggtcacgccaaggctcgccccgtgcactctcgtcccncctcc

SEQ ID NO: 154604 - DNA, 552 bp, Homo sapiens
  misc_feature: GYAE6OF02G6PWV.10.38.D05.1.454.CMB.1.raw
  modified_base (490)..(490): a, c, t, g, unknown or other
  misc_feature (490)..(490): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgttgcttaataactatgtctcctggtaccagcaccacccaggcaaacgcccccaaactccttgttttgaggtcagtaagcggcctcaggagtccctgatcggttctctcgcctccaagtctggcaacacggcctccctgaccgtctcgtcgggctccgaggctggaggatggaggctgattactactgcagcgcatacttcacggcccagtgggtgttggcggcggactaaggtcgaccgtcgtgggtcncggtcccgaaggccgtccgtccccgtcggtcctaccgtcgtccggttccccgccccttcccg

SEQ ID NO: 154605 - DNA, 524 bp, Homo sapiens
  misc_feature: GYAE6OF02HK5BR.10.38.D05.1.454.CMB.1.raw
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacataggtgctttaataactatgtctcctggtaccaacaacacccaggccaggccccagactcatcatttctgatgtcagtgatcggccctttgggatttctaatcgcttctctncctcaagtctgcacacggtctcctgaccntctccggctccacgctagaggacaggctacattattactgcagctcatactacacccgagggcactctacgtnattacgtcggacgggaacggtcctgggcctcggacccgttccgtacgtaccgacgtcccgaacggcctacccgg

SEQ ID NO: 154606 - DNA, 511 bp, Homo sapiens
  misc_feature: GYAE6OF02FFV1X.10.38.D05.1.454.CMB.1.raw
  modified_base (272)..(272): a, c, t, g, unknown or other
  misc_feature (272)..(272): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactcccttgtttttgaggtcagtaagnggcccctcaggagtcccctgatcggttctctgcctccaagtctggcaacacggcctccctgaccgtctctgggctccaggctgaggatgaggctgattactactgcagcgcatattcaggccccaacagggtgtttggcggcgggactaaggtgacgtcctgggtcagcccaaggctgcccctgtcactctgtcccacctcctccactacatgctgagcgggctggcaggcgnatagnc

SEQ ID NO: 154607 - DNA, 533 bp, Homo sapiens
  misc_feature: GYAE6OF02G2UQD.10.38.D05.1.454.CMB.1.raw
  modified_base (347)..(347): a, c, t, g, unknown or other
  misc_feature (347)..(347): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagtttttgctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaaggggctgggagtgggtctcagttattgaaacngatggcactacatattattctgactcgtgaagggtccgttcaccctctccagagaccacttaccaaacaacatcttagtacttcttacactatgccacaatctagagagtcgacgacacggcctacctattatgtgcgcgactatcgacctacgcttacaacgtttcgacggggaccagggacccg

SEQ ID NO: 154608 - DNA, 563 bp, Homo sapiens
  misc_feature: GYAE6OF02HKXWH.10.38.D05.1.454.CMB.1.raw
  modified_base (458)..(458): a, c, t, g, unknown or other
  misc_feature (458)..(458): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactccttgttttgaggtcagtaagcggccctcgaggacgtccctgactcggttctctcgcctcaagtctggacaacacggcctcctgaccgtctcgtcgggctccgacggctggaggatgaggtctgtacttactacgtgcagcgcatacgttcacggccccaagngggttgtttcgggcgggtacggacgtaaggtcgacccgtcgtaggtcgacggacccaaggccttccgccccgttcggcctccgttcgtccgttccccaccttccc

SEQ ID NO: 154609 - DNA, 533 bp, Homo sapiens
  misc_feature: GYAE6OF02H9ERS.10.38.D05.1.454.CMB.1.raw
  modified_base (483)..(483): a, c, t, g, unknown or other
  misc_feature (483)..(483): n is a, c, g, or t
  modified_base (508)..(508): a, c, t, g, unknown or other
  misc_feature (508)..(508): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggcaaacgccccaaactccttgtttttgaggtcagtaagcggccctcaggagtccctgatcggttctctgccctccaagtctggcaacacggcctccctgaccgtctctgggctccaggctgaggatgaggctgatttactactgcagcgcatattcacggccccaacgagggtgtttgggcgggcgggacgtaagggtcgaccgtccgtgggtcagcccgaaggcgtcgccccgtcgtcactctcgttcccnccctcctccactactactcgctcgngcggtcgtggcgacggccgcatagc

SEQ ID NO: 154610 - DNA, 569 bp, Homo sapiens
  misc_feature: GYAE6OF02INC6V.10.38.D05.1.454.CMB.1.raw
  modified_base (401)..(401): a, c, t, g, unknown or other
  misc_feature (401)..(401): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttaataactatgtctcctggtaccagcaccacccagcaaacgccccaaactccttgttttgaggtcagtaagcggcctcaggacgtcctgatcgttctctgcctccaagtctggcaacacggcctccctgaccgtctcgtgggctccgaggctgagntgagctgattactatgacagcgcatacttcgacggacccaagtggttcgttgggcggcgggtaactaagggtcgaccggttccgtagggtaccgacggacccgaagggtccgttccggcccccgttcggtcctaaccttcccgttacggttccccctaccccgttccc

SEQ ID NO: 154611 - DNA, 595 bp, Homo sapiens
  misc_feature: GYAE6OF02HYZEF.10.38.D05.1.454.CMB.1.raw
  modified_base (325)..(325): a, c, t, g, unknown or other
  misc_feature (325)..(325): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgacttttgttgcttataactatgtctctggtaccagcaccacccaggcaaacgcccccaaacttccttgtttttgaggtcagtaagcgccctnaggacgtccctgatcggttctctcgcctcaagtctggacaacgaccggcctccctgaccgtctcgtgggcctccgaggctggaggatggaggctgattactactgcagcgcatacttcgaacggacccaacgtagggtgtttcggcgggcggtacgtaagggtcgaccggttccgttgggtccgacggtccccgaagggtcccgttacccgccccccggttacggtccctaaccgttcccgtttccggtttccccccgccccttaccccg

SEQ ID NO: 154612 - DNA, 452 bp, Homo sapiens
  misc_feature: GYAE6OF02GH8MU.10.38.D05.1.454.CMB.1.raw
  modified_base (325)..(325): a, c, t, g, unknown or other
  misc_feature (325)..(325): n is a, c, g, or t
  modified_base (442)..(452): a, c, t, g, unknown or other
  misc_feature (442)..(452): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggcccccaanagggtgtttggcggcgggactaaggtgaccgtctgggtcagcccaaggctgccccctggtcactctgttcccgccctcctccactactatgctgagcgggctggcaaggcgcatagnnnnnnnnnnn

SEQ ID NO: 154613 - DNA, 575 bp, Homo sapiens
  misc_feature: GYAE6OF02F6LQ4.10.38.D05.1.454.CMB.1.raw
  modified_base (548)..(548): a, c, t, g, unknown or other
  misc_feature (548)..(548): n is a, c, g, or t
  modified_base (550)..(575): a, c, t, g, unknown or other
  misc_feature (550)..(575): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcgttcgtctgcctccacgtactcgcgacaacgccgtccctcgaccgtcctctcggtcggtccctacggcgtcgtaggagtgtagggacgtgtagttaaccttacttacgcgacgcggccatatttactacggaccccgaaccaagggtgggttttgggtcggcggggacgtaaggtaggaccgtaccctcgggttcgacgaccgacggacgtcgcccccgtccccggtcgacctacgtccgtttcccgtaccccctcccgttcccaacccgtacttaactgtaccgtcggagaccggggccgttggcgaaacggcggccacttaggancnnnnnnnnnnnnnnnnnnnnnnnnnn

SEQ ID NO: 154614 - DNA, 533 bp, Homo sapiens
  misc_feature: GYAE6OF02G73RZ.10.38.D05.1.454.CMB.1.raw
  modified_base (400)..(400): a, c, t, g, unknown or other
  misc_feature (400)..(400): n is a, c, g, or t
  modified_base (526)..(526): a, c, t, g, unknown or other
  misc_feature (526)..(526): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgcccccaaactcccttgttttgaggtcagtaagcggcctcaggagtccctgatcggttctctgcctcaagtctggcaacacggcctccctgaccgtctctggctccgagctgaggntgagctgattactactgcagcgctatattcaggccccaagagggttgttggccggtcgggacgtaaggtcgaccgtcgtgggtcaggcccgaaggcctcgccccgtggtccactcgtcgttccccnccctccc

SEQ ID NO: 154615 - DNA, 521 bp, Homo sapiens
  misc_feature: GYAE6OF02FG73K.10.38.D05.1.454.CMB.1.raw
  modified_base (440)..(440): a, c, t, g, unknown or other
  misc_feature (440)..(440): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccacccaggcaaacgccccaaactccttgttttgaggtcagtaagcggccctcaggagtccctgatcggttctctcgcctccaagtctggcaacacggcctcctgaccgtctctgggctccgaggctgagatgagctgattactactgcagcgcatattcacggccccaagngggttgttggcggcggactaggtcgaccgtcgtggcacgcccgaaggcctcgcccctggtcacctctcgttcccacctccc

SEQ ID NO: 154616 - DNA, 548 bp, Homo sapiens
  misc_feature: GYAE6OF02GU584.10.38.D05.1.454.CMB.1.raw
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaagccccaaactccttgttttgaggtcagtaagcggccctcaggagtccctgatcggttctctgcctcaagtctggcaacacggcctccctgaccgtctctcgggctccgaggctgaggatgaggctgacttactactgcagcgcatattcacggcccaacgtaggtcgtttggccggtcgggactaaaggtcgaccgtcgtgggtcacggcccaaggcctcgcccccgtcggtccaccgttccgtcgttccccacccttaccccg

SEQ ID NO: 154617 - DNA, 453 bp, Homo sapiens
  misc_feature: GYAE6OF02GVDPV.10.38.D05.1.454.CMB.1.raw
  modified_base (435)..(435): a, c, t, g, unknown or other
  misc_feature (435)..(435): n is a, c, g, or t
  modified_base (441)..(453): a, c, t, g, unknown or other
  misc_feature (441)..(453): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagcccaaggctgccccctcggtcactctcgtcccgccctcctccactactatgctgagcgggctggcaggcncatagnnnnnnnnnnnnn

SEQ ID NO: 154618 - DNA, 526 bp, Homo sapiens
  misc_feature: GYAE6OF02FZBZJ.10.38.D05.1.454.CMB.1.raw
  modified_base (363)..(363): a, c, t, g, unknown or other
  misc_feature (363)..(363): n is a, c, g, or t
  modified_base (443)..(443): a, c, t, g, unknown or other
  misc_feature (443)..(443): n is a, c, g, or t
  modified_base (520)..(520): a, c, t, g, unknown or other
  misc_feature (520)..(520): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctctggtaccagcaccacccaggcaaacgcccccaaactccttgttttgaggtcagtaagcggcctcaggagtccctgatcggttctctgcctcaagtctggcaacncggcctccctgaccgtctctgggcctccaggctgaggatggagctgattactactgcagcgcatattcacggccccaagngggttgttggcggcgggactaagggtgaccgtctgggtcaggcccaaggcctcgccccctggtcactctcgttcccncctccc

SEQ ID NO: 154619 - DNA, 321 bp, Homo sapiens
  misc_feature: GYAE6OF02HWLYN.10.38.D05.1.454.CMB.1.raw
  modified_base (320)..(321): a, c, t, g, unknown or other
  misc_feature (320)..(321): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtctgggtcagcccaaggctgcccctcggtcactctgttcccaccctcctccactactatgctgagcgggctgggcaaggcgcatagnn

SEQ ID NO: 154620 - DNA, 558 bp, Homo sapiens
  misc_feature: GYAE6OF02IUALR.10.38.D05.1.454.CMB.1.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (423)..(423): a, c, t, g, unknown or other
  misc_feature (423)..(423): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctctgtaccagcaccaccagcaaacgcccccaaatccttgttttgagtcagtaagcgcctnaggagtccctgattcggttctctgcctccaagtctgcaacncggcctcactgaccgtctcgtgggcctccgaggctggacggntgagtctgattactactgcagcncattatcacggcccaagtgggtgttcggcggacggtacgtaagggtcgtaccgtcgtcgggtccacggtcccgaaggtccgtaccggtcccccgttacgggtccctaccgtccgttccggttcccccgtaccccg

SEQ ID NO: 154621 - DNA, 564 bp, Homo sapiens
  misc_feature: GYAE6OF02IWASW.10.38.D05.1.454.CMB.1.raw
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
  modified_base (352)..(352): a, c, t, g, unknown or other
  misc_feature (352)..(352): n is a, c, g, or t
  modified_base (402)..(402): a, c, t, g, unknown or other
  misc_feature (402)..(402): n is a, c, g, or t
tcagcatagtagtgcacgaccggtgctcgatttagtatctgatagttgggtttgggggggagaggagcccagcactgggattccggaggtgtttccattcggtgatcagcactgaacacagaggactcaccacggagttttggctgagctgggttttccttgttgctatttcaaaaggtgtccactgtgaggttcaactggtggagactgggaggaggctggatccagcctggggggtccctgagactctcctgtgcagcctntgggttcagcatcagtaacgactacatgaccctgggcccncaggctccgaggggaaggggctgggagtcgggtctcgagttatgaaacngatggcactacatattattctgactccgtgaacgggtccgttcaccctcnccagagaccacttaccaacaacattcttagtattcttacactatcgacacaatcagaagtacgtacgaacgacacgggcctacgtaagttagttgtcgccgtcgaacacgtacgaacctacgctacgaacgtttcggacggggccctagggggcctccccgg

SEQ ID NO: 154622 - DNA, 530 bp, Homo sapiens
  misc_feature: GYAE6OF02H4VNU.10.38.D05.1.454.CMB.1.raw
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggctccgaggggaaggggctggagtgggtctcagttattagaaacagatggaactacatattatctgactcgtgaagggccggttcaccctctccgagagacctacttaccaacaacatcttgtacttccttcacatcgacacaatctgagcgtacgacgacacggccactattatgtgcgcgacntagactacgctacaagttccgnggggccaggggctacccgg

SEQ ID NO: 154623 - DNA, 582 bp, Homo sapiens
  misc_feature: GYAE6OF02J2L0O.10.38.D05.1.454.CMB.1.raw
  modified_base (242)..(242): a, c, t, g, unknown or other
  misc_feature (242)..(242): n is a, c, g, or t
  modified_base (288)..(288): a, c, t, g, unknown or other
  misc_feature (288)..(288): n is a, c, g, or t
  modified_base (339)..(339): a, c, t, g, unknown or other
  misc_feature (339)..(339): n is a, c, g, or t
  modified_base (410)..(410): a, c, t, g, unknown or other
  misc_feature (410)..(410): n is a, c, g, or t
tcagcatagtagtgcacgaccggtgctcgatttagtatctgatagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccagggaagggctggagtgggtctcagttatgaaacngatggcactacatattatctgactccgtgaagggccgttcaccctntccagagacacttccaacaacatcttgtatcttcacatgcacaatctgagngtcgacgacacggccaccgtatttacttgtcgcgcgaacatgactacgctacaattcgtgggccagggacncccgaggtcgacccgtcctccccgagccctccgaacccgaacgggccccaagttcccggtaccgtttcccccgtacgggcccgaccccgttcggcccttcccgacggtaccgcctaccccgtccggacgaccgaccacgacggcccggcccgtacgggtcctcggtacccgg

SEQ ID NO: 154624 - DNA, 599 bp, Homo sapiens
  misc_feature: GYAE6OF02IICQB.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgttgctttataactatgtctcctggtaccagcaccacccaggcaaacgccccaaactccttgtttttgaggtcagtaagcggcctcaggacgtccctgacttcggttctctcgcctccaagtctggacaacgaccggcctccctcgacccgtctcgtcgggctccgaggctgaggatgaggctgattactactgcagcgcatacttcgacggacccctaacgaggggtttcgtttcgggccgggtacggggtaacttaagggtcgacccggttccgtaggggttccaacggccccgaagggccttcccggcccccgttcgggtcctaccgttccgttccgttcccccaccccttccccg

SEQ ID NO: 154625 - DNA, 542 bp, Homo sapiens
  misc_feature: GYAE6OF02IG9S5.10.38.D05.1.454.CMB.1.raw
  modified_base (300)..(300): a, c, t, g, unknown or other
  misc_feature (300)..(300): n is a, c, g, or t
  modified_base (493)..(493): a, c, t, g, unknown or other
  misc_feature (493)..(493): n is a, c, g, or t
  modified_base (504)..(504): a, c, t, g, unknown or other
  misc_feature (504)..(504): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctcgggcccnccaggctccgagggagggctggagtgggctcagttatgaaacagatggcactacatattatctgacttccgtagaacgggtccgttacaccctctccagacactacccttcaaacacatcttagtacttcttcacatcgcaactaatctagagtacgtaccgaacgaccaccggacctaaccttattattcgngtccgcgaacngtgacctacgcttacgattcgtacgggcctaggtaccg

SEQ ID NO: 154626 - DNA, 645 bp, Homo sapiens
  misc_feature: GYAE6OF02HFK80.10.38.D05.1.454.CMB.1.raw
  modified_base (302)..(302): a, c, t, g, unknown or other
  misc_feature (302)..(302): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctggggccccnccgaggcctccgaggggaaggggctgggaggtgggtctcgagttatgaaacagatggcactacatattattctgactccgtaggaacgggtccggttcaccccttctaccaggacgaccctaccttaccaaacctaaactacttccttagttaacttcctttaccaactacttcgacctaaacaaattccgtaggaacgtaacggttccgaaacccgaacgaacccgggccctaaccgttaatttacgtttcggtcgccggaccgtaactaagttaccggaaaccctttaccggaccttaaccgtaaacggttttccggtacggggggaccccctaagggggg

SEQ ID NO: 154627 - DNA, 612 bp, Homo sapiens
  misc_feature: GYAE6OF02HNV3Z.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagccaccacccagacaaacgccccctaaactccttgttttgaggtcagtagccgcctcaggactcctgactcggttctctcgcctccaagtctggacaacgaccggcctcccgtcgacccgttctcgtcgggctccgaggcgtggaggagtcggaggctggtacttaccgtactcgacacgccgactattacttacgaccggacccctaagtacggggttacggtttcggggcgggtacgggtacgtaagggtcgaccggttcgtgggtaccgcggacccgaagggtccctccggcccccgttcggtccgtaccgttccgtacccgttcccctacccgttcccc

SEQ ID NO: 154628 - DNA, 602 bp, Homo sapiens
  misc_feature: GYAE6OF02IBDZ7.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctcctgtgcagcctcgtgggttcagcatcaagtaacgactacatgaccgtcgggcccgccaggcctccgaagggaacgggctagggaggtgggtctcgtagttatagaaacagatggcaactacatattatctgactcggtagaacggtccgttcgaccctcgtaccgagacgacctacttaccaaacaactattcttagtacttacttcaactatcgacaacctaattccgtagacgtaagtccgaaaccgtaccgtaaccggccctaaaccgttagtttacgtcggtacgccgtaacggactagtacgaacctccgtctacctaagtttcgggacgggtcccgaagggtacccg

SEQ ID NO: 154629 - DNA, 560 bp, Homo sapiens
  misc_feature: GYAE6OF02HI7X6.10.38.D05.1.454.CMB.1.raw
  modified_base (323)..(323): a, c, t, g, unknown or other
  misc_feature (323)..(323): n is a, c, g, or t
  modified_base (368)..(368): a, c, t, g, unknown or other
  misc_feature (368)..(368): n is a, c, g, or t
  modified_base (478)..(478): a, c, t, g, unknown or other
  misc_feature (478)..(478): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgactttgtgcttataactatgtctcctggtaccagcaccaccaggacaaacgcccccaaactccttgttttgaggtcagtaagccggcctnaggacgtccctgatcggttctctcgccctacaagtctggccaacnccggccctcccgtgacccgtctcgtcgggcctccgaggtctgaggatgaaggtctgaatttacacgtgcgagcgctatattccgaacggccccaagtggttgttggcggngggactaaggtcgaccgtcgtggccacggcccaaggtcctccgccccgtcggccaccgttccttacgtcccctacctccccg

SEQ ID NO: 154630 - DNA, 534 bp, Homo sapiens
  misc_feature: GYAE6OF02G04KU.10.38.D05.1.454.CMB.1.raw
  modified_base (338)..(338): a, c, t, g, unknown or other
  misc_feature (338)..(338): n is a, c, g, or t
  modified_base (525)..(525): a, c, t, g, unknown or other
  misc_feature (525)..(525): n is a, c, g, or t
  modified_base (533)..(534): a, c, t, g, unknown or other
  misc_feature (533)..(534): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgcccccaaactccttgtttttgaggtcagtaagcggccctcaggacgtccctgatcggttctctgcctccaagtctggcaacacggcctccctgaccgtntctgggctcaggctgagatgagctgattacactgcagcgcatattcacggccccaagagggttgtttgggacggcgggactaagggtcgtaccggtccgttgggtacacgcccgaaggctcgccccctggtccactctcgttccccacctcctccactctagtcgctgacggccggctcggcaggcncgagtagnn

SEQ ID NO: 154631 - DNA, 616 bp, Homo sapiens
  misc_feature: GYAE6OF02JA06T.10.38.D05.1.454.CMB.1.raw
  modified_base (246)..(246): a, c, t, g, unknown or other
  misc_feature (246)..(246): n is a, c, g, or t
  modified_base (400)..(400): a, c, t, g, unknown or other
  misc_feature (400)..(400): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttanaactatgtctcctggtaccagccaccaccaggcaaacgccccctaaatcctttgttttcgaggttccaaggtaacgcggccctcaggacgtcccgtgacttcggttctctcgcctcaagtctaggcaaacgccggtcctcccgtgacccgttcncgtacgggcctcgaggtctgaggtactggacggtctagaactttactacgttgaccgagcgcattacttcgacggtaccccaagtaggggttcgttcgggcgggacggtaacgtaacgggtcgtaaccgttccgtagggtccacggtaacccgaacggtccgacccggtccccgttcggcctaccgttcccgttaccggttccccaccccttcccg

SEQ ID NO: 154632 - DNA, 534 bp, Homo sapiens
  misc_feature: GYAE6OF02IY5XJ.10.38.D05.1.454.CMB.1.raw
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (517)..(517): a, c, t, g, unknown or other
  misc_feature (517)..(517): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctccgaggggaaggggctggagtgggtctcgagttatgaaacngatggcactacatattattcngactcgtgaacgggtcccggttcaccctctccagagacacttaccaacaacntccttgtattcttcacatcgccaactaatcctagagacgtcgacgacaccggcctaacctattatgtcgcgcgatagtcgactacgctacgaattcgnggggtcccaggggtacc

SEQ ID NO: 154633 - DNA, 528 bp, Homo sapiens
  misc_feature: GYAE6OF02GRSEY.10.38.D05.1.454.CMB.1.raw
  modified_base (320)..(320): a, c, t, g, unknown or other
  misc_feature (320)..(320): n is a, c, g, or t
  modified_base (438)..(438): a, c, t, g, unknown or other
  misc_feature (438)..(438): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgccccaaactccttgttttgagtcagtaagcggcctnagagtccctgatcggttctctgcctcaagtctgcaacacggcctccctgaccgtctcgtgggcctccaggctgaggatgaggctgattactactgcagcgcatattcacggcccaagngggttgttggcggcggactaaggtcgaccgtcgtgggtcacggacccaggcctcgcccccgtggtccaccttcctcgttccccacctccc

SEQ ID NO: 154634 - DNA, 587 bp, Homo sapiens
  misc_feature: GYAE6OF02IHU45.10.38.D05.1.454.CMB.1.raw
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgccactggaaccagcagtgactttgtgcttataactatgtctcctggtaccagcaccacccaggacaaacgccccaaactccttgttttgagtcagtaacgcggcctcaggacgtccctgtactcggttctctcgcctcaacgtctcgcaacgacggcctccctgaccgtctcgtcgggcctccgaggctggaggatggagctagtacttactacgtgacagcgactatacttcgacggaccccaagtacggggttggtttcgggccgggtcggaacgtaagggtcgtacccggtcgtgggtaccgacggacccgaaggtccgtcgtcccccgtacggtcctacgtccgtccggttcccccgccctaccc

SEQ ID NO: 154635 - DNA, 578 bp, Homo sapiens
  misc_feature: GYAE6OF02I1U2H.10.38.D05.1.454.CMB.1.raw
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (577)..(577): a, c, t, g, unknown or other
  misc_feature (577)..(577): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgccccaaactccttgttttgagtcagtaagcgccctnaggntccctgatcggttctctgccctccaagtctgggccaacgacggccctccctgacccgtctctgggcctccgaggctgaggatgaggctgattactactgcagcgcatacttcacggaccccaacgtagggttgtttcgggcgggacgggtaccgtaaggtcggaccgtccgtgggtcacgacccgagggcctcgccccgtcggtccacctcgttccgttccccaccccttccctccctaccttacctagttccgcgttcggacggccgggtccgtcggaccgacggccgaccagtcgnc

SEQ ID NO: 154636 - DNA, 457 bp, Homo sapiens
  misc_feature: GYAE6OF02I0BM4.10.38.D05.1.454.CMB.1.raw
  modified_base (246)..(246): a, c, t, g, unknown or other
  misc_feature (246)..(246): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (440)..(457): a, c, t, g, unknown or other
  misc_feature (440)..(457): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggcctcaggagtccctgatcggttctctgcctccaagtctggcaacncggcctcctgaccgtctctgggctccaggctgaggatgaggctgattactactgcagcgcaatattcacggccccaagagggtgttgggcggcgggactaaggtgacccgtcgtgggtcagcccaaggctacgcccctggcactctcgtcccacctcctcactactancnctgagcggctggcaggcgcagagnnnnnnnnnnnnnnnnnn

SEQ ID NO: 154637 - DNA, 717 bp, Homo sapiens
  misc_feature: GYAE6OF02J0PF0.10.38.D05.1.454.CMB.1.raw
  modified_base (365)..(365): a, c, t, g, unknown or other
  misc_feature (365)..(365): n is a, c, g, or t
tcagcatagtagtgcacgaccggtgctcgatttagtatctgatagttgggtttgggggggtcgtcgaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttatactatgtctctgtacagcaccaccagcaacgacccccaaactccttgttttgacgtcagtacgcggcctcgaggacgtccctgactcggttctctgtccctcaagtcctaggcaacncggccctccgtcgacccgtctcgtcgggcctcccgagggtcctagggtaggtatcggacggtaccgttaggtaactttaaccgtacggttcgaccgtaacgggccggacttaacgtttaccgtttaccgaaccgggtaaccccctaaagggtaccgggggtttacggttttaccggggaccggggtaaccggggttaaaccggttaaagggtcccgggtaaccccggttccgggtcgggttacccggaaccgggtaccccggtaacgggtcccgttcccgggaccccccccggtttgggtacccttacccgttacccggtttcccggttccccccgtcccccgtttaccccg

SEQ ID NO: 154638 - DNA, 656 bp, Homo sapiens
  misc_feature: GYAE6OF02IMMNL.10.38.D05.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactggaaccngcagtgactttgtgcttanaactatgtctcctggtacagcaccaccaggacaaacgccccaaactccttgttttgacgtcagtaagccggtcctcacggagtcctgacttcggttctctcgcctacaagtctcggcaacacggccctccctgaccgtctcgtcgggccttccgaggtccgtagaggtactggaacgtctaggtactttaaccgtaacgttcggacctacggccgacctaagttaacctttccggaacggtacccccaaaggtacggggttcgtttcgggcgggtacgggaaccttaaagggtccgtacccggttccggtacgggtccaaaccgggtcccgtaaacgggtcccgttaccggtaccccccgttcgggtactaacccgttccgtttacccgttcccccgtaacccttccccgg

SEQ ID NO: 154639 - DNA, 547 bp, Homo sapiens
  misc_feature: GYAE6OF02GNVPI.10.38.D05.1.454.CMB.1.raw
tcagcatagtagtgcacgaccggtgctcgatttagtatctgatagttgggtttgcggggagaggagcccagcactgggattccgaggtgtttccattcgatgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctcgtgggttcagcatcagtaacgactacatgaccgtcgggcccgcaggcctccgagggagggctggagtgggtctctagttattagaaacagatcggacactacatattattctcgactcgtgaacggtccggtcaccctctccagacgacacctttaccaacaacactcttagtacttcttacactatcgacacaactctagagtacgtacgacgacgaccgaccaccttacttattgtcgcgacgactactacgtactacgtacctactacgttcgtcgggtaccgg

SEQ ID NO: 154640 - DNA, 574 bp, Homo sapiens
  misc_feature: GYAE6OF02JFOZA.10.38.D05.1.454.CMB.1.raw
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccaggccgtgggggtccctgagactctcctgtgcagcctgtggttcagcatcagtaacgactacatgaccctgggccccgccaggcctccgaggggaacgggcgtgggagtgggtctcgagttatagaaacagagtggacactacattattattctgactccggtggaacggggtcccgttcacccttcgtccaagacgacctacttcccaaactaactattcttgtactcctttaccacatcgaccaactaagtctagagtacgtacaaccgacaccggccctaaacctnttaattcggngccgctaatgtcgaacctcgctactagttcggacggggtaccaggtacccg

SEQ ID NO: 154641 - DNA, 625 bp, Homo sapiens
  misc_feature: GYAE6OF02J2KEI.10.38.D05.1.454.CMB.1.raw
  modified_base (168)..(168): a, c, t, g, unknown or other
  misc_feature (168)..(168): n is a, c, g, or t
  modified_base (614)..(614): a, c, t, g, unknown or other
  misc_feature (614)..(614): n is a, c, g, or t
  modified_base (623)..(623): a, c, t, g, unknown or other
  misc_feature (623)..(623): n is a, c, g, or t
tcagcatagtagtgcacgaccggtgctcgatttagtatctgatagttgggtttgggggtccgtgagactctcctgtgcagcctctgggttcagcatcagtaacgactacatgacctgggcccgccaggctccagggaaggggctggagtgggtctcagttatgaaacngatggcactacatattattctgactccgtgaagggccgttcaccctctccagagaccacttccaaacaacattcttgtactcttcacatgcacaatctgagagtcgacgacaccggccacctattatgtgcgacgacatcgactacgctacaattccgtggggccagggacgcccgagggtccacccgtcctccccagtccctccgaaccgaacgggccctacgtccggtaccctttcccccgtcggcccgtcccgtcgtcccgttacccgacgggaccgaccgtacccgtccggaacgaccgacaacccggacgggtcccggccccgtcgggccgtccggtcccgtacgggtaccaacgggtacccttaacctcccgtaacctacgtactcgccgtacgacgggccggtaccgtcggaaccgtacggccgtaacgagttaccggngctcgctcngc

SEQ ID NO: 154642 - DNA, 474 bp, Homo sapiens
  misc_feature: GYAE6OF02I7GXJ.10.38.D05.1.454.CMB.1.raw
  modified_base (451)..(474): a, c, t, g, unknown or other
  misc_feature (451)..(474): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattacactgcagcgcatattcacggccccaagagggtgtttgggcggcgggacgtaaggtcgaccgtctgggtcagcccgaaggctcgcccccgtcggtcacctctcgtccccgccctcctccactactatgctgagcggctggcaacggcgcatagnnnnnnnnnnnnnnnnnnnnnnnn

SEQ ID NO: 154643 - DNA, 324 bp, Homo sapiens; identical to SEQ ID NO: 154532
  misc_feature: GYAE6OF02JBOE6.10.38.D05.1.454.CMB.1.raw
  modified_base (319)..(324): a, c, t, g, unknown or other
  misc_feature (319)..(324): n is a, c, g, or t

SEQ ID NO: 154644 - DNA, 565 bp, Homo sapiens
  misc_feature: GYAE6OF02I2252.10.38.D05.1.454.CMB.1.raw
  modified_base (507)..(507): a, c, t, g, unknown or other
  misc_feature (507)..(507): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccacccaggacaaacgcccccaaactcctttgttttgaggtcaggtaagccggcctcgaggacgtccctgatcggttctctgcctccaagtctggcaacgaccgcctccctgaccgtctcgtcgggctccgaggctggaggatggaggctagtacttactactgcagcgactatacttccgacggacccaagtgggttgttcgggcgggtcggactaagggcgaccgtccgtggtacncggacccaaggcctccgccccgtcggtacctaccttccgtccgttccccacccgtccc

SEQ ID NO: 154645 - DNA, 524 bp, Homo sapiens
  misc_feature: GYAE6OF02HR7K8.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcagttattgaaacagatggcactacatattatctgactccgtgaacgggccgttcaccctctccagagacacttccaacaacatcttgtattcttcacatgcacaatctgagagtcgacgacacggccaacttatattcgtgaccgcgacatcgacctacgctcgtaattcgtaggggcccagggaccg

SEQ ID NO: 154646 - DNA, 545 bp, Homo sapiens
  misc_feature: GYAE6OF02GDXBE.10.38.D05.1.454.CMB.1.raw
  modified_base (437)..(437): a, c, t, g, unknown or other
  misc_feature (437)..(437): n is a, c, g, or t
tcagcatagtagtgcacgaccggtgctcgatttagtatctgatagttgggtttggggggggtctcaggaggcagcgctctcaggacgtcaccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagcggccctcgagggtttctagtcgcttctctgcctccaagtctgcaacacgcctcctgacatctctggctccagctgacgacgaggctgaatattactgcagctcatatgtagagtggtntccttctttcgtaacgggttttcggcgggtacgggaccgtaggcgttaccggaccgttacccgtaacgttccgaaccggacccgaacggtccgtcccgtaccccccgg

SEQ ID NO: 154647 - DNA, 599 bp, Homo sapiens
  misc_feature: GYAE6OF02GHACN.10.38.D05.1.454.CMB.1.raw
  modified_base (246)..(246): a, c, t, g, unknown or other
  misc_feature (246)..(246): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
  modified_base (401)..(401): a, c, t, g, unknown or other
  misc_feature (401)..(401): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttanaactatgtctctggtaccagcaccaccaggcaaacgccccaaactccttgttttgagtcagtaagcgcctnagntccngatcgttctctcgcctcaagtctcggcaacacggcctcccgtcgaccgtctcgtcgggcctccgaggtctggaggtntggacggtctagacttactacgtgcagcgacattacttcgaaccggacccctaacgtaggggttcggtttacgggccgggtacgggtaacttaagggtcgtacccgttcgtgggtaccgacggacccgtaagggtccctaccggcccccgttacggtcctaaccgttccttcccggttacccctaccccgttaccccg

SEQ ID NO: 154648 - DNA, 591 bp, Homo sapiens
  misc_feature: GYAE6OF02HPZD6.10.38.D05.1.454.CMB.1.raw
  modified_base (227)..(227): a, c, t, g, unknown or other
  misc_feature (227)..(227): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgtcctgactcagcctccctccgcgtccggtctcctggacagtcagtcacatctcctgcactggaaccngcagtgtacttttgtgcttaataactatgtctcctggtaccagcaccaccaggacaaacgccccaaacttccttgttttgaggtcagtacgccggcctgaggactccctgacttcggttctcgtcgtccctaccaagtctcggacaacgccggccctcctcgtaccgtctcgtcggcctccgacggctggagtatggaggtctagtacttactactcgcagccactatacttccgacgtacccgaagtcgggttggttcgggcggtacgggagtaacgggtcgaccggtcgtagggtccacggacccgacggtccgtcccgccccgtcggtaccaccgttccgttccgtccccctaccctcccg

SEQ ID NO: 154649 - DNA, 548 bp, Homo sapiens
  misc_feature: GYAE6OF02HUXTW.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaacgccccaaactccttgttttgaggtcagtaagcggccctcaggagtccctgatcggttctctgcctcaagtctgcaacacggcctccctgaccgtctcgtgggctccaggctgaggatggagctgattactactgcagcgcattattcgacggaccccaagtacgggttgttcggcggtcgggactaaggtcgaccgtcgtgggtcacggcccgaaggtcctaccgccccgtcggtccaccttcgtccgttccccgcccttccc

SEQ ID NO: 154650 - DNA, 324 bp, Homo sapiens
  misc_feature: GYAE6OF02I9T0R.10.38.D05.1.454.CMB.1.raw
  modified_base (320)..(324): a, c, t, g, unknown or other
  misc_feature (320)..(324): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaacagggtgtttggcggcgggactaaggtgaccgtcctgggtcagcccaaggctcgcccctggtcactctgttccccaccctcctccacactatgctgagcgggctggcaaggcgcatagnnnnn

SEQ ID NO: 154651 - DNA, 529 bp, Homo sapiens
  misc_feature: GYAE6OF02FKS7Y.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagccccaaactccttgttttgaggtcagtaagcggccctcaggacgtccctgatcggttctctgcctcaagtctggcaacacggcctccctgaccgtctctgggcctccaggctgaggatgaggctgattactactgcagcgcatattcaggccccaagagggtgtttggcggcggaactaaggcgaccgtcgtggtccgaggcccaagggcctcgcccctggtcacgtctcgttccccaccctccc

SEQ ID NO: 154652 - DNA, 517 bp, Homo sapiens
  misc_feature: GYAE6OF02I67BL.10.38.D05.1.454.CMB.1.raw
  modified_base (329)..(329): a, c, t, g, unknown or other
  misc_feature (329)..(329): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (515)..(517): a, c, t, g, unknown or other
  misc_feature (515)..(517): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggccaaaacccccaaactccttgttttgaggtcagtaagcggccctcaggagtccctgatcggttctctgcctccaagtctggcaacacggcctcccngaccgtctctgggctccaggctgaggatgaggctgattactactgcagcgcatatcacgcccaagagggtgttggcggcgggacgtaaggtcgaccgtcgtgggtcacgccaaggctcgcccctcggtcactctcgttcccgcctcctccactactntcgcgtgcgcggctggcgaggcncanagnnn

SEQ ID NO: 154653 - DNA, 543 bp, Homo sapiens
  misc_feature: GYAE6OF02FSHMT.10.38.D05.1.454.CMB.1.raw
  modified_base (347)..(347): a, c, t, g, unknown or other
  misc_feature (347)..(347): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggcccgcaggctccgagggaaggggctgggagtgggtctcgagttatgaaacngatggcactacatattatctgactcggtgaacgggtccgttcaccctctccagagacacttccaacacatcttgtactcttacacatgacactaatctagagtacgtccgaacgacaccggacctaaccttattacttgcggtccgcgaactatgacttaccggcttaccgaatttcggacggggtccaacggggg

SEQ ID NO: 154654 - DNA, 590 bp, Homo sapiens
  misc_feature: GYAE6OF02IF45W.10.38.D05.1.454.CMB.1.raw
  modified_base (325)..(325): a, c, t, g, unknown or other
  misc_feature (325)..(325): n is a, c, g, or t
  modified_base (450)..(450): a, c, t, g, unknown or other
  misc_feature (450)..(450): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttaataactatgtctcctggtaccagccaccacccaggaccaaacgcccccaaactccttgttttgaggtcagtagcgcctnaggagtcctgattcggtctctcgcctcaagtctggaccaacgaccggcctccctgacccgtctcgtcgggctccgaggctggagtagtgacggcttggtaacttacgtacgttcgcgagccgtanatacttcgaaccggtaccccaaaggtggggttgttcgggacgggtcgggtaataagggtcgtaccgtcgtcgggtccgaacggcccgaaggcctaccggccccgttcggtccaccgttccttacgtcccccaccttcccc

SEQ ID NO: 154655 - DNA, 539 bp, Homo sapiens
  misc_feature: GYAE6OF02GGRGO.10.38.D05.1.454.CMB.1.raw
  modified_base (537)..(537): a, c, t, g, unknown or other
  misc_feature (537)..(537): n is a, c, g, or t
tcagcatagtagtgcacgaccggtgctcgatttagtatctgatagttggggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaatccttgttttgaggtcagtaagcggccctcaggatccctgattcggttctctcgcctccaagtctggcaacgaccggcctccctgaccgtctcgtggcctcaggctgaggatgaggctgattactactgcagcgcatacttcacgccccaacgaggttgttggcgggacggacgtaggtcgaccgtccgtggtcgacgccgaggctcgccccgtcgtcctacctcgtccgttcccaccctccctccacttactactcgctcgacggccggtctggacacggcgcgtatgncg

SEQ ID NO: 154656 - DNA, 556 bp, Homo sapiens
  misc_feature: GYAE6OF02HYEG0.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttaataactatgtctcctggtaccagcaccacccaggcaaacgcccccaaactccttgttttgagtcagtacgcgcctcaggacgtccctgactcggttctctcgccctccaagtctcggcaacgacggcctccctgaccgtctcgtcgggcctccgaggtctggaggatgaggctgacttacgactgacagcgctatacttcacggaccccaagtagggtgttcgggcggcggactaaggtcgaccgtcgtgggtcacggaccgaggcctccgccccgtcggtccacgttccgtcgttccccgcccttcccg

SEQ ID NO: 154657 - DNA, 464 bp, Homo sapiens
  misc_feature: GYAE6OF02FE91J.10.38.D05.1.454.CMB.1.raw
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (446)..(464): a, c, t, g, unknown or other
  misc_feature (446)..(464): n is a, c, g, or t
tcagcatagtagtgcacgaccggtgctcgatttagtatctgatagttggggtttgggggctttgcctgggtctcctggacagtcagtcaccatctcctgtactggaaccagcagtgactttgtgcttataactatgtctcctggtaccagcaccacccaggcaaagccccccaaatccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaanagggtgttgggcggnggactaaggtgaccgtctgggtcacgcccgaaggctcgccccctcggtccactctgtccccaccctcctccactactatgctgacgcgggctggcaaggcgcatagnnnnnnnnnnnnnnnnnnn

SEQ ID NO: 154658 - DNA, 521 bp, Homo sapiens
  misc_feature: GYAE6OF02IFU3C.10.38.D05.1.454.CMB.1.raw
  modified_base (511)..(511): a, c, t, g, unknown or other
  misc_feature (511)..(511): n is a, c, g, or t
  modified_base (519)..(520): a, c, t, g, unknown or other
  misc_feature (519)..(520): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctcgcgtccgggtctcctggacagtcagtcaccatctcctgcactggaaccagcagtgactttgttgcttataactatgtctcctggtaccagcaccaccaggcaaaagcccccaaactccttgttttgaggtcagtaagcggcctcaggagtccctgatcggttctctgcctccaagtctggcaacacggcctccctgaccgtctcgtgggctccgaggctgagatgaggctgattacatgcagcgctatattcgacgccccaacgagggtgtttggcggcgggataaggtcgaccgtcgtggtcagtcccaaggctcgccccgtcgcactctcgtcccacctccgtccactactatcgctgacggtcggctggacaggccncacgtagnng

SEQ ID NO: 154659 - DNA, 448 bp, Homo sapiens
  misc_feature: GYAE6OF02GVGCW.10.38.D05.1.454.CMB.1.raw
  modified_base (435)..(435): a, c, t, g, unknown or other
  misc_feature (435)..(435): n is a, c, g, or t
  modified_base (440)..(448): a, c, t, g, unknown or other
  misc_feature (440)..(448): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtctgggtcagcccaaggctgccccctcggtcactctgttcccgccctcctccactactatgctgagcggctggcaggcncatgnnnnnnnnn

SEQ ID NO: 154660 - DNA, 514 bp, Homo sapiens
  misc_feature: GYAE6OF02HNQPJ.10.38.D05.1.454.CMB.1.raw
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggcccgccaggctccgagggaagggctggagtgggtctcagttatgaaacagatggcactacatattattctgactccgtgaacgggtccgtttcaccctctccagacgacacttccaaacaacatccttgtacttcttacactatgacacaatctgagagtcgacacaccgacaccttatnttgtgcngacatgactacgctcaattcgcgggccagggacg

SEQ ID NO: 154661 - DNA, 592 bp, Homo sapiens
  misc_feature: GYAE6OF02G6KKH.10.38.D05.1.454.CMB.1.raw
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccatcagtgactttgtgcttataactatgtctcctggtaccagcaccaccaggcaaagccccaaactccttgttttgagtcagtaagcggcctnagactccctgatcggttctctcgcctcaagtctggcaaacncggccctccctgacccgtctcgtgggctccgaggctggagatgagctgattactatgcagcgctatacttcacggaccccaagtaggggttcgtttacgggccgggtacgggtaacttaacgggtcgacccgttcggtcgggtaccgaacggtaccccgaagggtccctacccggccccccgttcgggtaccctacccgttccggttcccggtttccccgccccttaccccg

SEQ ID NO: 154662 - DNA, 571 bp, Homo sapiens
  misc_feature: GYAE6OF02HN10Y.10.38.D05.1.454.CMB.1.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtncttataactatgtctcctggtaccagcaccacccaggcaaacgcccccaaactccttgttttgaggtcagtaagcgcctnaggctcctgatcggttctctcgcctcaagtctggcaacnccggtcctcccgtcgaccgtctcgtgggcctccgaggctggaggatgaggctgattactactgcagcncatactcgacgacccaacgtagggttcgtttcggcggtcgggtactaagggtcgtaccgtcgttgggttacgcccgtacggtccgtaccgtcccccgttaggtcctaccgtccgttccggttccccgtcccctccctaccc

SEQ ID NO: 154663 - DNA, 524 bp, Homo sapiens
  misc_feature: GYAE6OF02F86BD.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgagggaaggggctgggagtgggtctcagttattgaaacagatggcactacatattattctgactccgtagaacgggtccggttcaccccttctccagacgacacttaccaacaacatcttagtatcttcactatgcacaatctagagagtcgacgacacggccactattatgtgcgcgacatcgactacgctactaattcgtggggccacgggg

SEQ ID NO: 154664 - DNA, 564 bp, Homo sapiens
  misc_feature: GYAE6OF02I9GTR.10.38.D05.1.454.CMB.1.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacgttggtggttanaactntgtctcctggtaccaacaacacccaggcaaacgcccccaaatcatgattttgatgtcagtaatcggccctgacgggtttcaatcgtcttctctggctcaagtctggcaacncggcctcctgaccatctctggcctccgagctggacggacgaggctagtacttattactgcagcctacatanacaaccagcagcctacttcgtagtacgttcggacgggtacgggacctaacggcgtacggaacccgttccgtaacgggtcctaacggaccccgtaagggtccctaccggtccccccgttaggtcccctaccg

SEQ ID NO: 154665 - DNA, 565 bp, Homo sapiens
  misc_feature: GYAE6OF02IV597.10.38.D05.1.454.CMB.1.raw
  modified_base (375)..(375): a, c, t, g, unknown or other
  misc_feature (375)..(375): n is a, c, g, or t
  modified_base (563)..(563): a, c, t, g, unknown or other
  misc_feature (563)..(563): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggccaaagcccccaaactccttgttttgaggtcagtaagcggccctcaggagtcccctgatcggttctctgcctccaagtctggcaacacggcctccctgaccgtctctgggcctccaggctgaggatgaggctgattactacngcagcgcatattcgacggccccaacgacgggttgttcgggcggcgggacgtaacgggtgaccgtccgtgggtcacgcccgaaggccgtcgcccccgttggtccacgttcgtccgttcccaccccttccctcctacctaccttagtcgccgtggacggcgggccgtggaccgacggccgacacgtacgngc

SEQ ID NO: 154666 - DNA, 588 bp, Homo sapiens
  misc_feature: GYAE6OF02JH03S.10.38.D05.1.454.CMB.1.raw
tcagcatagtagtgcacgaccggtgctcgatttagtatctgatagttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaactcccttgtttttgaggtcagtaagcggccctcaggagtccctgatcggttctctgcctcaagtctggcaacacggcctccctgaccgtctctcgggctccgaggctgaggatgagctgactactactgcagcgcatattcgacggccccaacgtgggttgtttcgggcggtacgggaacttaagggtcgaacccggttccgtaggggtaccgacggtacccgaacgggtccgtaccggccccccgttcgggttcccaaccgttcccgttacggtttcccccaccccgtttccccg

SEQ ID NO: 154667 - DNA, 555 bp, Homo sapiens
  misc_feature: GYAE6OF02HIM2B.10.38.D05.1.454.CMB.1.raw
  modified_base (444)..(444): a, c, t, g, unknown or other
  misc_feature (444)..(444): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcatcatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctggggccccgcaggcctccgaggggaaggggctgggagtgggtctcgagttatgaaacagatggcactacatattattctgactcgtgaacgggtccgttacaccctctccagacgactaccttcaacaactatcttagttactcttcacntgaccacaatctagagagtccgaacgtacaccggcctaaccttagttacttcggtgaccgcgaactagtcgaactacggcttactaagtttccggacggggcccaacgggg

SEQ ID NO: 154668 - DNA, 597 bp, Homo sapiens
  misc_feature: GYAE6OF02GVZDJ.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggacaaacgccccaaactccttgttttgacgtcagtaagccgtcctcgaggacgtcctgactcggttctctcgcctccaagtctggacaacgacgcctccctgaccgtcgtcgtcgggctccgaggtctaggaggtagtggaggtctagtacttactactgcagcgacatactcacggacccctaagtgggttcgttcgggcgggtacggacgttaagggcgtaccggttacgtacgggtccgacggacccgtaagggtccgtcccggtcccccgttcggtcctacccgttccgttacccgttcccctaccccgttccc

SEQ ID NO: 154669 - DNA, 626 bp, Homo sapiens
  misc_feature: GYAE6OF02GEULS.10.38.D05.1.454.CMB.1.raw
  modified_base (220)..(220): a, c, t, g, unknown or other
  misc_feature (220)..(220): n is a, c, g, or t
  modified_base (310)..(310): a, c, t, g, unknown or other
  misc_feature (310)..(310): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccngcaccacccaggcaaacgccccaaactccttgttttgagtcagtagcggcctgagggtttcagtcgcttctctgcctcaagtctggcacncggcctcctgacatctcgtggctccgaggctggacgacgaggctagaattattactgacagctacatatgtagagttggtcgtccttcgtttacgtaacgggttttccgggacgggtacgggaccgtaggtccgttacggtacccgttaccgtaacgtaccgacgacccgaacggtccgtacccgtcccccgttccggtcctaaccgttcccgttccgttccccctaccccgttccctacccgtaccttaaccgttacttcggtaccgttacggacggtccgggtcgtacgggacccgacgggtcccgacgtaacg

SEQ ID NO: 154670 - DNA, 623 bp, Homo sapiens
  misc_feature: GYAE6OF02IOWMK.10.38.D05.1.454.CMB.1.raw
  modified_base (480)..(480): a, c, t, g, unknown or other
  misc_feature (480)..(480): n is a, c, g, or t
  modified_base (530)..(530): a, c, t, g, unknown or other
  misc_feature (530)..(530): n is a, c, g, or t
  modified_base (554)..(554): a, c, t, g, unknown or other
  misc_feature (554)..(554): n is a, c, g, or t
  modified_base (573)..(573): a, c, t, g, unknown or other
  misc_feature (573)..(573): n is a, c, g, or t
tcagcatagtagtgcacgaccggtgctcgatttagtatctgatagttggggtttgggggggaggaggagcccagccactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccgagccgtggggggtccctggagctctcctgtgcagcctcgtggtcagcatcagtaaacgacctacatacgaccgtcgggccccgccacggcctaccgaggggaacgggcgtagggaggttcgggtctcgtaagtttatagaaaacagagtggacactataattattacttctgacttcggaggaacgggtccgttaccacctctaccgagtagacctacttaccaaacaaactatcttagacttccgtttanactattcgaccaacgtaacttcgtaacgaagtacgttacgaccggaaacncccggaaccttaacgtattttaancggttacgacgacccgtanactaacgaccctagcctactaaagttccggaggggaccctaggggaaccc

SEQ ID NO: 154671 - DNA, 518 bp, Homo sapiens
  misc_feature: GYAE6OF02G0YRP.10.38.D05.1.454.CMB.1.raw
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaaggggctgggagtgggtctcagttattgaaacagatggcactacatattatctgactcgtgaagggccgttcaccctctccagacgacacttccaaacaacattctgtattcttcacatgcanaatctagagngtcgacgacacggccaacctattatgtgcgcgacatcgactacgctcaagttccgtggggccagggaccg

SEQ ID NO: 154672 - DNA, 524 bp, Homo sapiens
  misc_feature: GYAE6OF02IBFOL.10.38.D05.1.454.CMB.1.raw
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (518)..(518): a, c, t, g, unknown or other
  misc_feature (518)..(518): n is a, c, g, or t
  modified_base (520)..(524): a, c, t, g, unknown or other
  misc_feature (520)..(524): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccagggaaggggctggagtgggtctcagttattgaaacagatggcactacatattattctgactccgtgaagggccggttcacctctccagagacacttccaacaacatcttgtatcttcacatgcacaatctgagagtcgacgacacggccacctattattgtgcgcgacatgactacgctcaattctggggccagggacgcccaggtcaccggtctccccagccctccaccgaacggcccactccggtccttcccccgtggccgccctgcctccgaggcncaccctccgngagccacacgccggccctgggctcggcctgggtaccgaaggaccttaccgttcccaacttactatcgctggagcgggctggacaaggcgacagtacgncnnnnn

SEQ ID NO: 154673 - DNA, 556 bp, Homo sapiens
  misc_feature: GYAE6OF02F3GKS.10.38.D05.1.454.CMB.1.raw
  modified_base (249)..(249): a, c, t, g, unknown or other
  misc_feature (249)..(249): n is a, c, g, or t
  modified_base (427)..(427): a, c, t, g, unknown or other
  misc_feature (427)..(427): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgttgcttanaactatgtctcctggtaccagcaccacccaggcaaagcccccaaactccttgtttttgaggtcagtaagcggccctcaggagtccctgatcggttctctgcctcaagtctggcaacacggcctccctgaccgtctctgggctccaggctgaggatgaggctgacttactactgcagcncatattcacggcccaagagggttgttggcgggcgggtacgtaaggtcgaccgttcgtgggtcacggcccgaagggccttacggcccccttcgggtcctaccgttccgtccgttccccgccccttccccg

SEQ ID NO: 154674 - DNA, 539 bp, Homo sapiens
  misc_feature: GYAE6OF02IENEO.10.38.D05.1.454.CMB.1.raw
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgaggggaaggggctgggagtgggtctcagttattgaaacagatggcactacattattattctgacctccgtaggaacgggtccggtttcaccctctcccaagacgacacttaccaaacaactattccttagtactcttcactatgacacatctagagacgtcgacgacacggccacttattntgngcgcgacagtcgactcgctactaattcggacgggccagggaccg

SEQ ID NO: 154675 - DNA, 339 bp, Homo sapiens
  misc_feature: GYAE6OF02IL917.10.38.D05.1.454.CMB.1.raw
  modified_base (284)..(284): a, c, t, g, unknown or other
  misc_feature (284)..(284): n is a, c, g, or t
  modified_base (324)..(339): a, c, t, g, unknown or other
  misc_feature (324)..(339): n is a, c, g, or t
tcagcatagtagtgcacgaccggtgctcgatttagtatctgatagttggtttgggtaaccgtatgaacattctgtagggccgactgtcttctccacggtgctcccttcatgcgtgacctggcaacacggcctccctgaccgtctctgggctccaggctgagatgaggctgattactactgcagcgcatattcaggccccaacagggtgtttggcggcgggtactaaggtgaccgtctgggtcagcccgaaggctgcccctcggtcactctgttcccaccctccnccactactactgcctgagccggctggccaaggcgcatagnnnnnnnnnnnnnnnn

SEQ ID NO: 154676 - DNA, 548 bp, Homo sapiens
  misc_feature: GYAE6OF02I9WVS.10.38.D05.1.454.CMB.1.raw
  modified_base (547)..(547): a, c, t, g, unknown or other
  misc_feature (547)..(547): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgcccccaaactccttgtttttgaggtcagtaagcggccctcaggatccctgatcggttctctgccctccaagtctggcaacacggcctccctgacccgtctcgtcgggcctccgaggctggaggatgaggctgacttactacgtgcagcgcatattcacgcccaagagggttgttggcggcgggacgtaaggtcgaccgtccgtgggtcacgccgaaggctccgccccgtcggtcacctcttccgttccccaccctcctcctacctactactcgtctcgacggcggcgtcggacgaacggcgcagtcgnc

SEQ ID NO: 154677 - DNA, 561 bp, Homo sapiens
  misc_feature: GYAE6OF02GQ2L4.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactccttgttttgagtcagtaagcggccctcaggcgtccctgatcggttctctgcctcaagtctgcaacacggcctccctgaccgtctcgtcgggcctccgaggctgaggatggaggctgacttactactgcagcgctattactccgaacggcccctaacggtaggggttcgtttcggggcggtcgggacttaagggcgtaccgtcgtgggtcacgcccgaaggcctcggcccccgttcggctaccgtcgttccttcccgcccttcccg

SEQ ID NO: 154678 - DNA, 739 bp, Homo sapiens
  misc_feature: GYAE6OF02F7CY6.10.38.D05.1.454.CMB.1.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
tcagcatagtagtgcacgaccggtgctcgatttagtatctgatagttgggtttgggggggtcgtcgaggaggcgagcgctctcaggacgtcaccaccatggcctgggctctgctcctcctcaccctcctcactcagggcacagggtcctgggcccagtctgccctgactcagcctccctcgcgtccgggtctcctggaccagtcagtcaccatctcctgcactggaaccngcagtgtactttggtncttatactatgtctctgtaccacgcaccaccaggaccaaccgacccctaaactccttacgttttacgacggtactagtaacggaccggtaccgtccgaggtacgtacccgtgtacgttccggttctacctcggtaccctccgtaagtccgtacggaccaacgaccggtcccctcccgtcgtacccgttccgtaccgtcgggtacctccgacggtcgtggacggtacgtgacgggtctagggtaacttaccgttacgtcgaccgtacgtccggtactacttaacgttccgaaccggtacccccgtaacggtaacgggggtttacggttacggggaccggggtaccgggtaacggtttaaaccgggcgggtaaccccggttcggtaccgggtaccggtaaccggtacccggtaacggtaaccgttcccgggaccccccgttacgggttcctaacccgttccgtttacccggtttccccccgaccgtttccccccg

SEQ ID NO: 154679 - DNA, 678 bp, Homo sapiens
  misc_feature: GYAE6OF02HO4FL.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcaggcacagggtcctgggcccaggtctgccctgactcagcctccctccgcgtccggtctcctggacagtcagtcaccatctcctgcactggaaccagcagtgacttttgtgcttaataactatgtctcctggtaccagccaccaccaggacaaacgccccaaacttccttgttttgaggtcagtacgcgcctgaggacgtcctgactcggttctcgtcgcctcaagtctaggacaacgaccggtccctccctcgtacccgtctcgtcgggcctccgaggtcgtaggaggagtcggaggtcttagtaactttaccgtacgttcgcacgtccgactaattaccgtaccgaccggtacccctaagggtacggggttcggtttcggggaccgggtaccggggtaaacgtaaacgggtccggtacccggttccggttacggggtacccgaaccgggtacccggtaaacgggtcccgttacccggtccccccggtttacgggtaccctacccgttcccgtttaccccggttaccccctacccccgttaccccg

SEQ ID NO: 154680 - DNA, 889 bp, Homo sapiens
  misc_feature: GYAE6OF02J01X0.10.38.D05.1.454.CMB.1.raw
  modified_base (274)..(274): a, c, t, g, unknown or other
  misc_feature (274)..(274): n is a, c, g, or t
tcagcatagtagtgcacgaccggtgctcgatttagtatctgatagttgggtttgggggggtcgtcgaggaggcagcgctctcaggacgtcaccaccatggcctgggctctgctcctcctcaccctcctcactcagggcacagggtcctgggcccagtctgccctgactcagcctccctccgccgtccgggtctccgtggacagtcagtcaccatcctcctgcactcggaaccagcagtgtactttgtgactttataactatgtctctggtaccngccaccacccaggaccaaacgcccccaaattccttgtttacgacggtcaaggtacgccgcctacgaggtactccgtagacgttccggttactcgcgtccctacgtaagttcctacgggccaaacgccggccccttcccgtcgtacccgttctcgtacgggtccctacccgaaggttctaacgggacggtacgtacgggtacgggtaccgttacggtaaccttttaacccggaccgtttcgggaaccctacgggtacccgtaaccgttaaacgttttaccggtttaaccccggaacccgggtaacccccccgttaaaaggggtttaacccgggggggttttccgggtttttacccgggggaaccgggggtaacccgggggtttaaaacggttaaaccgggggggtttaccccgggtaaaccccccgggttttacccgggggttacggggtttaaccccggaaacccggggttaccccccggggttaaaagggttcccccgggtttaaccccgggtcccccccccggttttaacgggggtttccccctaaacccgtttttcccccggggtttacccccttttaaccccccccccgggttaccctttaccccccccgg

SEQ ID NO: 154681 - DNA, 648 bp, Homo sapiens
  misc_feature: GYAE6OF02HE6D2.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagccaccaccaggaccaaacgcccccaaacttcctttgttttgagtcagtaacgccggcctgaggacgtcctgtacttcggttctctcgcctcaagtctggacaacgcggccctcctcgaccgtctcgtcgggcctccgaggctggaggtatggacggtctaggtaacttacgtacgtcgacacgcgactattacgtccgaaccggaccccgtaaaggtcggggttcgttacgggccgggtaccgggtaacgtaacgggtccgtaccccggttccggttacggggtaccgaaccggtacccggaacgggtccctacccggtcccccggtttacggaccttacccgttcccgttcccgtttaccccccaccccgtttacccg

SEQ ID NO: 154682 - DNA, 503 bp, Homo sapiens
  misc_feature: GYAE6OF02IC9OQ.10.38.D05.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (476)..(503): a, c, t, g, unknown or other
  misc_feature (476)..(503): n is a, c, g, or t
tcagcatagtagtgcacgaccggtgctcgatttagtatctgatagttgggggtttgggggctttgcctgggtctcctggacagtcagtcaccatctcctgcactggaaccagcagtgactttgttgcttataactatgtctcctggtaccagcaccacccaggcaaagcccccaaatccttgtttttgaggtcagtaagcggccctcaggagtccctgatcggttctntgcctccaagtctggcaacncggcctcctgaccgtctctgggctccgaggctgaggntgaggctgattactactgcagcgcatattcgacggccccaagagggttgttggcggcgggaactaaggtcgaccgtcgtggggtccacggcccaacgggcctaccgcccccgtggtcacgttccttcgttccccgcccttccctcccactacctatcgctggacgcgggcgttcggcgaaggcgcagtagnnnnnnnnnnnnnnnnnnnnnnnnnnnn

SEQ ID NO: 154683 - DNA, 558 bp, Homo sapiens
  misc_feature: GYAE6OF02FIJ3Y.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgttgcttataactatgtctcctggtaccagcaccacccaggcaaacgcccccaaactccttgtttttgaggtcagtaagcggccctcaggagtccctcgatcggttctctgcctcaagtctggcaacacggcctccctgacccgtctctgggcctccaggctgaggatggaggctgacttactactgcagcgcatattcacggccccaacgagggttgtttgggcgggcgggacgtaagggtcgaccgtccgtgggtcacggcccaagggcctcggccccccgtcggtccaccgttcctcgttccccacccttcccc

SEQ ID NO: 154684 - DNA, 552 bp, Homo sapiens
  misc_feature: GYAE6OF02GHWCY.10.38.D05.1.454.CMB.1.raw
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggcctcaggagtcccctgatcggttctcttgcccttccaagtctggacaacaccggcctcccgtgaccgtctcgtgggcctccgaggctggaggatgaggctgaattacgtatgcagcgctaatattcgagccccaagtagggtgtttggcgggcggacgtaaggtcgaccgtcgtgggtcagcccaaggcctcgcccccgttggtccacgttctcgttccctccgtccactaccttatcgcgtcgacggccggcgtacggacaacgggcgacagtagnagn

SEQ ID NO: 154685 - DNA, 677 bp, Homo sapiens
  misc_feature: GYAE6OF02GI7N4.10.38.D05.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (404)..(404): a, c, t, g, unknown or other
  misc_feature (404)..(404): n is a, c, g, or t
tcagcatagtagtgcacgaccggtgctcgatttagtatctgatagttggggtttggggggggtcgtcaggaggcagcgctctcaggacgtcaccaccatggcctgggctctgctcctcctcaccctcctcactcagggcacagggtcctgggcccagtctgccctgactcagccctcctccgcgtccgggtctccgtggacagtcagtcaccatctcngcactggaaccngcagtgtacttttgtgcttaanaactatgtctcctggtaccagcaccaccaggacaaacgccccaaacttccttgttttgacggtcagtaacgcggccctgacggacgtccctgtacgtcggttctcgtcgcctccaaagtctggacaacgacggtccctcccgtagacccgtntccgtacgggcctaccgaggcctaggaggtataggacgtcgtagtaacgtttactaccgttagaccgtaacgcggactaattacgttacgaacccggtaccccaaacggttacggggttcggtttccggggaccgggaccgggtaaagtaacggggtacgtacccggttccgtacggggtaccgaacggacccgtaaacgggtcctacccggtacccccgtcggttacccgtaaccgttccgttacccgtttacccccgtacccccttccccg

SEQ ID NO: 154686 - DNA, 637 bp, Homo sapiens
  misc_feature: GYAE6OF02F6NJ2.10.38.D05.1.454.CMB.1.raw
tcagcatagtagtgcacgaccggtgctcgatttagtatctgatagttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtccaccatctcctgcactggaaccagcagtgacttttgtgcttataactatgtctctggtacagcaccaccaggacaaacgccccaaacttccttgttttcgaggtcagtaagccggcctcaggacgtccctgactcggttctctcgtcctaccgaagtctacggacaacgaccggccctccctcggtaccctctcgtcgggcctccgaggctggaggatggtacggctagtacttactacttcgactagccgctacgttcgttacgaccggaccctaaacgtacgggttaggttcgggacgggccgggtaacgtaacgggtcgaccggttccgtagggtacgacggacccggtaacggtcccgtaccggtaccccccgtcgggttaccctaccgttaccgttcccggtttacccctaccccgttaccccg

SEQ ID NO: 154687 - DNA, 514 bp, Homo sapiens
  misc_feature: GYAE6OF02F8DXQ.10.38.D05.1.454.CMB.1.raw
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (501)..(501): a, c, t, g, unknown or other
  misc_feature (501)..(501): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctggttcagcatcagtaacgactacatgacctgggccccgccaggctccgagggaaggggctgggagtgggtctcagttattgaaacngatggcactacatattattctgactccgtgaagggtccgttcaccctctccagngacacttccaanacntctgtactcttcatatcgacacaattcagagatcgacgacacgccaactnttatgngccgngacntgactacgctacattccggngggtccagggacc

SEQ ID NO: 154688 - DNA, 589 bp, Homo sapiens
  misc_feature: GYAE6OF02GNKFL.10.38.D05.1.454.CMB.1.raw
  modified_base (366)..(366): a, c, t, g, unknown or other
  misc_feature (366)..(366): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgccactggaacccaggcagtgtacttttgttgcttataactatgtctcctggtaccagcaccacccaggcaaacgccccaaactccttgttttgagtcagtagcgcctcgagacgtcctgatcggttctctcgcctcaagtctggcaacncggcctccctcgaccgtctccgtcgggcctccgaggctggaggtactggaggctagtacttactacgtgcagcgactatattcgacggtaccccaaggtgggttcgttcgggcggcgggtactaaggtcgtaccgtcgtgggtaccgacggtacccgtaacggtccgtacccgtcccccgttcggtacctaccgttccgttccggttccccgtcccttacccg

SEQ ID NO: 154689 - DNA, 547 bp, Homo sapiens
  misc_feature: GYAE6OF02F4V5W.10.38.D05.1.454.CMB.1.raw
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggctcctggacagtcagtcaccatctcctgcactggaaccagcagtgacttttgttgcttataactatgtctcctggtaccagcaccacccaggcaaacgcccccaaactccttgttttgaggtcagtaagcggcctcaggagtccctgatcggttctctgcctccaagtctggcaacacggcctccctgacccgtctctcgggctccaggctgaggatgaggctgattactactgcagcgcatattccacggccccaagaggggtcgtttgggcgggcgggactaagggtcgaccgtccgtgggtcacggcccaaggcctcgccccctcggtccacgttcctcgttcccccacccttccc

SEQ ID NO: 154690 - DNA, 789 bp, Homo sapiens
  misc_feature: GYAE6OF02J0AAQ.10.38.D05.1.454.CMB.1.raw
  modified_base (227)..(227): a, c, t, g, unknown or other
  misc_feature (227)..(227): n is a, c, g, or t
tcagcatagtagtgcacgaccggtgctcgatttagtatctgatagttgggtttgggggggtcgtcgaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctcctgcactggaaccngcagtgtactttgtgcttataactatgtctcctggtaccagccaccacccgaggaccaaaccgtacccccaaactttcccgtttagttttacggacgttctaaggttaacgccggtcctacgacggacttcccgtagacgttcggtcctcctccggacctaccgtaagtccgtacggaccaaccggtaccggtcccctaccgtacggtacccgttcctcgggtcgggtaccccttccgaacggttccgttagggaacggtacgttacgggacgggttaccgttacggttaaacctttaaccgttaccgttacggtccgtaaacggccgtacgtaacttaccgtttaccgaacccgggtaaccctaaccgggtaacggggtttcgggtttacgggtacccggggtaaccgggtaaacggttaacgggtaccgggttaaccgttcccgggtacggtttaccgaaccggacccgtaacggttcccggtaccccgttcccccggttaccggttaccgtacccggtttccggttcccggtttaccccccggtacccctttacccccg

SEQ ID NO: 154691 - DNA, 721 bp, Homo sapiens
  misc_feature: GYAE6OF02JKO5Y.10.38.D05.1.454.CMB.1.raw
tcagcatagtagtgcacgaccggtgctcgatttagtatctgatagttgggtttgggggggaggaggagcccagcactgggattccgaggtgtttccattcggtgatcagcactgaacacagaggactcaccatggagtttggctgagctgggtttccttgttgctattcaaaaggtgtccactgtgaggttcaactggtggagactggaggaggctggatccagccgtgggggtccctgagactcctcctgtgcacgcctcgtgggttcaggcatacgacgtaacgactacatcgaccgtcggccccgccgacggccgtccggaaggggaacgggcgtagggaggtcgggtcgtacgtagttaacgttacggaaaactaggtacgtaggacctaactacgtaacgtttatttaacgtctacgtaccgttaccggtagggaaaccgggttcccggttaccgaaccccttcgtacccaaaggtacgaaaccctacccgttaacccaaactaaaccgtatttccgttacgtttaccttacgtttaccaacctatccgtccaaacccgtattccgtagaagtaccgttacccgggaaacgtacccgtaaccgggtacccttaaactttacgtttacgtcggttccgaaccggttcccggaaattcgtaaccgaacgttacccgtcgttaactacggttcgggtaccggggacctaccggggtaac

SEQ ID NO: 154692 - DNA, 623 bp, Homo sapiens
  misc_feature: GYAE6OF02GHBPI.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggccccgccgacggcctccgaggggaacggggctgggaggtgggtctacgtagtttagttagaaacagatcggactactaacattattattctagtacgtccggtaggtaacggggtcccggttaccaccccgttcgtaccgaaggacgtaaccctaccttacccaaacgtaactacttaccttagttaactcctttacactatgaccaactaattcctaggagtacgtacggaacctaaccgacccgaccctaaccgttatttacgtgtcggcgacgtacgattacgacctacgtctacgtaagttcggtacggggcctaacgggg

SEQ ID NO: 154693 - DNA, 617 bp, Homo sapiens
  misc_feature: GYAE6OF02IVVR2.10.38.D05.1.454.CMB.1.raw
  modified_base (215)..(215): a, c, t, g, unknown or other
  misc_feature (215)..(215): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttccaatggtgagcgtggaggacggngtgcgtcgcgcggtcgggtccgtcgacgcgtcgtcgtgtcgcgacgtcgtcgtcggtcgacgctacgtacgaacgtaacgtacgtacacgtcgtccgtcggcccgtaccgcggtcgtacggacgggtacggcggtcggtcggtcggtcgtacgtacgtcgtagacgtagtacgcgtacgtacgtacgtacgttattgtctagtacgtacgtacggtacggtcgtccgtcgtcgtcgacgacgtctactacgacgtactcgtcgtcgtctactcgtacatacgtactacgtacgtacgtacgtacgtacgacgtacgtacgtacgacgtctagtcgtacgtcgtacgtacgcgtacgtaccgtacgtaccgtacgttacgtacgtacgtacgtcgtagtacgg

SEQ ID NO: 154694 - DNA, 597 bp, Homo sapiens
  misc_feature: GYAE6OF02FOJQ9.10.38.D05.1.454.CMB.1.raw
  modified_base (364)..(364): a, c, t, g, unknown or other
  misc_feature (364)..(364): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctctggtaccagcaccacccaggcaaacgcccccaaactccttgttttgaggtcagtaacgcggcctcaggatccctgatcggttctctgcctcaagtctggacaacncggcctccctgaccgtctcgtcgggcctccgaggcctaggaggtatggaggtctgtacttactacgtgcagcgacattacttcaaccggacccctaagagggttcggtttacgggaccgggtacgggaacttaagggtccgtaccgttccgtggggtaccaacggtcccgaagggtcctccggacccccgttggtaccctaccgttcccgtccggttcccccgacccttcccg

SEQ ID NO: 154695 - DNA, 670 bp, Homo sapiens
  misc_feature: GYAE6OF02IW3P0.10.38.D05.1.454.CMB.1.raw
  modified_base (231)..(231): a, c, t, g, unknown or other
  misc_feature (231)..(231): n is a, c, g, or t
tcagcatagtagtgcacgaccggtgctcgatttagtatctgataggttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcgtcctgcacgtggaaccngcagtgactttgtgcttataactatgtctctgtaccacgcaccacccaggacaaaccgcccccaaacttcctttgtttttgaggtcagtaacgccggtccctcgaggacgtccctagacgttcggttccttcgtcggtccctaccgtaacggttccgtacgggaccaaccgaccgggtcccctcccgtacggtaccccgttaccgttccgttacgggcccttacccgacgggtccgtaggaaggtacgtggacggtcgttaggtaacgttaccttacgttcgaccgtagaccgtactatacttcgaaccggtaccccgtaagtacgggttggttcgggacggtcgggtaactaagggtcgtaccgtcgtcgggtacgacggcccgaaggtcctaccgtccccgtcgtccgaccgttccgtccgttccccacccttcccg

SEQ ID NO: 154696 - DNA, 452 bp, Homo sapiens
  misc_feature: GYAE6OF02HHX3P.10.38.D05.1.454.CMB.1.raw
  modified_base (437)..(437): a, c, t, g, unknown or other
  misc_feature (437)..(437): n is a, c, g, or t
  modified_base (443)..(452): a, c, t, g, unknown or other
  misc_feature (443)..(452): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaagagggtgttggcggcgggactaaggtgaccgtcgtgggtcagcccaaggctcgccccctggtcactctcgtcccgccctcctccactctatcgctgacgcgggctggcaaggcncatagnnnnnnnnnn

SEQ ID NO: 154697 - DNA, 607 bp, Homo sapiens
  misc_feature: GYAE6OF02GOR2A.10.38.D05.1.454.CMB.1.raw
  modified_base (352)..(352): a, c, t, g, unknown or other
  misc_feature (352)..(352): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccgaggcctccgaggggaaggggctgggagtgggtctcgagttattgaaacngatggcactacatattatctgactccgtaggaagggtccggttacaccctctacccaggtacgacctacttacccaaacaactattcttagtaacttcttacactatcgaccaacaattccgtagaagacgttaccgaaccgaaccgacccgggtccctaaaccttatttacttcggtcgaccggtacgaacctattcggaaccttaccggcttacgtaaacgtttccggtacgggggtacccaggggtacccgg

SEQ ID NO: 154698 - DNA, 569 bp, Homo sapiens
  misc_feature: GYAE6OF02H1TYQ.10.38.D05.1.454.CMB.1.raw
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
tcagcatagtagtgcacgaccggtgctcgatttagtatctgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggacccagcactgatgttgggcattataaccttgtctcctggtatcaacaacgcccagaccaaagcccccanacctcttgaactttangaatcagtaagccgcctcagggtttctagtcgnttctctcgcctacaagtctggacaacacggccctcctagactaactctacgtgggcctaccgaggctagaccgaacggaggctagaaacttattactgccagcacatatagtagatggtctaccttgtttacgtaagggttttcggacggagggacctaggtctacgtacccggtaccttaaagtccgtacggaccgaacggtcctaccgtcccccgtgttaacccg

SEQ ID NO: 154699 - DNA, 590 bp, Homo sapiens
  misc_feature: GYAE6OF02G5W0L.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatcgacctgggccccgccgaggctccgaggggaaggggctgggaggtgggtctcgtagttatagaaacagatggcactacattattattctagtactccgtaggaacggggtccgtttaccacccgtctaccgagacgacctaccttaccaaacaactactcttagtacttcttacactatcgacacaatcgtagagtacgtacgacgacaccggaccctaacctagtttacttggtacgaccggtcgaacacgtacgaccttacgcctacgtaagtttccggacggggtaccgaggggacccg

SEQ ID NO: 154700 - DNA, 561 bp, Homo sapiens
  misc_feature: GYAE6OF02H3MT2.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagtttttgctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggccccgccaggcctccgaggggaaggggctgggagtgggtctcagttatagaaacagatggcactacatattatctgactccgtgaacgggccgttacaccctctccagacgacctacttaccaaacaacatcttagtatcttacaactatcgcaactaatctagagacgtcgacgacaccggcctaaccgttattagttgtcgccgcaaccagtacgaacctaccggcctacgtaactttccgggacggggtaccaggggtacccg

SEQ ID NO: 154701 - DNA, 537 bp, Homo sapiens
  misc_feature: GYAE6OF02HAN7Q.10.38.D05.1.454.CMB.1.raw
  modified_base (345)..(345): a, c, t, g, unknown or other
  misc_feature (345)..(345): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaggggctggagtgggtctcagttatgaaacngatggcactacatattattctgactcgtgacgggtccgttcaccctctccagacgacaccttaccaaacaacattcttgtacttcttacacatcgaccacaatcagagagtcgaacgaccacggcccactattacgtgtacgccgcgactatacgtactacgctactaattccggacggggcccagggaccg

SEQ ID NO: 154702 - DNA, 801 bp, Homo sapiens
  misc_feature: GYAE6OF02GK14J.10.38.D05.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctccngcactggaaccngcagtgacttttgtncttaataactatgtctctggtaccagcaccacccaggaccaaacgccccaaacttcctttgttttgagtcagtaacgccgtccctgaggtactccctgtacttccggttctcgtcgtcctaccgtaagtccgtacggacctaaaccgaccggtcccctttcccgtaccggtaacccgttccgttacccggtaggggtccccttacccggtaacgggtccgttacggaacgggtacgtagggtaaacgggtccgttaaggtaaaccgttttaccttaaaccggttggacccgaaagggtcccgtactaagtttacccgttaccggaaccccggtacccccgtaaagggttacggggtttcgttttaccgggggaccgggtaaccggggtaaacttaacggggttccgaccccgggtttacccgttacgggggttacccaaccgggttaaccccgaaacggggtcccccgttacccgggtaacccccccgtttccgggttaaaccaccccggttttcccggttaccccgggttttccccccgtaccccccttacccccgg

SEQ ID NO: 154703 - DNA, 454 bp, Homo sapiens
  misc_feature: GYAE6OF02FVN2X.10.38.D05.1.454.CMB.1.raw
  modified_base (285)..(285): a, c, t, g, unknown or other
  misc_feature (285)..(285): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (433)..(433): a, c, t, g, unknown or other
  misc_feature (433)..(433): n is a, c, g, or t
  modified_base (439)..(454): a, c, t, g, unknown or other
  misc_feature (439)..(454): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggntgaggctgattactactgcagcgcatattcaggccccaanagggtntttggcggcgggactaaggtgaccgtctgggtcagcccaaggctgccccctggtcactctgttccccgccctcctccactactatgctgagcggctgcagcncatagnnnnnnnnnnnnnnnn

SEQ ID NO: 154704 - DNA, 540 bp, Homo sapiens
  misc_feature: GYAE6OF02HPAD9.10.38.D05.1.454.CMB.1.raw
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctattcaaaaggtgtccactgtgaggttcaactggtggagactggaggaggctggatccagccgtggggggtccctgagactctcctgtgcagcctctgggttcagcatcagtaacgactacatcgacctgggccccgccaggctccgagggaagggctgggagtgggtctnagttatgaaacngatggcaatacatattatctgactcgtagaggccgttcaccctctccagacgacaccttaccaaacaactatcttgtacttcttacacatcgacactatctagacgtcgtacgacgaccgacggacccaacttattcttgcgcgacgacagtgaacctagctacaacgtttccgaggggcccagggtacccg

SEQ ID NO: 154705 - DNA, 557 bp, Homo sapiens
  misc_feature: GYAE6OF02JER7C.10.38.D05.1.454.CMB.1.raw
  modified_base (340)..(340): a, c, t, g, unknown or other
  misc_feature (340)..(340): n is a, c, g, or t
  modified_base (380)..(380): a, c, t, g, unknown or other
  misc_feature (380)..(380): n is a, c, g, or t
  modified_base (547)..(547): a, c, t, g, unknown or other
  misc_feature (547)..(547): n is a, c, g, or t
  modified_base (555)..(555): a, c, t, g, unknown or other
  misc_feature (555)..(555): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaatccttgttttgaggtcagtaacgcggccctcgaggacgtccctgattcggttctctgcctccagtctggccaacacggcctcctgaccgtctcngggcctccgaggctggaggatggagctgattactactgcngcgctatatcacggaccccaacgacgggttgttcgggcgggcgggactaaggtcgtaccggtccgtgggtcacggacccgaaggcgtccgccccgtcggtccacttctcgttccccacccttcctccacctactactcgtcgtcgcgtcgggctcggcgaacggccncacgtagntg

SEQ ID NO: 154706 - DNA, 615 bp, Homo sapiens
  misc_feature: GYAE6OF02GLCWQ.10.38.D05.1.454.CMB.1.raw
  modified_base (365)..(365): a, c, t, g, unknown or other
  misc_feature (365)..(365): n is a, c, g, or t
  modified_base (501)..(501): a, c, t, g, unknown or other
  misc_feature (501)..(501): n is a, c, g, or t
  modified_base (551)..(551): a, c, t, g, unknown or other
  misc_feature (551)..(551): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcgtggtttcgtgtaggctattacaaaaggtgtccactgtgaggttcaactggtggagactggaggaggctggatccagccgtggggggtccctgagactctcctgtgcagcctcgtggttcagcatcagtaacgactacatcgacctcgggccccgccgaggcctccggaaggggaaggggctggggaggttcgggtctacgtagtttattaggaaacngtaagtggacctactactattaatttacttcgtagtaccttccgggtaggaaccggggtcccgtttacacccctcgtaccgagtaacgacctaccgttaccaaacgtaaactcgttcttgttaactcttacacgtntcgactactactgtagagtaccgacgacgaccaccgtaacctacttattntcggtacgccgtacgactagtacgtacctacgtctacgtaacggtttccgggacgggaccgagg

SEQ ID NO: 154707 - DNA, 661 bp, Homo sapiens
  misc_feature: GYAE6OF02FLAO0.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccngcagtgactttgtgcttatactatgtctctgtaccagcaccaccagcaaacgccccaacttccttgttttgaggtcagtaacgccggccctcgaggacgtcccgtgtactcggttctcgtcgccctaccaagtctggacaacgccggtcccttcccgtacgacccgttccgtcgtcgggtcctccgacggctggaggtgtaggacggtctagtacttacgtactcgacgacgtacgtaattacgttaccgaccggtaaccccaaggtacggggtttcgggtttaccggggacgggtaccgggtaaccgtaaagggtcgtaccggttacccggtcgggttacggtaccgaaccgtacccggaacggtcccgtccccggtaccccgtccggttaccctaccgttccgttaccccgttccccctaccccgtacccg

SEQ ID NO: 154708 - DNA, 590 bp, Homo sapiens
  misc_feature: GYAE6OF02IJI2Z.10.38.D05.1.454.CMB.1.raw
  modified_base (414)..(414): a, c, t, g, unknown or other
  misc_feature (414)..(414): n is a, c, g, or t
  modified_base (468)..(468): a, c, t, g, unknown or other
  misc_feature (468)..(468): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaaggtgtccactgtgaggttcaactggtggagactggaggaggctggatccagcctggggggtcccctgacgactctcctgtgcagcctcgtgggttcagcatcaagtaacgactacatgacctggccccgccgaggctccgaaggggaggggctgggaggtgggtctcgtagttagttagaaaccagagtcggactaaatacaattattatctgactcggtgaacggtccgtcacctcnccagacgactacgtaccaaatacgattacttgtacttcgtacacgatgaccaanactcgttagacgtagtccgaacgacgtaccggaccctaacttattagttgtacgcgtaacgacattacggaaccttacgacttactaagttcccgggtacggggacccgtagggtaaccccg

SEQ ID NO: 154709 - DNA, 491 bp, Homo sapiens
  misc_feature: GYAE6OF02I23KK.10.38.D05.1.454.CMB.1.raw
  modified_base (247)..(247): a, c, t, g, unknown or other
  misc_feature (247)..(247): n is a, c, g, or t
  modified_base (327)..(327): a, c, t, g, unknown or other
  misc_feature (327)..(327): n is a, c, g, or t
  modified_base (471)..(491): a, c, t, g, unknown or other
  misc_feature (471)..(491): n is a, c, g, or t
tcagcatagtagtgcacgaccggtgctcgatttagtatctgatagttggggtttgggggctttgctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacncggcctccctgaccgtctctgggcctccaggctgaggatgaggctgattactactgcagcgcatattcacggccccaagngggttgttggcgcgggactaaggtgaccgtctgggtcagcccaaggctcgcccccgtggtccaccttccgtcgttccccgcccctccctcccacttaccttactgcctggacggccgggcgtcgggcgaagggcgacagtagcnnnnnnnnnnnnnnnnnnnnn

SEQ ID NO: 154710 - DNA, 540 bp, Homo sapiens
  misc_feature: GYAE6OF02GQGQI.10.38.D05.1.454.CMB.1.raw
  modified_base (443)..(443): a, c, t, g, unknown or other
  misc_feature (443)..(443): n is a, c, g, or t
  modified_base (485)..(485): a, c, t, g, unknown or other
  misc_feature (485)..(485): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaagcccccaaactccttgtttttgaggtcagtaagcggccctcaggagtccctgatcggttctctgcctcaagtctggcaacacggcctccctgaccgtctctgggctccaggctgaggatggaggctgattactactgcagcgcatattcaggccccaagngggtgtttggcggcgggactaagggtcgaccgtcgtgggtcncggcccaaggcctcgcccccgtcggtccaccttccgtcgttccccacccttcccg

SEQ ID NO: 154711 - DNA, 759 bp, Homo sapiens
  misc_feature: GYAE6OF02HWF4K.10.38.D05.1.454.CMB.1.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccagcagtcgtactttgtncttaanactatgtctctggtaccagcaccaccagcaaacgccccaaactcctttagttttgaggtcagtaacgccggccctacaggacgtccctgacttcggttctcgtcgcccttaccaagttctggacctaaaccgaccgggtcccctacccgttcgacccgttctccggtcgggcctaccgacggtcgtacggtacggtagtggtaacggtcgtacgtacgtttaccttaacgtcggaccgaacggtccgtaacgtactaaccgtttacggaacccggtaccccgtaaacggtacggggtttaccgggtttacggggaccggggttaccggggtaaacggttaaccggggtttaaccgggacccgtttccggggttaccggggttaccggaaccgggttacccccggtaaagggtccccgtttaacccgggtccccccggtttaccgggtacccttaccccggttttcccggtttaccccggttttacccccccgtaccccgttttaacccccgg

SEQ ID NO: 154712 - DNA, 549 bp, Homo sapiens
  misc_feature: GYAE6OF02GERB4.10.38.D05.1.454.CMB.1.raw
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
  modified_base (485)..(485): a, c, t, g, unknown or other
  misc_feature (485)..(485): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggcccgccaggctccgagggaaggggctgggagtgggtctcgagttatgaaacngatggcatacatattatctgactcgtgaagggccgttcaccctctccagagcacttccaaanacatcttgtatcttcactagtcgacacaaattctagagtacgtacgacgaactaccggaccctacctatttagttcgngaccgtcggaactactggaaccttacgcttacgaaatttccgtaggggacccaggggtacccgg

SEQ ID NO: 154713 - DNA, 624 bp, Homo sapiens
  misc_feature: GYAE6OF02I8DCB.10.38.D05.1.454.CMB.1.raw
  modified_base (402)..(402): a, c, t, g, unknown or other
  misc_feature (402)..(402): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctgggccccgcacggctccgaggggaaggggctgggagtgggtctcgtagttatacgaaacgagagtcggacactacattattattctagactcgtagacgggtccgttacncccgtctccgagacgtaccacttccaaactacattcttacgtattcttacactagttcgacctacaactcgtagacgtactcggaacaccgtaccggaccctaaccgttagtttacgttcggtacgacccggtaccgtaacgtaagttaccggaaccttaaccggttccttaaccggttaactttaccggggtccgggggtacccaagggggtaacccccgg

SEQ ID NO: 154714 - DNA, 560 bp, Homo sapiens
  misc_feature: GYAE6OF02F04P5.10.38.D05.1.454.CMB.1.raw
  modified_base (358)..(358): a, c, t, g, unknown or other
  misc_feature (358)..(358): n is a, c, g, or t
  modified_base (506)..(506): a, c, t, g, unknown or other
  misc_feature (506)..(506): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcaagtaacgactacatcgaccgtcgggccccgccacggcctccgaggggaagggcgtggaggtgggtctcgtagttatagaaacngatggacactacatattatctgactcgtaggacgggtccgttcaccctctacagacgactactaccaaacacatcttagtatccttacacatcgacaacatctagagtacgtacgaacgtaccgacggcctaacttattatcggtacncggacaactgtacggacctacgcttacgaagttccggtacggggcctaacgggg

SEQ ID NO: 154715 - DNA, 569 bp, Homo sapiens
  misc_feature: GYAE6OF02IJB0B.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgcccccaaactccttgttttgaggtcagtaagcggcctcaggatccctgatcggttctctgcctcaagtctggcaacacggcctccctgaccgtctcgtcgggctccgaggtctggaggatgaggctgacttactactgcagcgcatacttcacggacccaagaggggttgtttgggccggtcgggaactaacgggtcgaccggtccgtcgggtcacggtcccgaagggtccgttccgcccccgttcggtcctaccgttccgtccgttcccccacccttccccg

SEQ ID NO: 154716 - DNA, 720 bp, Homo sapiens
  misc_feature: GYAE6OF02H9MBO.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgccactggaaccagcagtgtactttgtgcttataactatgtctcctggtaccagcaccacccagcaaacgccccctaaactcctttgttttgaggtcagtaagccggcctcgaggtacgtccctagtacgtcggttctcgtcgtccctaccgtaagtccgtcggacaaccgtaccggccctacccgtcgtacccgtctccgtcgggtcctccgtacggcctggacggtagtggacggctagtaactttaccttacgtcgacgacggccgactaattacttaccgaaccggtaccccctaaaggtaggggtttcgggttttacgggacccggggtacgggtaaacggttaaacgggttccgtacccgggttacccggtacggggtaccgtaaccggacccccggtaaggggtaccccgttccccggttacccccccgttccgggttaccccgtacccgtttaccccgtttcccgggttttacccccccaccccgtttaccccccg

SEQ ID NO: 154717 - DNA, 640 bp, Homo sapiens
  misc_feature: GYAE6OF02IVXIA.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatcctcctgcactggaaccagcagtgtacttttgtgcttaataactatgtctcgtggtaccagccaccaccaggacaaacgcccctaaacttcctttagttttcgacggtcaaggtaacgccggtcctcgacggtacgtccctgtacgttcggttctcgtcgtaccctacgtaacgttctacggaccaaacgtccggtcccttcccgtcgacccgttctacgtcgggtcctaccgaggtctacgggaaggtactcggaggtcgtagtaacttactacgttgcctaggcactatacgtcgaccggaccctaaaggtgggttcgttcgggcggacgggtaactaacgggtcgtacccgttcgtacgggtacaacggacccgtaggcctacccgccccgttcgtacctaccgttccgttccgttccccgaccttccg

SEQ ID NO: 154718 - DNA, 667 bp, Homo sapiens
  misc_feature: GYAE6OF02HOBL4.10.38.D05.1.454.CMB.1.raw
  modified_base (664)..(664): a, c, t, g, unknown or other
  misc_feature (664)..(664): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggcaaacgccccaaactccttgttttgagtcagtagcgcctgaggactcctgattcggttctcgtcgccctccgaagtctggccaacgaccggccttccctgacccgtctcgtcgggcctccgaggctggaggatggagctagactttacagtgcacgcgactagttacttacgacggacccctaaacggtacgggtttggtttcggggacgggtacggggtaacgttaacggggtacggtaacccggtttccggttacggggttaccgacggaccccgaaacgggttcccgtcccggtaccccccgttcggtaccctaccgttcccgttccgtttcccccggtccccttcccgttacccgtaccttacgttacgtacgccgttcggacggtccgggtccgtacgggaccgtaacgggccgtacgacggtacgntcg

SEQ ID NO: 154719 - DNA, 523 bp, Homo sapiens
  misc_feature: GYAE6OF02IJ45J.10.38.D05.1.454.CMB.1.raw
  modified_base (215)..(215): a, c, t, g, unknown or other
  misc_feature (215)..(215): n is a, c, g, or t
  modified_base (346)..(346): a, c, t, g, unknown or other
  misc_feature (346)..(346): n is a, c, g, or t
  modified_base (517)..(517): a, c, t, g, unknown or other
  misc_feature (517)..(517): n is a, c, g, or t
  modified_base (519)..(523): a, c, t, g, unknown or other
  misc_feature (519)..(523): n is a, c, g, or t
tcagcatagtagtgcacgaccggtgctcgatttagtatctgatagttgggtttgggtccctgagactctcctgtgcagcctctgggttcagcatcagtaacgactacatgacctgggcccgccaggctccaggggaaggggctggagtgggtctcagttattgaaacagatggcactacatattattctgactccgtgaagggccgttcaccctnccagagacacttccaaacaacatcttgtatcttcacatgcacaatctgagagtcgacgacacggccacctattatgtgcgcgacatgactacgctcaatttcgtggggccagggagcccaggtcaccgtcnccccagcctccaccaacgggcccagtccggttccttacccccgtggccgcccctcgcctccgacggacgcaccctccgagacgcacacgccggcccgtcgggctcgctcggtcgaacggtactacctcccacttactatcgctgacggcggcgtggcgaaggcgcaatcgncnnnnn

SEQ ID NO: 154720 - DNA, 631 bp, Homo sapiens
  misc_feature: GYAE6OF02IH52I.10.38.D05.1.454.CMB.1.raw
  modified_base (472)..(472): a, c, t, g, unknown or other
  misc_feature (472)..(472): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgtacttttgtgcttaataactatgtctcctggtaccagccacccacccaggaccaaaacgacccccctaaaacttccctttgtttttacggacggttacaaggttaacggccggtcccctacgacgggtacgttccccgtagtacgttcggtttcctcgtcgtccctacctaacgtcgtcggaccaacgccggtccctcccgtcgacccgtctcgtcggcctcgagctggagtgngagctgtacttactacgtgacaggccatatacttcgaccgtacccaagtgggttgttcgggcggacggtacgtacggtcgaccgtcgtggtcacggaccgacggtccgtccgtccccgtcggtacctacccgttccgtcccgttccccgcccttacccg

SEQ ID NO: 154721 - DNA, 643 bp, Homo sapiens
  misc_feature: GYAE6OF02HSSK8.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggctggatccgaggccgtcggggggtccctgagactctcctgtgcacgcctcgtggtcagcatcaagtaacgactacagtacgacccgtcgggccccgaccgacggccgtaccggaggggagggcgtgggaggtgggtctcgtaggttatagaaacagagtcggacactacattattattctgtacgtcgtaggtacgggtccgttaccacccgtctccgaagtacgacctaccttaccaaactaactcttcttgttacttccttacactatcgacaactatctagacgtacgtcgaaccgcgtacccggacctaacctttagtttacgttcggcgacccggtacgtaaccgtacgttacggtaacccttacgacccttacgttaaccggttccggggtacggggtaccccggaacggggtacccgg

SEQ ID NO: 154722 - DNA, 641 bp, Homo sapiens
  misc_feature: GYAE6OF02HWDYU.10.38.D05.1.454.CMB.1.raw
  modified_base (358)..(358): a, c, t, g, unknown or other
  misc_feature (358)..(358): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctggagactctcctgtgcagcctcgtgggttcagcatcagtaacgactacatcgaccgtcgggccccgcaggcctccgaggggacgggctgggaggtgggtctcgtagttatagaaacngatcggcactacatattattctcgtactccgtaggaacgggtccgttaccaccctcgtaccaaggacgtaaccctaccttacccaaaactaactacttcgttagtacttcgtttacactatcgacaacctaatcgtagacgtacgtccgaaccgaccgacccggacctaacccgtttagttaccgttacggtcgtaccggacgtaaccgtagttacccggtaaccgtacggtaccttaccgtaaacggtttcccggtacgggggaccccagggggtaaccccg

SEQ ID NO: 154723 - DNA, 650 bp, Homo sapiens
  misc_feature: GYAE6OF02G7RDM.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaacgccccaaactccttgttttgagtcagtagcgcctgaggacgtcctgacttcggttctctcgccctcaagtctggacaacgaccgcctcctcgaccgtctcgtcgggccgtccgggctggacggagtcggacggtcgtacgtacttacctacgttcgacgacgccgactattacttcgaccggtaccccgaaacgtacggggttcgtttcggggacgggtaccggggtaacgttaacgggtaccggtacccggttccggttcgggtaccgaccgggacccgaacgggtcccgtcccggtcccccgttcgggtacctacccgttcccgttacccggttacccccttaccccgttccccgtaccccg

SEQ ID NO: 154724 - DNA, 532 bp, Homo sapiens
  misc_feature: GYAE6OF02JCJ0L.10.38.D05.1.454.CMB.1.raw
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
  modified_base (513)..(513): a, c, t, g, unknown or other
  misc_feature (513)..(513): n is a, c, g, or t
  modified_base (527)..(527): a, c, t, g, unknown or other
  misc_feature (527)..(527): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctctggtaccagcaccaccaggcaaacgccccaaactccttgttttgaggtcagtaagcggccctcaggagtccctgatcggttctctgccctcaagtctggcaacaccggcctccctgaccgtctctgggctccaggctgacggatgaggctgattactctgcagcgnatactcgcggacccaacgngggttcgttcgggcggtcggtacgtaaggtcgtaccgtcgtggtcacgccgaaggctcgcccctcggtcncctctccgttcccncctcc

SEQ ID NO: 154725 - DNA, 713 bp, Homo sapiens
  misc_feature: GYAE6OF02I81QD.10.38.D05.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
tcagcatagtagtgcacgaccggtgctcgatttagtatctgatagttgggtttggggggggtctcaggaggcagcgctctcaggacgtcaccaccatggcctgggctctgctcctctcaccctcctcactcagggcacagggtcctgggcccagtctgccctgactcagcctccctccgcgtccgggtctcctggacagtcagtcaccatctcctgcactggaaccngcagtgtactttgtncttaataactatgtctctgtaccagcaccaccagacaaacgccccaaacttccttgttttgaggtcaggtaacgcggccctacgaggtacgtccctgtactcggttctcgtcgcctcaagtcgtgacaacgcgcctcctgtaccgtctcgtcggcctccgacggtctacggaggtacgtcgggtacggtaccttaggttaacctttaaccgttacgttacgacccggtaacggtacggtacctaagttaaccgtttacccggaaccggtaacccccgtaaagggttcggggtttacggtttcgggaccggggtaccggggtaaacgttaaacggggtcccggtaacccggttccggtacgggtacccgtaaccggtaccccgggtaacgggtccccgtacccggtccccccggtttacggtacccgttaccgttcccgttaccccggtttacccccctacccctttccccg

SEQ ID NO: 154726 - DNA, 608 bp, Homo sapiens
  misc_feature: GYAE6OF02G20YB.10.38.D05.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttanaactntgtctctggtaccagcaccacccagacaaacgccccaaacttccttgttttgaggtcagtaacgccggcctgaggtcgtcctgactcggttctctcgcctaccaagtctggacaacgaccggccctcccgtgacccgtctcgtcgggcctccgaggtctaggagtatggagtctagtaacttactacgtgacagccgacaattactcgaacggtaccccaaggtggggtttgttcgggccgggtacgggtaacgttaagggtcgtacccgttcgtcgggtaccacggacccgtaagggtcctcccggtcccccgttcggtacctaccgttccgtccggtttcccccgcccttacccg

SEQ ID NO: 154727 - DNA, 658 bp, Homo sapiens
  misc_feature: GYAE6OF02JZS9D.10.38.D05.1.454.CMB.1.raw
  modified_base (303)..(303): a, c, t, g, unknown or other
  misc_feature (303)..(303): n is a, c, g, or t
tcagcatagtagtgcacgaccggtgctcgatttagtatctgatagttgggtttggggggaggaggagcccagcactgggattccgaggtgtttccattcggtgatcagcactgaacacagaggactcaccatggagttttggctgagctgggttttccttgttgctatttcaaaggtgtccactgtgaggttcaactggtggagactggaggaggctggatccagcctgggggtccctgagactctcctgtgcagcctctgggttcagcatcacgtaacgctacatgacctgggccccgccgnggcctaccgacggggaaggggcctagggacgtcgggtctacgtagtttactaggaaacctaggacttggccacgtacattattcttcgtgactccggtagaacgggtcccgtacaccctcgtacccaggtacaccgtccttacccaaactaaccattacccttaggtaccttacctttacaacctacttacggcctaaaccgtattaccttaggaaaggtaccgtaccggaacggttaacccaccggtacccaaccttaagtttacttcgaacggttcccggaaccgtatacgttacggtacctaacccgtcgttacaaaccgttttcgggccggggttacccgaggaaccccgg

SEQ ID NO: 154728 - DNA, 694 bp, Homo sapiens
  misc_feature: GYAE6OF02IC1ZF.10.38.D05.1.454.CMB.1.raw
tcagcatagtagtgcacgaccggtgctcgatttagtatctgatagttgggtttgggggggagaggagcccagcactgcgattccgaggtgtttccattcggtgatcagcactgaacacagaggactcaccatggagttttggctgagctgggttttccttgttgctattcaaaaggtgtccactgtgaggttcaactggtggagactggaggaggctggatccgagccgtggggggtccctgagactctcctgtcgcagccttcgtgggtcagctatcaagtaacgactacatcgacccgtgggaccccgccgacggtcctcccggaaggggtaacgggcgtggggacggtggggtcctacgtaaggtttacgttagaaaacgaggtagtaggaccgtactaactaatatttaacgtctacgtacctcccggtaggaaaccggggtcccgttaccgacccctacgtaccgaaggaacgtaaccctacgttacccaaaactacctagttccttaagtacctttacctactaactacgttacacctaacgttaactcgttaggaaccgtaagtacccgaacggaaccgtacccaaccgttaacttaagtttacgttacgttcggaccggacctaacgagttaccgaaccgttacgtcctacccgttaaggtttcccggaacggggccgtaacgggg

SEQ ID NO: 154729 - DNA, 655 bp, Homo sapiens
  misc_feature: GYAE6OF02JDL7Q.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgataggttgggtttggggggggtctcaggaggcagcgctctcaggacgtcaccaccatggcctgggctctgctcctcctcaccctcctcactcagggcacagggtcctgggctcagtctgccctgactcagcctcgctcagtgtccgggtctcctggcagtcagtcaccatctcctgcactggaaccngcagtgatggttggtgttatgtactttgtctccgtggtaccaacagcagccacggacgaacgccccaattcatgtatttatgatgtcgagtcgcgcggtccgtcggggtccctgactcgtcttctctcggcctaccgaagtcctacggaccaaccgaccgccctcccgtacgaccctactccgtccgtcggtccctccgacggtcccgttaggacggtagtcggacggtcgttacgtactttaaccgtactcggacctacggaccgtacgtaacgttacgtacccggaccgggtaccccgtaacgggttcggggtttacggtttacggggtccggggtaccgggtaaacggttaacgggtccggtaacccgggttccgggttcgggtacccgaccgggtaccccggtacggtccccgttcccccggg

SEQ ID NO: 154730 - DNA, 497 bp, Homo sapiens
  misc_feature: GYAE6OF02FZDDM.10.38.D05.1.454.CMB.1.raw
  modified_base (328)..(328): a, c, t, g, unknown or other
  misc_feature (328)..(328): n is a, c, g, or t
  modified_base (476)..(476): a, c, t, g, unknown or other
  misc_feature (476)..(476): n is a, c, g, or t
  modified_base (478)..(497): a, c, t, g, unknown or other
  misc_feature (478)..(497): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacaccggcctccctgaccgtctctgggctccaggctgaggatgaggctgattactactgcagcgcatattcacggccccaagngggttgttgggcggcgggaactaaggtgaccgtccgtgggtcacggcccaagggcctacggcccccctgggtccacgtctcgttccccgccctcctccactactactcgctggacgccgggcgtcgggccgaacgggcgactagtagncnnnnnnnnnnnnnnnnnnnn

SEQ ID NO: 154731 - DNA, 544 bp, Homo sapiens
  misc_feature: GYAE6OF02HW0E1.10.38.D05.1.454.CMB.1.raw
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
  modified_base (382)..(382): a, c, t, g, unknown or other
  misc_feature (382)..(382): n is a, c, g, or t
  modified_base (445)..(445): a, c, t, g, unknown or other
  misc_feature (445)..(445): n is a, c, g, or t
  modified_base (543)..(544): a, c, t, g, unknown or other
  misc_feature (543)..(544): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttaataactatgtctcctggtaccagcaccacccaggcaaaacgcccccaaatccttgttttgaggtcagtaagcggccctnagagtcctgatcggttctctgcctcaagtctggacaacncggcctccctgacccgtctctgggctccgaggctggaggatggaggctgaacttactaactgcngcgcatattcacggccccaagtagggttgttcgggcggacgggaacgtaaggtcgaccgtcgngggtcacgcccgaaggctaccgcccctcggcacctcttcgtcccacctccctaccactactatcgctcgagcggcgtggacgtaacggcgacagtagnn

SEQ ID NO: 154732 - DNA, 719 bp, Homo sapiens
  misc_feature: GYAE6OF02HUEX7.10.38.D05.1.454.CMB.1.raw
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgttgtcttaataactatgtcttccgtaggtaccagccacccaccgaggaccaaacgacccctaaacttcctttgttttgaggtacaggtaacgccggccctcgaggacgttcccgtgacgttcggttctcgtacgtccctaccgaagttccgtaggaccaaccgaccggccccttcccgtacgtacccgttcttcgcgggtcctaccggaggtctaggaggactcggaggtctagtaacttactaacgtgacgacgcgtactagttacttaccgaccggaaccccgtaacggtacgggttggtttcggggaccgggtacggggtaacggttaacggtacggtacccggttccggtcgggtaccgaccgacccgtacgggccgttcccgtaccccgttccgtaccttaccgttccgttcccgttcccctacccttcccctacctacccgttaccttacgtaccgcggttacggaccgggtccggtccggttacggaccggtaacgggccgaccgtaacgttagcgtg

SEQ ID NO: 154733 - DNA, 638 bp, Homo sapiens
  misc_feature: GYAE6OF02HAN5O.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcatcagtaacgactacatcgaccgtcgggcccgccgacggctccgaggggacggggctgggaggtcggtctcgtagttatagaaacagagtaggactaactactattattacttcgtagtaccgtacgtacggaacgggtcccgttaccctacccgtcaccgagaacgacctaccttaccaaacaaccgtcttcgttagtaccttctaccaactactcaccaacctattccgaggtacgacgtaccgaacgtacccgaccgtacccaaccgttttattacggttcggtacgccggaactacctagtaccgtaacctaccgtacctacgttagttaccggggtaccggggacccgtagggaccccgg

SEQ ID NO: 154734 - DNA, 581 bp, Homo sapiens
  misc_feature: GYAE6OF02GIKIW.10.38.D05.1.454.CMB.1.raw
  modified_base (350)..(350): a, c, t, g, unknown or other
  misc_feature (350)..(350): n is a, c, g, or t
  modified_base (402)..(402): a, c, t, g, unknown or other
  misc_feature (402)..(402): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctcgggccccgccaggcctccgaggggaaggggctggagtgggtctcgagttatgaaacngatggcactacatattatctagtactcgtagaacgggccgtttcacccttcncccagacgacctaccttacccaaacaactattcttagtacttcttacacattgcaacgaattcgtagacgtagtcgaacgacaccggaccctaacttattacgttggtcgcgacgaactagtccgaaccttacggtacctaccgtaacgtttccggcgggggtaccccaggggtacccg

SEQ ID NO: 154735 - DNA, 599 bp, Homo sapiens
  misc_feature: GYAE6OF02IHNVN.10.38.D05.1.454.CMB.1.raw
  modified_base (441)..(441): a, c, t, g, unknown or other
  misc_feature (441)..(441): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgacttttgtgcttaataactatgtctcctggtaccagcaccaccaggacaaacgcccccaaacttccttgtttttgaggtcagtagcgcctgaggactcctgatcggttctctgccctcaagtcgtggaccaacgaccggtccctccctcgacccgtcctcgtcgggcctccgaggtctggagatggagctagtacttacgtactgacncgcgacatactaccgaccgaccccaaggtcgggtttggttcgggcgggtacggacgttaagggtcgaccggtccgtgggtccacggtacccaagggtcccttacccggtcccccgttcggtccctaccgtcccgttaccgttcccccacccttccccg

SEQ ID NO: 154736 - DNA, 571 bp, Homo sapiens
  misc_feature: GYAE6OF02GMI7S.10.38.D05.1.454.CMB.1.raw
  modified_base (360)..(360): a, c, t, g, unknown or other
  misc_feature (360)..(360): n is a, c, g, or t
  modified_base (397)..(397): a, c, t, g, unknown or other
  misc_feature (397)..(397): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggctccgagggaaggggctgggagtgggtctcagttatgaaacagatggcactanatattatctgactccgtgaacgggtccggtcaccctntaccagacgactaccttcccaaacaactatccttagtacttcttcactatcgccaacatctagagtacgtcgaacgaccgaaccggtcccaaccgttattagttcggtagcccggcgaactagttacgaccgttaacgcttacgtaactttcggcggggacccaggggtacccg

SEQ ID NO: 154737 - DNA, 572 bp, Homo sapiens
  misc_feature: GYAE6OF02FUUH3.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaacgcccccaaactccttgttttgaggtcagtaagcgcctcaggatccctgatcggttctctcgcctccaagtctggcaacgacggccctccctgacccgtctccgtgggcctccgaggctgaggatggaggctgattactacgtgcagccgcatacttcgacggaccccaagtaggggttgtttcgggcgggcgggtaacgtaagggtcgacccgttcgtgggtcaacggcccgaacggcctaccgcccccgttcggtcctaccgttccgtccgttccccacccttccc

SEQ ID NO: 154738 - DNA, 527 bp, Homo sapiens
  misc_feature: GYAE6OF02GGDPN.10.38.D05.1.454.CMB.1.raw
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
  modified_base (469)..(469): a, c, t, g, unknown or other
  misc_feature (469)..(469): n is a, c, g, or t
tcagcatagtagtgcacgaccggtgctcgatttagtatctgatagttgggttttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctccgagggaagggcgtggagtgggtctcgagttattgaaacngatggacactacatattatctgactcgtgaaggtccgtcaccctntccagacgacactcaaacacatctgtatctcacatgcaacatcagacgagtcgacgacaccggcaacctattattgngcggacacacgtagacctaacgtctactaaacgttccgacgggggccaaggggtaccg

SEQ ID NO: 154739 - DNA, 579 bp, Homo sapiens
  misc_feature: GYAE6OF02F6AMN.10.38.D05.1.454.CMB.1.raw
  modified_base (356)..(356): a, c, t, g, unknown or other
  misc_feature (356)..(356): n is a, c, g, or t
tcagcatagtagtgcacgaccggtgctcgatttagtatctgatagttgggttttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctggttcagtcatcagtaacgactacatgacctgggcccgcaggctccgagggagggctggagtgggtctcagttattagaaacagatggcactanatattatctgactcgtgaacgggccggttccaccctctccagagaccacttaccaaacaacattctgttatcttcacactgacctaactaatcctaggacgtacgtaccgacgaccaccggaccctaaccttaatttacgtcggtcgccggacgaaccgtatacggtaacctaccgacttaccaacgtttccgggtacgggggaccctagggggtaaccccgg

SEQ ID NO: 154740 - DNA, 763 bp, Homo sapiens
  misc_feature: GYAE6OF02JRTBZ.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgaggtcctgggcccagtctcgccctgactcacgcctccctccgccgtccgggtctcctggacagtcacgtcacctatctcctgacacgtcggaaccagcagtcgtactttgtgacttataactatcgtctccgtacggtaccacgaccaccaccgaggaccaaaccgtcccctaaacttccgtttggttttaggacggtaccaaggttaacggcccggtaccgtacgacgggtaccgtcccgtgtacgttccggttcctcgtccgtcccgtaccgtagttccgtggacccaaacggccgtccctcccgtacgtccgtccgtacgtcggtcccgtaccggcggtcggtacggtacggtaacgtggtacggtcgtacggtaacttacgttacggtacgtacgacggtaccgtacgttaacgttaaccgttaccgtaacccggaacccgtaacgggtacgggggtttacggtttacggggaccgggtaccgggtaaacggtaaacgggttccgtaacccggttcggttaccggtaccgaaccggtacccgtaacggtcccgttacccggtccccgtaccggtacccggtccgttcccgttacccgttacccccgtaccttaccccg

SEQ ID NO: 154741 - DNA, 688 bp, Homo sapiens
  misc_feature: GYAE6OF02FHBL2.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctctggtaccagcaccaccaggcaacgccccaacttccttgttttgagtcagtaacgcggcctcgaggacgtccctgactcggttctctcgcctccaagtctggcaacgacggccctccctcgacccgtctcgtcgggcctccgaggcctaggaggtatggaggtctagtaactttacctacgttcgactacgccgactaattacgttccgaaccggtacccctaaacggtacggggtttcggtttacggggaccgggtaccgggtaaacgttaacggggttccggtaaccccggttccggtacgggggtaccctaaccgggtaccccgtaaacggggtccccttacccgggtaccccccccgttacggggttaccctaacccgtttcccggtttaccccgggtttacccccccgtcccccgtttacccccg

SEQ ID NO: 154742 - DNA, 761 bp, Homo sapiens
  misc_feature: GYAE6OF02IV5I4.10.38.D05.1.454.CMB.1.raw
tcagcatagtagtgcacgaccggtgctcgatttagtatctgatagttgggtttgggggggggtctcaggaggcagcgctctcaggacgtcaccaccatggcctggctctgctcctcctcaccctcctcactcagggcacagggtcctgggcccagtctgccctgactcagcctccctccgcgtccgggtctcctggacagtcagtcaccatctcctgcactcggaaccagcagtgtacttttgtgtcttaataactattcgtctcctggtaccagaccacccacccaggaccaaaccgccccctaaacttcctttgttttgaggtcaggtaacgccgccctgaggactcctagacttccggttctccgtcgtccctactaacgtcgtacggaccaaccgaccggtccctcccgtcggtacccgttcgtccggtcgggccttccggacggtcgtaggaggtacgtggacggtctaggtactttaacgtacgtcgaccgtacgccgtactacttaaccgttaccgaacccgggtaaccccgttaaacgggtacggggtttacggttccggggaccggggtaaccgggttaaacggttaaacggggttcccgtaacccgggttccggttacggggtacccgtaacccgggtaacccggtaaccgggtccccgttaccccggtaccccccggttaaccgggttcccgttaacccggtttccccggttaccccggttttacccccccgtcccgtttaacccccccg

SEQ ID NO: 154743 - DNA, 707 bp, Homo sapiens
  misc_feature: GYAE6OF02IBPEA.10.38.D05.1.454.CMB.1.raw
  modified_base (161)..(161): a, c, t, g, unknown or other
  misc_feature (161)..(161): n is a, c, g, or t
  modified_base (183)..(183): a, c, t, g, unknown or other
  misc_feature (183)..(183): n is a, c, g, or t
  modified_base (341)..(341): a, c, t, g, unknown or other
  misc_feature (341)..(341): n is a, c, g, or t
  modified_base (701)..(701): a, c, t, g, unknown or other
  misc_feature (701)..(701): n is a, c, g, or t
tcagcatagtagtgcacgaccggtgctcgatttagtatctgatagttgggtccctgagactctcctgtgcagcctctgggttcagcatcagtaacgactacatgacctgggcccgccaggctccgagggaagggctggagtgggtctcagttattgaaacngatggcactacattattattcngactccgtgaagggtccggttcaccctctccagagacctaccttccaaacaactattcttagtattccttacacatcgcacaatctgagagtcgacgacacggcctacctattattgtgcgcgacatgactacgctacaattcgtggggccagggacncccgaggtccaccgtctccccagccctccaccgaacgggcccagttccgggtcccttacccccgtgggacccgtccctcggacccttacccgacgggtaccgaccgtaacccgtacccggtaaggaaccggtcccgaaaccgacgggtaccccgggtccccggttagggggacccttccgggtcccggttacgggttaacccgaaaaccggggtaccctttacccgtttaacccctacgtttaaccgttaacgtcggaccgttacgggaccgggtaccgggggtcccgttacggggaacccggtaaacggggtcccgtaacccgtaaaggtttaccgggcttaccggagtccggctacgntaaccg

SEQ ID NO: 154744 - DNA, 792 bp, Homo sapiens
  misc_feature: GYAE6OF02HWDWG.10.38.D05.1.454.CMB.1.raw
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacgagggtcctgggcccagtctcgccctgactcagccctccctccgcgtccgggtctccgtggacagtcagtcaccatctcctgcacgtcggaaccagcagtgtacttttgtgactttaataactatcgtcttccgtggtaccagccacccaccgacggaccaaaccgaccccctaaacttcccttttaggttttcgacggttacaacgttaacggcccggtacccttacgacgggtaccgttccccgtagtaccgtttcgggttcctccgtcgtaccccttaccgaacggtttccgtacgggaaccctaaacccggtacccgggtcccccttacccggtacccggtaccccgtttccgttaccgggtccgggtacccttacccgggtaacgggtccgttacgggaacggtacgtcgggaacgggttacgttacggttaacgttttaaccgtaccgttggaccgtacgtccgtaacttacgttaaccgttaccgaacccgggaccccgtaaagggtcggggtttacgggttcgggaccggggtaccgggtaaacgtaagggttccgtaccggtcggtaggtaccgacggtacccgacggtcccgtacccggtcccgtacgtccgtaccttccggtacctcccccgtaccttcccgg

SEQ ID NO: 154745 - DNA, 586 bp, Homo sapiens
  misc_feature: GYAE6OF02JAJLF.10.38.D05.1.454.CMB.1.raw
  modified_base (326)..(326): a, c, t, g, unknown or other
  misc_feature (326)..(326): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggccccgccaggcctccgagggagggctgggngtgggtctcgagttattgaaacagatggacacgtacatattacttctcgtactccggtggaacgggtcccgtttcacccctctacccgaagtacgaacctacttacccaaacaactacttacttgtacttccttacactatcgaccaacaattccagagacgtacgacgaaccaccggccctaacctatttacgttgcgacggcgtaccatacgacctacgtcctacgtaacttccggtaggggaccccgtagggacccg

SEQ ID NO: 154746 - DNA, 801 bp, Homo sapiens
  misc_feature: GYAE6OF02IIQS2.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcacccctcctcactcgagggcacgacgggtcctcgggcccagtctcgccctgactcacgtccctccctccgcggtccgggtctcctggacagtcagtccaccatcctccgtgaccacgtacggaaccagcagtgtacttttgtacgtcttaataacttatcgtctccgtacggtaccagaccaccgaccgaggacaaccgaccccctaaacttcccgttttagttttacggacggtacgtaaggttaacggccggtacccctagtacgggtaccgttccctaggtacgttccgggtttcctacgtcgtaccctaccgtaacgttccgtaggtacccaaccgaccggtccctcccgtacggtaccccgttccgtccgggttaccgggcccttcccggacgggttccgtagggtaacggaacgtttggacgggttaccttaggtaacctttaccgtactacggtacgacggtaccgtactaagttaccttaccgaaccggtaaccccgtaagggtacgggttttcggggttacgggacccggggtacgggtaaccggttaaagggtccggtaacccggttcccgggtagggtaccgaacccggtacccggtaaggtcccgtaccccggtaccccgttcgggtaccctaccgttccgttaccccggttcccccgcccgttaccccg

SEQ ID NO: 154747 - DNA, 584 bp, Homo sapiens
  misc_feature: GYAE6OF02JDOVI.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgagggaagggctggagtgggtctcagttatgaaacagatggcactacatattatctgactccgtagaacgggtccggttcacccctctaccagacgacctaccttaccaaactaactattacctttgttaacttcctttcaaccgtattcgactaactaatcctagaagacggttcgaaccgacaccgggcccaacctttattactttgcggtccgacgtacattacgacctaaccggtccttaaccaagtttccggtacggggccctaacggggg

SEQ ID NO: 154748 - DNA, 663 bp, Homo sapiens
  misc_feature: GYAE6OF02JBV9C.10.38.D05.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (233)..(234): a, c, t, g, unknown or other
  misc_feature (233)..(234): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
tcagcatagtagtgcacgaccggtgctcgatttagtatctgatagttggggtttggggggggtcgtcgaggaggcagcgctctcaggacgtcaccaccatggcctgggctctgctcctcctcaccctcctcactcagggcacagggtcctgggcccagtctcgccctgactcagcctcctccgcgtcccgggtctcctggacngtcgatcaccntctccngcactggaaaccnncgagtgacgttggtagttaataactntntctcgtcgtaccaacaacaccgacgacaacgacccaacacactatatttnatgtactagtacgtccgtccgtacgtacggttactacgtcgtcttctcgtcgtctacctacgtcgtacggactacgaccgtccctaccctcgaacctctccgttcgtcggtcctccgacggtacgtacggacggacggtacgtcgtacgtacgtttaacgttacgttacggtctacgtactacgtaacttaacgtaacctaaccgtacgacgtactaccgttacgtttacgttaccggttacggtaccgggacgggacggtaccgtaacgtcgtaccgggttaccgttacggtaaccggtacacccggtaccgtacggtccgtcccggtaccccggttccgtaccgtaccc

SEQ ID NO: 154749 - DNA, 595 bp, Homo sapiens
  misc_feature: GYAE6OF02HBH9K.10.38.D05.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (322)..(322): a, c, t, g, unknown or other
  misc_feature (322)..(322): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatctcctgcactggaaccngcagtgactttgtgcttaanaactatgtctctggtaccagccaccaccaggacaaacgccccaaacttccttgttttgaggtcagtagcgcctnagacgtcctgacgtcgtctctcgtcctcaagtctcggacaacgccggtccctcctcgtaccgtctcgtggcctccgagtcgtaggaggtatcggaacgtctagtaacttacgtacgtcgcaacgccgatatctccaacggtaccccaaaggttcgggttagttcgggacggtacgggaagttaacgggtcgacccggttcgtcggacgtaccggaccgacgtccgtcccgaccccgtgtcccgtacctttccgtccttacccccaccttcccg

SEQ ID NO: 154750 - DNA, 601 bp, Homo sapiens
  misc_feature: GYAE6OF02FUN0T.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccagcaccaccaggcaaacgcccccaaactccttgttttgaggtcagtaagccggcctcaggacgtccctgactcggttctctcgcctcaagtctggcaacgacggccctccctgaccgtctcgtcgggcctccgaggctggaggatggaggctgtacttacctactgcagcgctattacttccgacggaccccaaggtacggggttgtttcggggcgggtacgggaacgttaagggtcgacccggttccgtgggtccacggtcccgaaggtcccgtcccggtcccccgttcggtacctaccgttccgttccgtttcccccacccgttccctaccc

SEQ ID NO: 154751 - DNA, 573 bp, Homo sapiens
  misc_feature: GYAE6OF02HQWBR.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagtctctgggttcagcatcagtaacgactacatgacctgggcccgcacggctccgagggaaggggctgggagtgggtctcgtagttattgaaacagatggacacgtactatattattctgtactcgtgaagggtcccgttaccaccctctccgaagacgacctacttaccaaacaacacttgttacgtacttcttcaacatcgaccaactaactcgttagaagtacgtacggaaccgaccacggacctaccttattacttggtcgcgacgtacgagtacgacgtacgactcgtaacgttccggtcgggacgtaacgggg

SEQ ID NO: 154752 - DNA, 652 bp, Homo sapiens
  misc_feature: GYAE6OF02HLAE2.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaacgccccaaatccttgttttgaggtcagtagcgcctgagctcctgactcggttctctcgcctcaagtctggcaacgcggcctccctgaccgtctcgtcgggctccgaggtctggacggtatggacggtctaggtaactttaccgtacgttgaccaggccgtactaattacgttccgaacggtacccccaaaggtaggggtttcggtttacggggccgggtaccggggtaaacgttaaagggttccggaacccggttccggtaggggtacccgaacggcccccggtaaagggtcccgttcccggaccccccgtttcgggtaccctacccgtttcccggttcccggtttacccccctacccccgttaccccg

SEQ ID NO: 154753 - DNA, 468 bp, Homo sapiens
  misc_feature: GYAE6OF02FUD1L.10.38.D05.1.454.CMB.1.raw
  modified_base (332)..(332): a, c, t, g, unknown or other
  misc_feature (332)..(332): n is a, c, g, or t
  modified_base (440)..(440): a, c, t, g, unknown or other
  misc_feature (440)..(440): n is a, c, g, or t
  modified_base (446)..(468): a, c, t, g, unknown or other
  misc_feature (446)..(468): n is a, c, g, or t
tcagcatagtagtgcacgaccggtgctcgatttagtatctgatagttggggtttggggtctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacaggggtntttgggcggcgggactaaggtgaccgtcctgggtcagcccaaggctgccccctggcactctcgttccccgccctcctccactactatgctgagcgggctggcagggcncatagnnnnnnnnnnnnnnnnnnnnnnn

SEQ ID NO: 154754 - DNA, 752 bp, Homo sapiens
  misc_feature: GYAE6OF02IGBIV.10.38.D05.1.454.CMB.1.raw
  modified_base (741)..(741): a, c, t, g, unknown or other
  misc_feature (741)..(741): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcacgccctccctcgcgtccgggtctccgtggacagtcagtccaccatcctccgtgccacgtcggaaccagcaagtgtacttttgtgactttaataacttatcgttctccgtacggtaccacgccaccaccgagaaccaaaccgaccccctaaacttccttttaggttttcgacggttacaaggtaacgccggtaccctacgacgggtaactcccgtggtaacgttcgggtttcctcgtcgtcccttaccgtaacgtccgtacggaccaaccgtaccggcccttcccgtcggtacccgttcgtcggtcgggtaccttaccggaggtcgtgggaacggtcgtaggtacggtacgttagttaactttaccgtacgtcggtaccacgggtctaacgtatacgttacggaacccggtaccctaacgggttcggggttacgggttaccggggacgggtacccgggggtaattaaccggggtccgacccggttcggtacgggtccgtaaccggacccgtacgggacccttcccggtaccccgttggtacccttccgttacccgtacccgtttaccccncccgttacccg

SEQ ID NO: 154755 - DNA, 607 bp, Homo sapiens
  misc_feature: GYAE6OF02FVWTJ.10.38.D05.1.454.CMB.1.raw
  modified_base (409)..(409): a, c, t, g, unknown or other
  misc_feature (409)..(409): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctctgggttcagcatcagtaacgactacatcgacctcgggccccgccgaggcctccgaggggaacggggctgggagtgggtctcgtagttattagaaacaggatggcactacatattattctgactcgtagaacgggtccgttcaccctntaccagaacgtacctacttaccaaacaacgtcttcttagttacttccttacacattcgacctacaattcgagacgtagtccgaacgaaccaccgggacccttaacttagttacgttcgacgaccggtccgaactatcggtaacccttacggcctttaaccgtaaccgttccgggtacggggacccgaacggggtaccc

SEQ ID NO: 154756 - DNA, 597 bp, Homo sapiens
  misc_feature: GYAE6OF02IZBG8.10.38.D05.1.454.CMB.1.raw
  modified_base (228)..(228): a, c, t, g, unknown or other
  misc_feature (228)..(228): n is a, c, g, or t
  modified_base (411)..(411): a, c, t, g, unknown or other
  misc_feature (411)..(411): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagcaccaccagcaaacgccccaaactccttgttttgaggtcagtaagccggcctcgaggtacgtcctagtacgtccggttctctcgccctactaagtctggcaacgccgtcctcctcgacctctcgtcggctccgagtctggagngtgaggctagtacttactactgcagcgctagttattccgacggtacccctaaggtagggttcgtttacggggccgggtacgggtaacgttaaacgggcgtacccgttcgtacgggttccacggtacccgacggtcctcccggccccgttggtcctaccgttccgtacccgtttcccaccccgttcc

SEQ ID NO: 154757 - DNA, 570 bp, Homo sapiens
  misc_feature: GYAE6OF02HF3XE.10.38.D05.1.454.CMB.1.raw
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(570): a, c, t, g, unknown or other
  misc_feature (549)..(570): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgtttttgaggtcagtaagcggccctcaggagtccctgatcggttctctgcctccaagtctggcaacacggcctccctgaccgtctctgggctccaggctgaggatgaggctgattactactgcagctcatatgtagatggtgccttctttacgaagggtttttccggacgggtaggggacccagggtcctacggtaccccggttaccctaaaggtccaacggaccccaaagggcctcggccccccttcgggtcccaccgttccgttcggtttccccccaccccttcccgtacccaaccgttacctaacgttcgccttaggacggccgggccgttagggaccaaacgggtcgacgtaacgtacggncncnnnnnnnnnnnnnnnnnnnnnn

SEQ ID NO: 154758 - DNA, 742 bp, Homo sapiens
  misc_feature: GYAE6OF02GAMP0.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactggaaccngcagtgactttgtgcttataactatgtctctgtaccagcaccaccaggaccaaacgacccccaaacttcctttaggtttttacggacggttaccgaaggttaacggccggtacccctacgaacgggtacgttcccctaggtacgttccggtttctaccgttcgtcccttacccgtaacggttccgtacgggaccctaaacggtacccggtccccttaccccgtacggaccccgttcgttaccggttcggggtccctacccggtaggtccgtagggacggtagtggacggtacttaggtaactttacctacgtcgacgacgtaccgactattacgttaccgaaccggtacccctaaaggtcggggtttggttcggggaccgggtaccgggtaacgttacggggtacgacccggttcggtcgggtaccgaacggacccgtaacgggtcccgtcccggtcccccgttacggtacccgtaccgttcccttcccggttcccccctaccccgttccccg

SEQ ID NO: 154759 - DNA, 651 bp, Homo sapiens
  misc_feature: GYAE6OF02FKDLC.10.38.D05.1.454.CMB.1.raw
  modified_base (265)..(265): a, c, t, g, unknown or other
  misc_feature (265)..(265): n is a, c, g, or t
  modified_base (300)..(300): a, c, t, g, unknown or other
  misc_feature (300)..(300): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttatactatgtctctgtaccngcaccaccagacaacgccccaacttcttgttttgngtcagtacgccggcctcgaggtacgtccctgtacgttcggttctcctcgccctaccgtaagtcctagggacctaacgaccggtccctcccgtcgtacccgttctccggtcgggcctccgaggtcgtaggaggtatggaggtctagtaacttacgtacttcgacgtagccgactaatacttacgaccggtaccccgtaaggtacggggtttcggttcggggaccgggtacgggtaacgttaacgggtccgacccggttccggtcgggtaccgaccggtacccgaacgggtcccgttcccggtcccccgttcggtacctaccgttccgttcccggttccccgtccccttcccg

SEQ ID NO: 154760 - DNA, 629 bp, Homo sapiens
  misc_feature: GYAE6OF02FV1UC.10.38.D05.1.454.CMB.1.raw
  modified_base (484)..(484): a, c, t, g, unknown or other
  misc_feature (484)..(484): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcacgtaacgactacatgaccgtcgggccccgccgaggcctaccggaggggaaggggcgtgggaggtgggtctcgtagtttattagaaactagagtcggactactaacattattattctagacctcccggtaggaacgggtcccggttacaccctctaccagacgtaacctaccttacccaaacacctacttcttgttacttccttcaaactntacgccaactaattccgtagacgtacgtaccgaacgaccgtaaccggaccccttacttaatttacgttcgtcggaccggactaccgtaagttccgaaccttacggccttacgtaactttccgggcggggtaccgagggtaacccg

SEQ ID NO: 154761 - DNA, 585 bp, Homo sapiens
  misc_feature: GYAE6OF02FLG1C.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacttttgtgcttataactatgtctcctggtaccagcaccacccaggcaaacgcccccaaacttccttgttttgacggtcagtaagcggccctcgaggacgtccctgactcggttctctcgcctccaagtcgtggacaacacggcctccctgaccgtctctcgggcctccgaggctggaggatggaggctagtacttacctacgtgcagcgctatacttcgacggaccccaagtacggggttgtttacgggcgggacggtaacgtaacggtcgacccgttcgtcgggtacgacggacccgaaggtcctccgcccccgtcggctaccttccgtccgttccccgacccttcccg

SEQ ID NO: 154762 - DNA, 782 bp, Homo sapiens
  misc_feature: GYAE6OF02G4OLE.10.38.D05.1.454.CMB.1.raw
  modified_base (245)..(245): a, c, t, g, unknown or other
  misc_feature (245)..(245): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcacgtggaaccagcagtgtactttgtncttataactatgtctctcggtaccagcaccaccaggaccaaacgacccctaaactccttgtttgagtcgagtaagccgcctcgaggtacgtccctgtactcggttctctcgcctactaagttccgtagacaaccgtacggtccctcccgtagacccttcgtccgtcgggcctcccgaggtctaggacggtagttacgggacggtcttacggttaactttaaccgtaccgttcggacgtaacggtccgaacctacgtttaacgttacccggtaaaccccgggaacccccgttaaacgggtacgggggttttacgggtttaccggggaccggggtacccggggttaaacgtttaaacgggggttcccgtaaccccgggtttcccgggtttccggggtaacccgtaacccgggaaccccggttaaaccgggggtccccgttaccccgggttccccccccggttacggggttaaccccttacccggtttacccccggtttaccccgggttttaccccccccgtaccccgtttaccccccgg

SEQ ID NO: 154763 - DNA, 640 bp, Homo sapiens
  misc_feature: GYAE6OF02HG8BO.10.38.D05.1.454.CMB.1.raw
  modified_base (259)..(259): a, c, t, g, unknown or other
  misc_feature (259)..(259): n is a, c, g, or t
  modified_base (577)..(577): a, c, t, g, unknown or other
  misc_feature (577)..(577): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtgggaggaggctggatccagccgtgggggtccctgagactctcctgtgcncgcctcgtgggttcagcatcaagtaacgactacatcgaccgtcgggccccgccgacggccgtaccggagggggaacggggcgtagggaggttcgggtctacgtagtttagtacggaaacagatcggactaactaactaattatttacttctacgtacgtaccggtagggaacgggtcccgtttaccaccctcgtacccgaagaaccgaccctaaccttaccaaacgaactacttaccgttagtaccttctactaccagtcactaacacttccgagacgtacgtcgaaccgaccaccgtacctaacttagttactggcnccggtacgactagtccgaacgtaccgtcttaacgtacgttcgggacgggacccgagggtcccg

SEQ ID NO: 154764 - DNA, 606 bp, Homo sapiens
  misc_feature: GYAE6OF02IAFPJ.10.38.D05.1.454.CMB.1.raw
  modified_base (561)..(561): a, c, t, g, unknown or other
  misc_feature (561)..(561): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggcgtggatccgagccgtgggggtccctgagactctcctgtgcacgcctcgtgggttcagcatcagtaacgactacatcgaccgtcgggccccgccgaggccgtaccggagggggaacgggcgtgggaggtcgggtctcgtagttattagaaacgagagtcggacactactattatttacttctgaccttacggtagaacgggtcccggttcacccgtcgtaccgaagacgacctacgttacccaaactaactacttctttagtacttcttacaactatcgaccaataactcgtagaagtacgtaccggacaaccgacgacctaacttattagtcgacggcgcctanacgtacgactaccgctacttaacgttcggcggggacctaacgggg

SEQ ID NO: 154765 - DNA, 560 bp, Homo sapiens
  misc_feature: GYAE6OF02INNC4.10.38.D05.1.454.CMB.1.raw
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctgggttcagcatcagtaacgactacatgacctgggcccgccaggctccgaggggagggctggagtggtctnagttatgaaacngatggcactacatatattctgactcgtagaagggtccgttacaccctctccaagacgactacttaccaaacaactattccttagtacttcttacactatcgcaacaatctagagactacggaacgaccaccgggccctaaccgttatttacgttgtacgccgcgaacgatacgtacctaacgcttacgaacgttccggaggggacccaggggtacccg

SEQ ID NO: 154766 - DNA, 567 bp, Homo sapiens
  misc_feature: GYAE6OF02ISVBP.10.38.D05.1.454.CMB.1.raw
  modified_base (564)..(564): a, c, t, g, unknown or other
  misc_feature (564)..(564): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggcaaacgcccccaaactccttgttttgaggtcagtaagccggccctcaggagtccctgatcggttctctgcctcaagtctggcaacacggcctcccgtgacccgtctcgtcgggctccgaggctggaggatggagctgtacttactactgcagcgcatatcgacgacccaagagggttgttagggcggtcgggacgtaaggtcgaccgtcgtggtcgacgccaaggctccgccccgtcggtccacgtcgtccgttccccgcccgtccctaccgtacctactacgtcgtcgtgacggtccgggtcgtcgggacgacgggccgacgtacgtacgntcg

SEQ ID NO: 154767 - DNA, 658 bp, Homo sapiens
  misc_feature: GYAE6OF02H92K7.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagtttggctgagctgggttttccttgttgctatttcaaaaggtgtccactgtgaggttcaactggtggagacgtgggaggaggcgtggatccaggccgtcgggggtccctggacgactctcctgtgcacgcctcgtgggttcagcatacaagtaacgactaacactacgaccgtcgggccccgccgacggcctaccgaggggaacgggcgtgggaggtcggtctcgtagttagttacgaaacgagagtcggacaacttacaatttaatttacttccgtacgtaccgtacccggtagggtaacgggtcccgggtttacctaccccgtctaccgaggaaccgtaacctacccttaaccaaaccgaactacgtttcttacgttaccttctttaccatactacgactaaacgtataccgtagacgtaggtaccgaccgaaccgcggtaacccacttaattcgttgacgtccgactacacgtacgacgtacctcgtaactaaccgtttcgggcggacccgaaggtcccgg

SEQ ID NO: 154768 - DNA, 596 bp, Homo sapiens
  misc_feature: GYAE6OF02IVVQ0.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggacaaacgcccccaaactcctttgttttcgagtcagtaacgcggcctcgagacgtcctgactcggttctctcgccctacgaagtctggaccaacgaccggtccctccgtcgacccgttctcgtcgggcctccgacggtcctcggaacgacggacggtactagtaacttaacttacgtgacacgctactatagtagtagtacgtcggtcgtccttcgtttacgtacgggttttcgggacgggtacgggacgacggtcgtacggtaccgtcgtaacgcgacgccgaggtccgtccgtccccgtcgtctaccgtcttcccg

SEQ ID NO: 154769 - DNA, 693 bp, Homo sapiens
  misc_feature: GYAE6OF02HP2YD.10.38.D05.1.454.CMB.1.raw
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
  modified_base (688)..(688): a, c, t, g, unknown or other
  misc_feature (688)..(688): n is a, c, g, or t
tcagcatagtagtgcacgaccggtgctcgatttagtatctgatagttgggtttggggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgcccccaaactccttgttttgaggtcagtagccggcctcgaggacgtccctgtacttcggttctcgtcgacccttaccaagttcgtcggaccaaacgccggcccttccgtcgtaccgtctcgtcggcctccgnggtctggaggagtggaggtctggtacttacgtacncgcgaggacgctaatacgtccgaaccggaacccctaagggtacggggttggttcgggacggggtaccgggtaacgttaaacgggtcggtacccggttccgtcgggtaccacgacccggaacggtcctacccggtcccccgttcggtaccctaccgttccgttacccgtttcccccggtcccttacccctaccgtaaccgttaaccgttaccgttacggtccgtaccgggtacgggcccgggttaccggtccggggtaccaaccgggccgtacgtagtacgngtacg

SEQ ID NO: 154770 - DNA, 704 bp, Homo sapiens
  misc_feature: GYAE6OF02IVJW6.10.38.D05.1.454.CMB.1.raw
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccagcagtgtacttttgtgcttataactatgtctcctggtaccagccaccacccaggacaaacgcccctaaacttcctttgttttgaggtcaggtaacgccggccctgacggtcgtcctgacttcggttctctcgcctaccgtaagtctacggacaacgaccggtccctcccgtcggacccgtctccgtcgggtcctccgacggtctaggaggtagtggacggtctagtaactttacgtacgttcgacgacggccgtactaacgttacgttaccgaaccggtacccccgtaaagggtacgggggtttcgggtttacgggaccgggggtacgggtaaccgttaaacggggtccggttacccggttccggttacggggtaccgaaccgggtaaccccggaagggtcccgttacccggtcccccgttacgggttaccctacccgtttccggttcccggtttcccccgaccccgtttaccccg

SEQ ID NO: 154771 - DNA, 455 bp, Homo sapiens
  misc_feature: GYAE6OF02FVXES.10.38.D05.1.454.CMB.1.raw
  modified_base (442)..(455): a, c, t, g, unknown or other
  misc_feature (442)..(455): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctggtcactctgttcccaccctcctccactactatgctgagcgggctggcaaggcgcatagnnnnnnnnnnnnnn

SEQ ID NO: 154772 - DNA, 602 bp, Homo sapiens
  misc_feature: GYAE6OF02F1R9D.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatcctcctgcacgtggaaccagcagtgtacttttgtgactttaataacttatgtcctccgtcggtaccagccaccacccgaggacaaaccgccccaacttccttgttttgagtcagtacgcgcctacgaggacgtcctgtactcgttctctcgcctcagtcgtgcacaccggcctcctcgccgtctcgtcggcctccgacgtcgtaggacggtgtcggcgtactagtaacttactacgtcgcgagccgctattacgtccgaaccgacccgtaggtcgggttggttcgggcgggtacggacgtaacgggtcgtccgtcgtcgggaccacggccgtaagcccgtcccgtccccgtggtccctaccgttccgtaccgttccccacccgttccc

SEQ ID NO: 154773 - DNA, 632 bp, Homo sapiens
  misc_feature: GYAE6OF02JBHP5.10.38.D05.1.454.CMB.1.raw
  modified_base (346)..(346): a, c, t, g, unknown or other
  misc_feature (346)..(346): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatgacctggccccgcaggctccgagggagggctggagtggtctgagttatagaacagtagnggcactacattattattctgtacctccggtaggtaaccgggtccgtttaccaccctccgtaccgaagtacgacctaccgttaccaaacgtaactactacttgttacttcttaccactatgacctaactaatccgtagaacgtcgtacgtaaccgactaacccggtacccaaccgttaatttacgttcgtccgggtacccgaaccgtaaaccgtagtaaccggtaaccttaaccggttacttaacccttaaacggtttccgggtaccgggggaccctaaccgggggg

SEQ ID NO: 154774 - DNA, 677 bp, Homo sapiens
  misc_feature: GYAE6OF02JD34J.10.38.D05.1.454.CMB.1.raw
  modified_base (227)..(227): a, c, t, g, unknown or other
  misc_feature (227)..(227): n is a, c, g, or t
tcagcatagtagtgcacgaccggtgctcgatttagtatctgataggttgggtttgggggggtctcaggaggcagcgctctcaggacgtcaccaccatggcctgggctctgctcctcctcaccctcctcactcagggcacagggtcctgggcccagtctgccctgactcagcctcctcgcgtccgggtctccgtggacagtcagtcacatctcctgcactggaaaccngccagtcgtactttgtgcttaataactatgtctcctggtaccacgcaccaccaggacaaacgcccccaaaacttccgtttgtttttcggacggtactacggtaacggtccggccttacgaggacgttcccgtgaacgttcgttctcgtacgtcctccgtaacgtccgttaggaccaacgtaccggtcctaccccgtggtacccgttctccgtcggaccttcccgaggtccgtggaacggtcgttacggaagtcgtacggtaacttaccgtacgtacgtcgaacgtcgtctaacttagtaccgacgtaccccaagtcgggttagtttcggcgggtacggacttaacgggtcgacccgttacggtcgggtacgaccggaaccgtagggtcctccggtaccccgttcgggtacctacggttcccgttaaccggttccccgtacccgttacccg

SEQ ID NO: 154775 - DNA, 766 bp, Homo sapiens
  misc_feature: GYAE6OF02HLOHP.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttcaaaaggtgtccactgtgaggttcaacgtggtggagacgtgggaggaggctggatccgagccgtcgggggtccctgacgactctcctgtgcacgcctcgtgggttcagctatacaacgtaacgactacatcgaccgtcgggccccgccgacggtccgtaccggaaggggaacggggtcgtaggggacggttcgggtaccgtacgtaagtttacgtaacggtaaaacgagtacgtacggacctaacgttaactaatttaacgtttacttacgtacgtaccgttaccgggtaacgggtaaccggggttcccggtttaccctaccccgttacccgttacccggaaagggttaacccgaacccttaacccgtttaaaccccgaaaaacttaacccgttattttaccgttttaacgttaaccgttttacccttaacccgaaacctacgttacccgaacccttaacgtaaacgttccgtaaggacggtaaccgtaccgaccgaacccgtaccgacccttaacgttatttacgttcgacgccgtacgacttagtacgaacccgttacgccgttacttaggtttccggaccggggactacgggg

SEQ ID NO: 154776 - DNA, 531 bp, Homo sapiens
  misc_feature: GYAE6OF02GHI8X.10.38.D05.1.454.CMB.1.raw
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (482)..(482): a, c, t, g, unknown or other
  misc_feature (482)..(482): n is a, c, g, or t
  modified_base (525)..(525): a, c, t, g, unknown or other
  misc_feature (525)..(525): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttataactatgtctcctggtaccagcaccacccaggcaaacgcccccaaactccttgttttgaggtcagtaagccggccctcaggacgtccctgactcggttctctcgccctcaagtctggcaacgccggcctccctgaccgtctccgtgggctccgagctgaggatggagctgattactatgcagcncatntcacgcccaagngggttgttggcggtcggactaaggtcgccgtcgnggtcacgccaaggctccgccccgtggtccacgtctcgtccccncctccc

SEQ ID NO: 154777 - DNA, 772 bp, Homo sapiens
  misc_feature: GYAE6OF02JB8P4.10.38.D05.1.454.CMB.1.raw
tcagcatagtagtgcacgaccggtgctcgatttagtatctgataggttgggggtttggggggggtctcaggaggcagcgctctcaggacgtcaccaccatggcctgggctctgctcctcctcacctcctcactcagggcacacgggtccgtcgggccacgtctcgccctcgactcacgcctccctccgcggtccgggtctccgtcggacagtccccccccccagtcaccactctcctcgcacgtcggaaccacgcgacgtcgtactttgttcgtcttactaactatgtctcctcggtaccacgcaccacccaggacaaacgccccaaaaccttccttcgtttttcgacggtacacgtaacgcggcctcgacggacgtcctgacttcggttctctcgtcctccgaacgtcgtcggacaacgacggacctccctcgtaccggtactcgtcgggtcctccgagggtccttgggaacggtacgtggaagggtccttaggacttttaaaccgtccgttaggacctaacgggtccacgttaacgtacggtttacccgaaccggggaaccccctaaagggttaacgggggtttcgggttttaccggggaccggggttcgggggtaaaccggtttaaagggggtccggtaacccggtttcgggttaccggggtacgtaaccgggtacccggaaacgggggtccctttacccgggtaccccccgtttcgggttacccgtaccgttttccggtacccgtttcccccgaaccccgtttccccg

SEQ ID NO: 154778 - DNA, 511 bp, Homo sapiens
  misc_feature: GYAE6OF02GE5FJ.10.38.D05.1.454.CMB.1.raw
  modified_base (432)..(432): a, c, t, g, unknown or other
  misc_feature (432)..(432): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctccgagggaaggggctggagtgggtctcagttattgaaacagatggcactacatattatctagactcgtgaacgggcgttcaccctctccagacgacacttccaacaacactcttgtatcttcacatncacaatctgagagtcgaacgacacggaccactattattgtgcgacgacatgactacgctcaattcgtagggcctacggg

SEQ ID NO: 154779 - DNA, 731 bp, Homo sapiens
  misc_feature: GYAE6OF02I4F14.10.38.D05.1.454.CMB.1.raw
  modified_base (209)..(209): a, c, t, g, unknown or other
  misc_feature (209)..(209): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcaggcacgagggtcctgggcccagtctcgccctgactcacgcctcctccgcgtccggtctcctggacagtcagtcacntctcctgcacgtacggaaccagcaggttctacgttttgtgtactttaataacttatgtctccgtagtaccacgaccaccgaacccgaggaaccaaaccgtaccccctaaactttccgttttgttttacgaaggttacaaggttacgcccggtaccctaggacggtacgtccgtagacgttccggttactcgtcgtccctactacggttccgtacggtaaccgaaccgccgtcccgtaccgtcgtaccgttcttcggtcggtcctcggtaggtccttaggacggcgttacgacggtcttaggtacttaaacctggtaccgacgtacggacgtcttaaagtccgttaccgaaccggtaaccccggttaaggttacggggtttacggttcgggggaccgggtaaccgggtaacggttaaacgggtccggtaccgttcgggacggttaccgaccggtaccgtaccggttcccttccccggtaagtcccgcgttcccgttcccgttaccccggtcccttcggtaccc

SEQ ID NO: 154780 - DNA, 333 bp, Homo sapiens
  misc_feature: GYAE6OF02FKS0R.10.38.D05.1.454.CMB.1.raw
  modified_base (327)..(333): a, c, t, g, unknown or other
  misc_feature (327)..(333): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattattactgtcagtcctatgacagtaggctgagtctttgggtgttcggcggagggaccaagctgaccgtccttcgtcagcccaaggctgccccctggtcactctgttccccaccctcctccactactatgctgagcgggctggcaaggcgcatagnnnnnnn

SEQ ID NO: 154781 - DNA, 718 bp, Homo sapiens
  misc_feature: GYAE6OF02HKAZC.10.38.D05.1.454.CMB.1.raw
  modified_base (410)..(410): a, c, t, g, unknown or other
  misc_feature (410)..(410): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgctttataactatgtctcctggtaccagcaccacccaggcaaacgccccaaactccttgttttgagtcagtaagcggcctcaggacgtccctgactcggttctctcgcctcaagtctggcaacacgtcctccctgaccgtctcgtcgggcctccgacggctaggaaggntggaggtctgtaacttacgtactcggacacgtccgactacttacttaccgaccgggtaccccctaaacggtagggggtttcgttttacggggacccggggtaccgggggtaaccttaaaacgggggttccggttaaccccgggttccccgggttagggggtttaccccgaaacggggtaccccccggtaaaacgggggtccccgttaacccccggggtccccccccgtttaccggggttaccccgttaaccccgttttcccgggtttcccccgggttttcccccccgaccccccgttttacccccccg

SEQ ID NO: 154782 - DNA, 875 bp, Homo sapiens
  misc_feature: GYAE6OF02H8082.10.38.D05.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagcatagtagtgcacgaccggtgctcgatttagtatctgatagttggggtttggggggtctcaggaggcagcgctctcaggacgtcaccaccatggcctgggctctgctcctcctcaccctcctcactcagggcacagggtcctgggcccagtctgccctgactcagccctccctccgcgtccggtctccgtggacngtcagtcaccntctcctgcactggaaccagcaagtgtacttttggttgtccttaataactatcgttctccgtggtaccagccaccaccacggacaaaccgaccccctaaacttcccttttagtttttcggacggttacaaggttaaacggccggtaccccgttacggttaacgggggttttcctaacggttccgttccttttaccgttccgtttccgtaccccgttaccccgttaaaacggtttcccgttacggggtaaccctaaaacccggtaacccggggtccccctttacccccgtaccggtaaaaccctaaaccgtttcccgtttaccgggtttaacgggggtcccccgtttacccggaacggggttacccggtttaacgggaaaccccgggtaaccgggtaacgggttaccgttaaacggttaaaaccgttttaacggttttaaacccgtggtacccgtaaccgttccgtaacttaagttacgtaagggttacgttaacggttacggggttccttacccgtttccgttttaacgggttaacggggtttttccgggacgggtaacgggtacccgagggtacccgttacggtacccggttaccgtaacgttccggaaccgacccgtaacggtccctaccggtccccgttacggtccctacgtcccgttacccg

SEQ ID NO: 154783 - DNA, 679 bp, Homo sapiens
  misc_feature: GYAE6OF02JF2N0.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgactttgtgcttataactatgtctcctggtaccagcaccaccaggacaaacgcccccaaattcctttagttttcgaggtcagtaacgccggcctcgaggactccctgtacttcggttctctcgtccctactaagtctaggactaaacgcggtccctacccgtgacccgttcgtcgtcgggtcctccgtaggctaggaaggtactgggacggtacgttacggtaactttacctacggttcgacgtaacggcctacttaaacttcgttacccgaaccgggtaccccctaaagggtaggggtttcgttacggggaccgggtacgggtaactaaagggtcgtaacccggtcggtagggtaccaacgggtacccgtaagggtcccgtacccggtcccccgttagggtcctaaccgttccgtttacccgttccccctaccccgttaccccg

SEQ ID NO: 154784 - DNA, 677 bp, Homo sapiens
  misc_feature: GYAE6OF02HGXKM.10.38.D05.1.454.CMB.1.raw
  modified_base (369)..(369): a, c, t, g, unknown or other
  misc_feature (369)..(369): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacttttgtgcttaataactatgtctcctcggtaccagcaccacccgaggaccaaaccgaccccctaaacttcccgtttgttttacggagtcagtaacgccggccctgaggcgtcctgtactcggttctcgtcncctcaacgtctagacaacgaccggccctccgtcgtacccgtctacgtcggctccgacggtcgtacggagtgtcggaggtctagtacttacgtactcgacagccgatactacttacgacggaccccgtaaggtacggggttcgggtttacgggccgggtaccgggtacggttaaacgggtccggtaacccggttcggtacggggtaccgaaccggtacccgtaaacgggtcccgttaccccggtcccccggtttaccgggtaccgttacccgttcccggttacccgttccccccgtaacccttcccccg

SEQ ID NO: 154785 - DNA, 561 bp, Homo sapiens
  misc_feature: GYAE6OF02IBJDT.10.38.D05.1.454.CMB.1.raw
  modified_base (465)..(465): a, c, t, g, unknown or other
  misc_feature (465)..(465): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaaggtgtccactgtgaggttcaactggtggagactggaggaggctggatccagccgtggggggtccctgagactctcctgtgcagcctctgggttcagcatcagtaacgactacatgacctgggccccgccaggctaccgagggaggggctggagtgggtctcagttatagaaacagatggcactacattatatctgactcgtgacggtccgttcaccctctccagacgacctacttccaaacaacatctgtatctcacatcgacaacatcgtagagagtaccgacgaaccncggaccctaaccttattacgttggtcgaccggcgaacctagtacgtacctacggactacgtaacgtttccggtcggggtacccgagggtaacccgg

SEQ ID NO: 154786 - DNA, 681 bp, Homo sapiens
  misc_feature: GYAE6OF02FYOC8.10.38.D05.1.454.CMB.1.raw
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacctatctcctgcactggaaccagcagtgtactttgtntacttanactntgtctctgtaccngcaccaccagacaacgccccaactcttgtttagagtcagtacgcgcctcgagtactcctgtacgtcgttctcgtcgtcctactaacgtcctcggaccaaccgaccgtccctcccgtccgtacccgttcgtccgtcgggcctccgacggtcgtggacggtagtacggacggtactcgtaattaccgtagttcgacgtacgtccgcttaatacgttaccgaccggtaccccgtaacggttacggggttcggtttacgggaccggggtaccggtaaacggttacgggtaccggtacccggttccggtacgggtacccgaacgggtaccccgtaacgggtccccttacccggtcccccggttcggtacccggtacccgtttcccggttccccggttcccccgtcccccgttaccccg

SEQ ID NO: 154787 - DNA, 232 bp, Homo sapiens
  misc_feature: GYAE6OF02FYWZP.10.38.D05.1.454.CMB.1.raw
  modified_base (223)..(232): a, c, t, g, unknown or other
  misc_feature (223)..(232): n is a, c, g, or t
tcagcatagtagtgcacgaccggtgctcgatttagtatctgatagttgggtttgggtgccgaagttgctggaggtcaccgtctccccagcctccaccaagggcccatcggtcttccccctggcgccctgctccaggagcacctcagagagcacagcggccctgggctgcctggtcaaggctacttcccactactatgctgagcgggctggcaaggcgcatagnnnnnnnnnn

SEQ ID NO: 154788 - DNA, 612 bp, Homo sapiens
  misc_feature: GYAE6OF02H76E9.10.38.D05.1.454.CMB.1.raw
  modified_base (429)..(429): a, c, t, g, unknown or other
  misc_feature (429)..(429): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactcggaaccagcagtgacttttgtgcttataactatgtctcctgtaccagcaccaccaggcaaacgccccaaatccttgtttttgagtcagtacgcggcctcaggactccctgactcggttctctcgcctcaagtctggacacacggccctccctgaccgtctcgtcgggcctccgaggctggaggagtgaggctgtattactactgacngcgactatacttacgaccggtacccaacgtacggggttcggtttcgggccgggtacggggtaacgtaacgggtcgacccggttccggtcgggtaccgacggtaccccgaaggtcccgttaccgccccccggttcggtccctaccgtttcccgttaccggtttccccccgtcccgttacccccg

SEQ ID NO: 154789 - DNA, 802 bp, Homo sapiens
  misc_feature: GYAE6OF02HLZ9K.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatctctgcactggaaccagcagtgtactttgttgcttataactatgtctcctggtaccagtccacccacccaggacaaaccgccccctaaaacttcctttggtttttagacggttacacggtaacggccggcccctacgacgggtacgtcccgtgacgttcggttcctcgtcgtcctaccgtaagtccgtcggaccaaaccggtaccggtcccttcccgtacgtacccgttccgttaccggtcggggtccctcccggaacgggtccgttaggggtaagggtaacgttcgggaacgggtccgttaaggttaacgttttaaacccgtacggttacggaccgtacggccgtacctactttaccggttccggaaccggtaaccccctaaacgggttagggggtttacgggttttacggggcccgggggttaaccggggttaaaccggttaaagggggttcccgttacccgggttacccggttcgggggttacccgaaccgggaccccggtaacggggtccccggttacccgggtaccccccgtttccgggtacctacccgttccggtttccccggtttccccgtcccccttaccccg

SEQ ID NO: 154790 - DNA, 545 bp, Homo sapiens
  misc_feature: GYAE6OF02HTW69.10.38.D05.1.454.CMB.1.raw
  modified_base (350)..(350): a, c, t, g, unknown or other
  misc_feature (350)..(350): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtcctgagactctcctgtgcagcctctgggttcagcatcagtaacgactacatgacctgggcccgccaggcctccgagggaacgggctggaggtgggtctcgtagttattgaaacngatggacactacatattatctgactccgtagacgggtccgttcaccctcaccgagacgacctacttaccaacaaccgtatcttagtactcttacacgtattacgcaactactctacgagacgttcgaacgtacaccggtccactattagtgacgcgnacntcgactacgctacgaattcggacgggccaggaccg

SEQ ID NO: 154791 - DNA, 678 bp, Homo sapiens
  misc_feature: GYAE6OF02JC5UE.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgataggttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgactttgtgcttataactatgtctcctggtaccagcaccaccaggcaaacgccccaaactccttgttttgaggttcaggtaagcggccctcaggtacgtccctagacttcggttctctcgccctacgaagtctggaccaacgaccggccttcccgtgtacccgtctccgtcgggccttccgacggtctggagggactggacggtcgtagtaactttacgtacgttcgaccgtagccgacgtaattacttaccgaaccggtcccctaaaacggtgggggttcggttttacgggggaccgggtacggggtaaccgttaaagggtccggtaacccggttcggtcggggtaccgtaacggaccccgtaacgggtcccgttcccggccccccggtttcggtccctaacccgttccgttacccggtttaccccctacccccgtttccccg

SEQ ID NO: 154792 - DNA, 643 bp, Homo sapiens
  misc_feature: GYAE6OF02HI2LZ.10.38.D05.1.454.CMB.1.raw
  modified_base (225)..(225): a, c, t, g, unknown or other
  misc_feature (225)..(225): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (519)..(519): a, c, t, g, unknown or other
  misc_feature (519)..(519): n is a, c, g, or t
  modified_base (571)..(571): a, c, t, g, unknown or other
  misc_feature (571)..(571): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctctcactcagggcacagggtcctgggcccagtctgccctgactcagcctccctcgcgtccggtctcctggacagtcagtcacatctcctgcactggaaccngcagtgtactttgtgcttataactatgtctctggtaccagccaccaccaggaccaaacgcccccaaattccgttgttttacgacgttcaaggtaagccggtaccctagacggtacgttccctaggtacgttccggttctcgtcgtaccttaccgaagttccgtcggacaaccgtaccggtccctacccgtggtacccgttctcgtcggcctaccgtacggtctacggtacggacgttcggacggtactagtacttacgtaaccggttnccagccgnatactcgacgacccaagngggttgttggcgcggtagtaggtcgaccgtcgtggtccacgccgaaggtccnccgttaacccccggttcggttacccgtaccgttcccggttacccggttacccccgtcccgtttaacccccgg

SEQ ID NO: 154793 - DNA, 597 bp, Homo sapiens
  misc_feature: GYAE6OF02HB9WS.10.38.D05.1.454.CMB.1.raw
  modified_base (483)..(483): a, c, t, g, unknown or other
  misc_feature (483)..(483): n is a, c, g, or t
tcagcatagtagtgcacgaccggtgctcgatttagtatctgatagttgggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataaccttgtctcctggtatcaacaacgcccagacaaacgccccacactcttgatttatgaacgtcagtaagccgcctcgtaggtttctacgtcgcttctcgtcgcctccgaagtcgtggtacaaccgtaccggccctcccgtagaacctaattccctcgtcgggtccttccgacggtctcggaacgacgaggctagaattatactgcagctacattatgtagtatcggtcgccctttnttacgttaacgggttttcggacggggtagggacccgtggaccgttacggtaacccggttacctaggttaccgaccggtacccgtaaccgggtcctccccggtccccgttacccg

SEQ ID NO: 154794 - DNA, 703 bp, Homo sapiens
  misc_feature: GYAE6OF02G83MN.10.38.D05.1.454.CMB.1.raw
  modified_base (369)..(369): a, c, t, g, unknown or other
  misc_feature (369)..(369): n is a, c, g, or t
  modified_base (408)..(408): a, c, t, g, unknown or other
  misc_feature (408)..(408): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttaataactatgtctcctggtaccagcaccacccaggcaaacgccccaaacttccttgttttgaggtcagtaagccggccctgaggacgtccctgatccggttctctcgcctcaagtctgcaacncggcctcctgacctctcgtcggctccgagtctaggaggntggagtctggtacttactacgttcgacgtacgcgtacctaattacgttccgaaccgggtaccccctaaagggtacgggggtttcggtttacggggaccgggttaccggggtaaaccgtttaaaggggtcccgggtaacccggtttcccggttacgggggtacccgtaaacccgggtacccccggtaaacgggggtccccgttacccgggtacccccccccggtttaggggttaccccgtaacccggtttccccggtttacccggtttacccccccgaacccccttttccccccgg

SEQ ID NO: 154795 - DNA, 657 bp, Homo sapiens
  misc_feature: GYAE6OF02HJUOK.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcacgcctctgggttcagcatcagtaacgactacatcgaccgtcgggcccctccgacggtccgtccggaagggggaacggggcgtaggggacggttggggtctcgtaaggtttattaggaaaacaggagtgggactactaactaatttatttactttcgtacgaaccgttccggtagggtaacggggtcccgtttacccacccttcgtaccaggacctacctacccttacccaaacaactacttcgttagtaacttcttacactacgtagtacaacctatcgtagacgtacgtcgaaccgacgtaccggccctaacttagtttacttggtacgcgtacgtaactacgtcgtaaccgtacgtccgttaactacgttaccgggacgggtaccggagggtacccgg

SEQ ID NO: 154796 - DNA, 683 bp, Homo sapiens
  misc_feature: GYAE6OF02HT527.10.38.D05.1.454.CMB.1.raw
tcagcatagtagtgcacgaccggtgctcgatttagtatctgatagttggggtttggggggggtctcaggaggcagcgctctcaggacgtcaccaccatggcctggctctgctcctcctcaccctctcactcagggcacagggtcctgggcccagtctgccctgactcagccctccctccgcgtccggtctcctggacagtcagtcaccatctcctgacactaggaccagcagtggacgttggtgttaataacttatgtctcctaggtaaccaacaacaccaggacaaacgcccccaaactcatattattttacgattacgtctaagttaactccggtaccctagtaggggtttactaagtcgtcttctctacgtcctactaacgtctcgaacctaacgaccgtcctacccgtactaaccgacttacgcgtacggcctacccggacggtaccgttcgaacgggtacgaccggtacttcgtaattaacgttactccggatacgaccttacgaattaaccgactaaaccgacgtaccggcttacgtaccttcgtagttacgtcccgggtacgggaacgtacgtacggtacgaacggtttaacccggtaccctaacgggttaccgaacgtaaccccggttacgaccccggttaccccgtacccccggttgtaaccccgtttacccgg

SEQ ID NO: 154797 - DNA, 737 bp, Homo sapiens
  misc_feature: GYAE6OF02HQ1G4.10.38.D05.1.454.CMB.1.raw
  modified_base (241)..(241): a, c, t, g, unknown or other
  misc_feature (241)..(241): n is a, c, g, or t
  modified_base (331)..(331): a, c, t, g, unknown or other
  misc_feature (331)..(331): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaccagcagtgtactttgtncttaataactatgtctctggtacagccaccaccaggaccaaacgcccccaaaattcctttgttttgacggtacaagtaacgccggccctnacggacgtccctagaacttcggttctcgtcgtccctacgtaaagtccgtacggacaaaccgaccgggtccccttacccgtacggtaacccgttccttacggtccggggaccttacccggaagggtccttagggaaggtaacgttgggaacggtcctaggtaactttaacgtaacgttcggaacacggccgtaactaacgtttaacttaccgaaccgggtacccccaaagggttaggggttcggtttagggacccgggtacggggtaaacctaaacggggttcgtaacccgggttaccgtacggggtaccaaccgggtaaccccgtaaagggtccctcccggtaccccccggttaggttaacccacccggttttcctacccggttacccccctaaccccttaccccg

SEQ ID NO: 154798 - DNA, 742 bp, Homo sapiens
  misc_feature: GYAE6OF02JZ8KO.10.38.D05.1.454.CMB.1.raw
  modified_base (229)..(229): a, c, t, g, unknown or other
  misc_feature (229)..(229): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgtacttttgtgactttataactatgtctctggtaccagcaccaccagcaacgccccaaactccttgttttgagtcagtaacgcggcctcgaggacgtcctgagttcgtctctcgcctcagtcngcacacgcctcncgtaccgtctcgtcggcctccgaggtctaggacggtacgtggacggtcgttacgtaactttaccgtacgttcgacgtacgtccgactagttaccgttaccgaacccgggtacccctaaagggttacgggggtttccggtttacggggtacccgggtaaccgggggtaaaccggtttaaacggggtacccgttaaccccgggtttcccgggttaacggggttaccccggtaaacccgggtacccccgggtaaacggggttcccccggttacccgggttaccccccccgggtttacggggttacccccgttaacccggttttcccccggtttaccccggttttaccccccccgtaccccccgtttaaccccccgg

SEQ ID NO: 154799 - DNA, 696 bp, Homo sapiens
  misc_feature: GYAE6OF02H9G3U.10.38.D05.1.454.CMB.1.raw
tcagcatagtagtgcacgaccggtgctcgatttagtatctgatagttggggtttgggggggtctcaggaggcagcgctctcaggacgtcaccaccatggcctgggctcagctcctcctcaccctctcactcagggcacagggtcctgggcccagtctgccctgactcagccctccctccgcgtccgggtctcctggacagtcagtcaccatctcctgcactggaaccagcagtgtacttttgtgacttaataacttatgtctctgtaccagccaccaccagacaaacgaccccctaattcctttgttttgagtcagtaacgccggcctcgaaggcgtccctgacgttcggttctctacgccctacctaagtcgtggactaacgaccggtccctcccgtacgtacccggttctcgtcgggtcccttaccggacggtccgttacgggaaggtacgtacgggtacggtccgttacggtaaattttacccgtaacgttcggtaccaacggcccgtactaagtactttaccgaaccgggtacccctaagggtacggggttcggtttacgggccgggtaacgggtaacgtaacgggtccgacccgttccggttacgggtaccacggtacccgtaaggtcccgtacccgtcccccgtcggttacctaccgttccgttcccggttccccccgtacccttccccg

SEQ ID NO: 154800 - DNA, 500 bp, Homo sapiens
  misc_feature: GYAE6OF02FGUUB.10.38.D05.1.454.CMB.1.raw
  modified_base (338)..(338): a, c, t, g, unknown or other
  misc_feature (338)..(338): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (481)..(500): a, c, t, g, unknown or other
  misc_feature (481)..(500): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcacccacccaggcaaacgcccccaaactccttgtttttgaggtcagtaagcggccctcaggagtccctgaccgattctctggcctccaagtctggcacctcacgccctcctggccatccagttgggcctccggtccgaggactggacgctgtattattactgtgtagctatgggatgacagcctagngtgtcttatcgtcttacgggactcgggaacctaaggtcacccgttctacgcacgcccaacgcccaacccntntcacttcgtcgtccccgccctcctccacttcatcnctcggngccggntcggacacggcgctagtngntgcnnnnnnnnnnnnnnnnnnnn

SEQ ID NO: 154801 - DNA, 671 bp, Homo sapiens
  misc_feature: GYAE6OF02HDM3I.10.38.D05.1.454.CMB.1.raw
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctcctccgcgtccggtctccgtggacacgtcagtccaccatcctcctgccacgtcggaaccngcaagtgtactttgtnacttataactatgtctcctggtaccacgccacccaccaggaccaaaccgacccccaaacttcctttgttttacgaggtacaggtaacgccgcctcgaggacgtcctgtacgttccggttctcgtcgccgtacaacgttcgtacggaccaacgaccggtccctcccgtcgtacccgttcgtccgtcggtccgtaccgacggtcgtaggacgtagcggaggtcgtagtacgttacgtacgttgacgacgtcgactattactaccgacccgaacccgtacggtagggtttcggttacggggccgggtacgggtaaacgttacgggtaccgacccggttggtacggtaccggaccgtacccggtaaggtccctacccggccccgttcgtccgtccgttccgttcccgttaccccgtcccttacccg

SEQ ID NO: 154802 - DNA, 743 bp, Homo sapiens
  misc_feature: GYAE6OF02HG9Z2.10.38.D05.1.454.CMB.1.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
tcagcatagtagtgcacgaccggtgctcgatttagtatctgatagttgggtttgggggggtcgtcaggaggcagcgctctcaggacgtcaccaccatggcctgggctctgctcctcctcaccctcctcactcagggcacagggtcctgggcccagtctgccctgactcagccctcctccgcgtccggtctccgtggacagtcagtcacatctcctgcactggaaccngcagtgacttttgtgctttanaactatgtctctgtaccagcaccaccagcaaacgccccaaactccttgtttgagtcagtaacgccggtcctcacggacgtcctagacgtcggttctctcgcctaccgtaagtcctcgggactaaccgaccgggtccccttacccgtacggtacccggttccttcggtcgggggtaccctttacccggacgggtccgtacgggtaacgggtacgtacgggtaacgggtcccgttaggtaactttaacgtaaccgttggtccgaacgtccgactaacgttaacttacccgaccgggtaacccctaaacgggtcggggttttacgttacgggggccggtaaaccggggtaaacgttaaaccgggttcggtaaccccgggttcccggttagggtacccgtacggaccccgtaaagggtccccgttaacccgggccccccgtttcgggtaccctacccggtttaccgtaccccgggtttccccctaacccccgttccccg

SEQ ID NO: 154803 - DNA, 636 bp, Homo sapiens
  misc_feature: GYAE6OF02FUP4B.10.38.D05.1.454.CMB.1.raw
  modified_base (358)..(358): a, c, t, g, unknown or other
  misc_feature (358)..(358): n is a, c, g, or t
  modified_base (475)..(475): a, c, t, g, unknown or other
  misc_feature (475)..(475): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactggaggaggctggatccagccgtggggggtccctgagactctcctgtgcagcctcgtgggttcagcatcagtaacgactacatcgaccgtcggccccgccgaggcctaccgaggggaaggggctgggagtgggtctcgagttatagaaacgngagtggctactactattattattctagtacctcgtaggacgggtccgttaccacccgtctaccagacgaacctaccgttaccaacgaaccattaccttgttacttctacactacgtnaccacaattcgtagtacgacgttaccgaacgtaccgtacccggaccctaaccgttatttacgttggtacggtccggtacgtaaccacgttccgaaacccgttacgtacccgttacgtaaccgtttccggggtaccggggtacccggaacggggtaccccgg

SEQ ID NO: 154804 - DNA, 718 bp, Homo sapiens
  misc_feature: GYAE6OF02JEZFY.10.38.D05.1.454.CMB.1.raw
  modified_base (239)..(239): a, c, t, g, unknown or other
  misc_feature (239)..(239): n is a, c, g, or t
  modified_base (512)..(512): a, c, t, g, unknown or other
  misc_feature (512)..(512): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtccgtgggcccagtctgccctgactcagccctccctccgccggtccgggtcctccgtggacacgtcacgtcaccatcctcctgcacgtcgaaccngacagtgtacttttgtcgtcttaataactattcgtcctccgtcggtacacgccaccaccgacggtacaaaccgacccctaacttcgtttgtttacgagttcaagtacgccggtaccctgaacgggtctccgtgtacgttccggttcacgtccgtaccctacgtaacgttccgtacggaacccaacggtccccggtcctacccgtcggtcccttgtaccggtcggacctaccggaggtcgtagggtactaggtcgaggtctagtacctttacgngtcacgtgccgtatagtaccgtaccgacgtaccctaagggttggttccgggtacggtaccgggaccgtttaaacggaacggttccccgggaacgtttcggtacggggaccccaaccgggttacccgaacggttccccggttacccgtaccccgttgttaaccccgtccgtttacccggccccgtttaccccgcccctttaacccgg

SEQ ID NO: 154805 - DNA, 640 bp, Homo sapiens
  misc_feature: GYAE6OF02HYEQV.10.38.D05.1.454.CMB.1.raw
  modified_base (326)..(326): a, c, t, g, unknown or other
  misc_feature (326)..(326): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaaggtgtccactgtgaggttcaactggtggagactgggaggaggcgtggatccgagccgtggggggtccctggacgactctctgtgcagctctggttcagcatcaagtaacgactacatgaccgtcgggcccgcaggcctcgaagggagggcnggagtgggtctcgagttatcggaaactagatggctaactacagtaatttactcgtgtaaccgttccggtaggtaaccggggtccgtttaacccacccgttactaccgaaacggaacgtaacctaccgttaaccaaaaccgtaaactaagttctttacggtaattccgtttacaactagcgacaaacaattcgagtagcggtaaccgaccgtaaccgaccggccaaaccgttattacgttgcgaccgtacgaacctggtaacgaaccgttaacgcctaacgtaaccgtttcgggccgggaccgaacggggtaccc

SEQ ID NO: 154806 - DNA, 640 bp, Homo sapiens
  misc_feature: GYAE6OF02JYZS8.10.38.D05.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (500)..(500): a, c, t, g, unknown or other
  misc_feature (500)..(500): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactgggaggnggctggatcccgagtcccgtggggggttacccctggacncctctcctgtcgccagcctcgtggtcagcatcaggtaccnctacnctcgcctcgggcccncaggctccggagggacggctagggngtgggtctcagtttatacgaaacngatacggctactacgtattactttacgtcctcgaacccgttccgggagtaaccggggggtcccctttacccaaccccttctacccgtacggaccaacctaccctaccaaaccctaacgcttcctagtcttccttcaacnctcggaccactaacgtctagacgacgttaccgaaccgaaccggaccacctacttattacgttcggtacgccggaaccgtaataccttacgaccgtaccggtctacctaacggtttcggaccggggacctacgggaccccg

SEQ ID NO: 154807 - DNA, 758 bp, Homo sapiens
  misc_feature: GYAE6OF02IAO4O.10.38.D05.1.454.CMB.1.raw
  modified_base (221)..(221): a, c, t, g, unknown or other
  misc_feature (221)..(221): n is a, c, g, or t
  modified_base (383)..(383): a, c, t, g, unknown or other
  misc_feature (383)..(383): n is a, c, g, or t
tcagcatagtagtgcacgaccggtgctcgatttagtatctgatagtttgggtttgggggggtctcaggaggcagcgctctcaggacgtcaccaccatggcctgggctctgctcctcctcaccctctcactcagggcacgacgggtcctcgggcccagtctcgccctgactcagccctcccgtccgcggtccggtctcctggacagtcagtcaccatctccngctacgtggaaccagcagtcgtacttttgtgacttaataactatcgtctccgtgtaccacgccacccaccacggaccaaaccgaccccctaattccttttgttttagacggtcaagtacgccgcctgagctcctagactcggttctctcgcctacaagttcncggtaccaacgtaccggtccctacccgtacgtacccggttccgtcggtccgggtacccttaccgggacgtccggttacggggaaacgtcggtacgggtacgtacggttaacgtttaccttaacgtcggtacggtaccgacgtccgtaacgttaactacccgttaccggaaacccggtaaccgtacggggttacgggtttccggggaccggggtaaccgggttaaccgggttaaaggttacccgggtaccggttacccggttccgggttaacggacccggtaccgggtaaacccgttccggtcccggttacccccggtcccggttacgacccgttccggtttacccggttccccgttcccccgtacccgttacccc

SEQ ID NO: 154808 - DNA, 842 bp, Homo sapiens
  misc_feature: GYAE6OF02I533X.10.38.D05.1.454.CMB.1.raw
  modified_base (216)..(217): a, c, t, g, unknown or other
  misc_feature (216)..(217): n is a, c, g, or t
  modified_base (260)..(260): a, c, t, g, unknown or other
  misc_feature (260)..(260): n is a, c, g, or t
tcagcatagtagtgcacgaccggtgctcgatttagtatctgatagttgggtttgggggggtctcaggaggcagcgctctcaggacgtcaccaccatggcctgggctctgcccctcctcaccctcctcactcagggcacagggtcctgggcccagtctgccctgactcacgcctccctccgcgtccgggtctcctggacagtcagtccacatcctcnncacgtcgaaccagctagtcgtcgtttgtcgtattaactaactntcgttcctcgtacgtaccagtccaacccaccgagaccaaaccgacccctaactttccgtttgtttacggacgtactaacgtacggcccgtaccgtacgacgtacgtcccgtagtacgttcgttctacgtccaccgttacgtaacgtcgcgaaacctaccggtacccgtcccgttaccgtaccgttacccgtcgttccggtaccgggtacccgtacgggtacggtcggttaacggacgggttaacggtccgggtaaacggttctaacgggttaaacctttaacgttaaccggcgtaaccgtaaccgggtaccgtagttaaccgttaaaccgttacccggaaacccgggacccccggttaaaagggttcggggttttaccggggttaacggaaccccgggggtaacccggggttaaccttaaacggggtacccgggttcccgttaccgggttacgggaacccgaacccggttaaccccgggtaacggtcccttaacccccggggtcccctttaacccgggcccgttacccggtttcccggttaccccggttttacccccccggccccgtttaaacccccttcgg

SEQ ID NO: 154809 - DNA, 694 bp, Homo sapiens
  misc_feature: GYAE6OF02GWD2J.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgacgactctccgtgtcgcacgcctcgtgggttcagcatcagtaacgactacatcgaccgtcgggcccgcgacggccgtccgaggggaacgggcgtggaggtgggtctcgtagttagtagaacgtagagtcggacaactacaattattacttctagtaccgttcggtaggtaacggggtcccgttaccctacccgtccgtaccgaagtaaccgtaacctacccttaacccaaactaaactagtttacccctttagttaacttcgttaccaactacgtcgtaacaaccgttaaacttcgtaaggtacgtaacggttaccggaaccgtaaccgacccggtaccctaaaccgtttactttacgttacggtacgtcccggaaccgtaacgtaacgtcggtaacccgtaccgtacctaacggttaaccgtccgggttacggggacccggaagggtacccgg

SEQ ID NO: 154810 - DNA, 659 bp, Homo sapiens
  misc_feature: GYAE6OF02GVZ25.10.38.D05.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (623)..(623): a, c, t, g, unknown or other
  misc_feature (623)..(623): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacngtcagtcaccatctcctgcactggaaccngcagtgactttgtgcttaataactatgtctctggtaccagccaccaccaggcaaacgcccctaaacttccttgttttgagtcagtaacgccgccctcgaggtacgtccctgtactcggttctcgtcgtccctaccgaagtctacggaccaaccgaccggtccctcccgtcggacccgttcgtccgtcgggcctccgaggcctagggacggtatggacggtctagtaactttactacgtgccgaacgccgtactactacgttccgaccggtaccccaaaggtcggggttcggttacgggccggggtaccgggtaacgttaaacgggtccgacccggttccgtaggggtaccacggacccgtaacgggcccgttacccggtcccccggttcggttaccnccgtttcccgttaccgttccccctacccgttccccg

SEQ ID NO: 154811 - DNA, 614 bp, Homo sapiens
  misc_feature: GYAE6OF02F4LC2.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctggtcagcatcagtaacgactacatgaccgtcgggcccgcacggcctccgaggggacgggctgggagtgggtctcgtagttatgaaacagatcggacacgtacattaattattctacgtactccggtaggacgggtcccggttacgaccctcgtacccaggactaccaccgttaccaaaccaactacttccttagttacttacctcaactctacgacaacaacttccgagtacgacgtccgacgaaccgaccgtccctaaacttattacgttgtacggccgaccgtaactataccgtaaccgtcgtaccttacgtaaacggtttcccgggacggggtacccaggggtaaccccg

SEQ ID NO: 154812 - DNA, 510 bp, Homo sapiens
  misc_feature: GYAE6OF02FIL23.10.38.D05.1.454.CMB.1.raw
  modified_base (161)..(161): a, c, t, g, unknown or other
  misc_feature (161)..(161): n is a, c, g, or t
  modified_base (249)..(249): a, c, t, g, unknown or other
  misc_feature (249)..(249): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (503)..(510): a, c, t, g, unknown or other
  misc_feature (503)..(510): n is a, c, g, or t
tcagcatagtagtgcacgaccggtgctcgatttagtatctgatagttgggtccctgagactctcctgtgcagcctctgggttcagcatcagtaacgactacatgacctgggcccgccaggctccagggaaggggctggagtgggtctcagttattgaaacngatggcactacatattattctgactccgtgaagggccggttcaccctctccagagacacttccaaacaacatcttgtatcttcacatncacaatctgagagtacgacgacacggccacctattattgtgcgcgacatgactacgctcaattctggggccagggcgcccgaggtccaccgtcctccccagccctccacgaacgggcccatccggtccttccccgnggccnccctgcctccgaggacnccacctccgagacgcacncgccggccngggctgtcctggcaaggcctaccttcccacttactactgcgtgacggcggctcggacaggcacagtcgnnnnnnnn

SEQ ID NO: 154813 - DNA, 792 bp, Homo sapiens
  misc_feature: GYAE6OF02GUZR0.10.38.D05.1.454.CMB.1.raw
  modified_base (216)..(216): a, c, t, g, unknown or other
  misc_feature (216)..(216): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctccngcactggaaccagcagtgtacttttgtgcttataactatgtctcctggtaccagcaccacccagccaaacgcccccaacttccttgtttcgagtcagtacgcgccctgaggactcctgacttcggttctcgtcgcctacagtctggacacgaccggccttccctcgaccgtctccgtcgggtcctccggacggtcgttagggaacgtagtaggtacggtacgttacggttaactttaccgtaacgttcgacccgtacgcccgtactaacgtttaccgttaccggaacccggtaccccccgtaaagggttacgggggttttaccgggtttacgggggtacccgggggtaaacccgggggtttaaccggttaaaaccgggggttccggtaaccccgggtttcccggggtttaaccgggggtacccgtaaacccggggtaacccccgggtaacccggggtaccccgttcccccgggtttaacccccccgggtttcgggttaccccccggtaaacccgtttttccccccgggttacccgggttttcccccccccccggtacccgttttaaccccccccgg

SEQ ID NO: 154814 - DNA, 797 bp, Homo sapiens
  misc_feature: GYAE6OF02IPZRZ.10.38.D05.1.454.CMB.1.raw
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaccagcagtgtactttgtgcttataactatgtctcctggtaccagcaccacccgaggaccaaaccgcccccaaacttcctttgtttttacgaggtacagtaacgccgcctcgacggacgtccctggtacttcggttctccgtcgcccttacgtaacgttcgtacggaccaaaccgtacccggtccctacccgtcgtaacccgttccgtaccgtcggggtacccttccgaacgggtccgtagggtacggtacgttaggaacgggtccgttaggttaactttaaccgttaaccgtcggtaccgaacggcctaccgtaacttaccgttaccggaacccgggtaacccccaacgggttaacgggggtttcggtttacgggggacccggggtacggggtaacggtttaaacggggtccgggttaacccgggttcgggtaccgggttaccggaacccgggtaccccggtaaacggggtccccggttacccccggttcccccgtttaccgggggtaacccctttcccggttaccccggtttaccccggttttacccccccgaaccccctttccccgg

SEQ ID NO: 154815 - DNA, 593 bp, Homo sapiens
  misc_feature: GYAE6OF02JH9ED.10.38.D05.1.454.CMB.1.raw
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctggttcagcatcagtaacgactacatgacctcgggcccgccacggctccgaggggaagggtctgggagtgggtctacgtagttattagaaaacngaagtggaccaatacataatttactctnactccgtgaacggtccgttacacctctaccagacgacaccgttaccaaacaactataccttgtaacttctttacacatcgaccaaactattcgtagagacgtacgacgaccaccggacctaacgttattagttcgtacgcgtaccgaatacgtacgtaccgtaaccggtctaaccgttaactttccgggaccggggacctaggggtaacccg

SEQ ID NO: 154816 - DNA, 705 bp, Homo sapiens
  misc_feature: GYAE6OF02JZHB0.10.38.D05.1.454.CMB.1.raw
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
tcagcatagtagtgcacgaccggtgctcgatttagtatctgatagttgggtttgggggggtctcgaggaggcagcgctctcaggacgtcaccaccatggcctgggctctgctcctcctcaccctcctcactcagggcacgacggtcctggcccagtctcgccctgactcagccctcccncgcgtccggtctccnggacagtcagtccaccatctccngcctactcggaaccaggcctaaggtcgactttttgtgacttaactaactatcgtctacccgtggttacccagaccaccaccgaacggaccaaaccgcccccaaaacctttccctttagttttaggacggtctaacggtaacgtccggacctcgacggtacgtcccgtgtacgtcgtacttcctcgtaccctacctaagtccgtagacccgtaacgaccggtcccgtaccctcgtacccgtcgttccgtacgggcctaccgacggtctaggacgtacgtggacggtcttagtactttaacgccgtaagtccgaagcgactatctaccgaaccgtacccgaaggtcgggttggttacggtaccgggtacggaacgttaagggtaccgtaccgggttcgttaccggggctaacccgggactaacggtccggtacccgtccccgttcgtacccgtaccgtttcccgtacccttaccccgacccctttacccg

SEQ ID NO: 154817 - DNA, 704 bp, Homo sapiens
  misc_feature: GYAE6OF02INCJO.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctctcactcagggcacgagggtcctgggcccagtctcgccctgactcacgcctccctccgcgtccggtctccgtgacacgtcagtaccacctatcctcctgacacgtacggaaccacgcgagtgtacttttgtagtacttaataactatgtctccgtacggtaccacgccaaccgaccgaacggtaccaaaccgaccccctaaacttccgtttaggtttttaggacggttaacaaggtaacgccggtaccctacgtacggtaccgtccgtagtacgttcggttctacgtccgacctacgtaacgtcgacggtacaaccgaccgtcctccgacgtaccgtcgtcgtcggcctccgagtcgtaggagtagtaggagtacgtagtacgttactacgtcgacgacgtacgtaactataacgttcgaaccggtacccgtaacggtagggttacggtcgggacgggtaacgggtaacgtaacggtccgtaccggttacgtacggtaccggaacggacccgtacgggcccttaccggtcccccggtgtacccgttaccctccgtttacccgtcccctcccgttacccg

SEQ ID NO: 154818 - DNA, 657 bp, Homo sapiens
  misc_feature: GYAE6OF02H50U4.10.38.D05.1.454.CMB.1.raw
  modified_base (199)..(199): a, c, t, g, unknown or other
  misc_feature (199)..(199): n is a, c, g, or t
  modified_base (248)..(248): a, c, t, g, unknown or other
  misc_feature (248)..(248): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactggaaccagcagtgtactttgtgcttanaactatgtctctggtaccagcaccaccaggcaacgccccaaactccttgttttgagtcagtaagccgcctcgagatcctgactcggttctctgcctacaagtctcggcaacgaccggtcctcccgtcgtaccgtcgttcgtacgggccttccggacggtcgtaggacgggtactcggaggtcctaggtaactttaccgtacgttcgactacggtcgctaattacgttaccgaccggtaccccctaaaggtcggggtttcgtttacggggccgggtaacgggtaacgttaaacgggtccgtacccgggttcgtacggggtaccaaccgggtaccccgtaagggtcctaccgggtaccccccgttcggttaccctaccgttccgttacccggttccccgtcccttaccccg

SEQ ID NO: 154819 - DNA, 825 bp, Homo sapiens
  misc_feature: GYAE6OF02IOPBY.10.38.D05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtatctgatagttgggggtttgggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcacatctcctgcactacggaaccagcagtgtacttttggtcgtacttaataacttatcgttcctccgttacggtaccacgccaaccccacccgaacggaccaaaccgaccccctaaaacttccgttttagtttttacggaggttaccaaggtaacggccggtaccctacgacggtccgtcctagtacgttccggtttccttcgtcgtcccgttacgtaagttccgtacggtaccaaccgtacccggtcccttacccgtcggtacccgttcgttccgtcgggtcccttaccggacggtaccgtaggaaggtacgtaggtacggtacgttagttaactttacgtacgtacgaccgtacggtaccgtactaacttacgttaaccggacccgggtaacccctaaacggggttacgggggtttcgggttttaccggggaccggggttaacccggggttaaacggttaaaaccgggggttccggtacccgggttacccgggtacgggtacccgaacccgggtaccccggtaaaccgggtccccgttacccgggtccccccggttccgggttacccttacccgtttacccggttaccccgtttccccccgtacccgttaccccgg

SEQ ID NO: 154820 - DNA, 700 bp, Homo sapiens
  misc_feature: GYAE6OF02JHXDB.10.38.D05.1.454.CMB.1.raw
  modified_base (293)..(293): a, c, t, g, unknown or other
  misc_feature (293)..(293): n is a, c, g, or t
tcagcatagtagtgcacgaccggtgctcgatttagtatctgatagttgggttttggggggagaggagcccagcactgggattccgaggtgtttccattcggtgatcagcactgaacacagaggacttcaccagtggagtttggctgagctagggtttccttgttgctatttcaaaaggtgtccactgtgaggttctaactggtggagactggaggaggctggatccgagccgtggggggtccctggacgactctccgtgtgcagcctcgtgggttcagcatcagtacgactanatgacctggcccgcaggctacgagggaagggctgggagtcgggtctcgagttatgaaactgagtggcaactacgtatacttattcgtacgtacgttccgtaggaacgggtcccggttaccacccttctaccaggacctaccgtaccttaccaaaacgaacctacgtttccgttagtaaccttccgtttaacaccgtacttcggaacctaacgaagtttcccgaaggtaccgtaggtaacccgaacgaacccgtacccgggtacccttaaaccgtatttttttaacggtccggttcggaacccggttacggtaaccgtaagtttacccggaaccgtttaaccccggccgttttaaacctaaacggttttcccggggcccgggggtaacccgtaacggggggtaccccg

SEQ ID NO: 154821 - DNA, 594 bp, Homo sapiens
  misc_feature: GYAE6OF02G9FAY.10.38.D05.1.454.CMB.1.raw
  modified_base (492)..(492): a, c, t, g, unknown or other
  misc_feature (492)..(492): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctcgggttttccttgttgctatttcaaaggtgtccactgtgaggttcaactggtggagactggaggaggctggatccagccgtggggggtccctgacgactctcctgtgcagcctctgggttcagcatcgagtaacgactacatcgaccgtcggggccccgccgaggcctaccggagggggaacggggcgtgggaggtgggtctcgtaggttattaggaaacagagtcggactactactattattattctagtaccgtccggtaggacggggtcccgttcacccctctacccgaagacgaacctaccttacccaaacaacgtattccttagtactcttacactancgacactaatctagagacgtcgaccgtacaccggccctacgttattacttgcgacgcgactgtcgacctacgcctactagttcgggacgggccgagggtccc

SEQ ID NO: 154822 - DNA, 612 bp, Homo sapiens
  misc_feature: GYAE6OF02H88HJ.10.38.D05.1.454.CMB.1.raw
  modified_base (265)..(265): a, c, t, g, unknown or other
  misc_feature (265)..(265): n is a, c, g, or t
  modified_base (337)..(337): a, c, t, g, unknown or other
  misc_feature (337)..(337): n is a, c, g, or t
  modified_base (458)..(458): a, c, t, g, unknown or other
  misc_feature (458)..(458): n is a, c, g, or t
tcagcatagtagtgcacgaccggtgctcgatttagtatctgatagtttgggggtttggggggggtctcaggaggcagcgctctcaggacgtcaccaccatggcctgggctctgctcctcctcaccctcctcactcagggcacagggtcctgggcccagtctgccctgactcagccctccctccgccgtccgggtctccgtggacagtcagtccaccatcctcctgcactggaaccagcagtgtacttttgtgcctttaataactntgtctcctggtaccagccaccacccagacaaacgccccctaaatcctttgttttgagtacagtagccgtccngaggctccctgtatcggttctctcgtccctacgagtctggacccaacgccggtcccctcctcggacccttctcggtccgggcctcgaggtcaggaggactggcgtcgtagtattacgtacngcacgctactataccttcgaccgtacccgagtagggttcgtgggaccggacgggtactacgggtccgtaccgttccggtggtaccgacgacccgtacggtccgtacccggtccctcggtacctccgttccgtccgttacccccgcccttacccg

SEQ ID NO: 154823 - DNA, 574 bp, Homo sapiens
  misc_feature: GYAE6OF02GKWBD.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcacgcctcgtgggttcagcatcaagtaacgactacatcgacctcgggcccgccgaggcctaccgaggggaagggctgggaggtgggtctcgagttatagaaacagagtggacactacatattattactcgactcgtaggaacgggtcccgtaccaccctctaccagacgacctacttaccaaacaactattacttagtacttacctcaactatcgacctaacaatcgtagacgtacgtaccgacgaaccgcgaccaaaccttagtagttcgcgccgacactatcgaactcgactcgaatttcggagggaccgaggaccg

SEQ ID NO: 154824 - DNA, 812 bp, Homo sapiens
  misc_feature: GYAE6OF02GXAHY.10.38.D05.1.454.CMB.1.raw
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtccaccatctcctgcacgtcggaaccngcagtgtacttttgtntcttaataactatgtctcctggtaccngccaccaccagacaaacgccccaactcttgtttgagtcagtacgccgcctgacgtcgtcctgtacgttccgttctccgtcgtccctaccgtaacgttccgtacgggaccaaccgtacccgggtcccttacccgtacggtaacccggttccgttaccggtcggggtacccttacccggacgggtccgttaggggaacggtacgtacgggaacggtcgttaaggttaacctttaaccggttaccgtaggaccgtaacggtaccgtacgttaacgttaacgttacccggaacccgggtaacccccttaaagggttacggggtttaccgggttttacgggggacccggggttaaccggggtaaaccgttaaaccggggttccggtaaccccgggtttcccggttacggggttaccccgaaccgggttaacccccggtaacggggtccccgtttaccccgggtaccccccggtttaccgggtacccttacccggttttacccccgtttaccccggtttaccccccccgtaccccgtttaccccccg

SEQ ID NO: 154825 - DNA, 1003 bp, Homo sapiens
  misc_feature: GYAE6OF02IIAYV.10.38.D05.1.454.CMB.1.raw
tcagcatagtagtgcacgaccggtgctcgatttagtatctgatagttgggtttggggctctgctcctctcacctcctcactcagggcacagggtcctggcccagtctgccctgactcagcctccctcgcgtccgggtctcctggacagtcagtcaccatctcctgcactggaaccagcagtgactttgtgcttataactatgtctccgtggtaccagtccacctacccgaggccaaacgcccccaaaacttccgttgttttacgacggttcagttaacgccggtacccttacgaggtacgttccccgtagtaacgtccgggtttactccgttacgccccgttaacccgaaaggtttccgtacgggtaccgtaaacccgtacccggggtccccttaccccgtaggttaacccccgtccgttaccggttacgggggtcccttaccggacggggtcccttaacgggtaacgggtacgttacgggaacggttaccgttacggtaaaccttttaacccgtaaccgttcgggaccgtaaccggtaccggtacttaacgtttaaccgtttaccggtaaacccgggtacccccgtaaaaccgggttaacggggtttccgggtttaccgggggtacccggggtaaccggggtaacccgtttaaacgggggtacccggttaacccgggtttaccccgggttaccggggttacccgtaaacccgggtaccccgggtaaacggggtcccgtttaccccgggaccccccggtttacgggttaacccccgttacccggttttacccgtacccccgggttttaaccccccgtaaccccgtttaccccggttaacccgtttaaacccgtttaccccggttaaaccgtttccccggggttaaccgtttaacccgggggtaacggttaaccccggggtttacccgtaaccgggggttaaccccgttaaacgggggtccccgttaaacccgggtaaacgttcccgggtaacgttaacccggg

SEQ ID NO: 154826 - DNA, 605 bp, Homo sapiens
  misc_feature: GYAE6OF02GJBD5.10.38.D05.1.454.CMB.1.raw
  modified_base (427)..(427): a, c, t, g, unknown or other
  misc_feature (427)..(427): n is a, c, g, or t
  modified_base (485)..(485): a, c, t, g, unknown or other
  misc_feature (485)..(485): n is a, c, g, or t
  modified_base (557)..(557): a, c, t, g, unknown or other
  misc_feature (557)..(557): n is a, c, g, or t
  modified_base (570)..(570): a, c, t, g, unknown or other
  misc_feature (570)..(570): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaggtgtccactgtgaggttcaactggtggagactggaggaggctggatccgagccgtgggggtccctgagactctcctgtgcacgcctcgtggtcagcatcaacgtaacgactacatcgaccgtcgggccccgccgaggcctaccggaggggaggggcgtagggaggtcggtctcgtagttagtacgaaacagagtgacaactactatatttactctacgtacgtccggtaggtacgggtcccgttccacccgtntaccgaaggtacgacctaccttacccaaactactacttcgttatacttcctacaactnacgaccaacgtatcgtagagtacgtacgaccgacacccgtacctaacttattacgttcgcgaccgcgtaacntacgaacccttancctacgttaacgttcggcggggacctaggggcccg

SEQ ID NO: 154827 - DNA, 567 bp, Homo sapiens
  misc_feature: GYAE6OF02HVJYF.10.38.D05.1.454.CMB.1.raw
  modified_base (397)..(397): a, c, t, g, unknown or other
  misc_feature (397)..(397): n is a, c, g, or t
  modified_base (485)..(485): a, c, t, g, unknown or other
  misc_feature (485)..(485): n is a, c, g, or t
  modified_base (564)..(564): a, c, t, g, unknown or other
  misc_feature (564)..(564): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttaataactatgtctcctggtaccagcaccacccaggccaaacgcccccaaactccttgttttgaggtcagtaagcggccctcaggacgtccctgatcggttctctgccctccaagtctggacaacgaccggccctcccgtcgacccgttctcgtcgggcctccgaggctgaggtatgaggctgacttactactgcagcncatactcgacgacccaacgagggtgttggcggcgggtacgtaggtcgtaccgtcgtcgggtcacgcccgaaggctcgccccgtcgtcnctctccgttcccaccctcctccactacttactcgcgtcggcggcgggtcgtcggaccgaacgggccgacgtacgtcggntcg

SEQ ID NO: 154828 - DNA, 679 bp, Homo sapiens
  misc_feature: GYAE6OF02I3X9A.10.38.D05.1.454.CMB.1.raw
  modified_base (447)..(447): a, c, t, g, unknown or other
  misc_feature (447)..(447): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacttttgtgacttataactatcgtctcctggtaccagccaccaccaggcaaacgccccaaacttcctttgttttgacggtacaggtaacgcggccctcgacggacgtccctgtactcggttctcgtcgcctacaagtctaggacaacgacggtccctccgtacgtacccgttactcgtcggcctccgaggctaggaggtagtaggacggntacgtaattacgttacgtcgacgacgcgacgtaattactacgaaccgggtaccccaaacggtaggggtttacggtttcggggccgggtacgggtaacggtaacgggttaccgtacccggttccggtacggggtctaaccggtaccccggaacgggtcccgtacccgggtcccccgttacgggttacccgtacccgttcccggttacccgtttcccccggtccccttaccccg

SEQ ID NO: 154829 - DNA, 694 bp, Homo sapiens
  misc_feature: GYAE6OF02GOW4X.10.38.D05.1.454.CMB.1.raw
  modified_base (309)..(309): a, c, t, g, unknown or other
  misc_feature (309)..(309): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtcgcacgcctcgtgggttcagcattcaagtaacgactacatcgaccgtcgggccccnccgaggcctcccggaaggggaacggggcctagggacgtcggggtcctcgtaaggtttagtacgaaaacgtaggatcggacaactactaagtttatttaattccgtagtaccgttccgtaacgggaacggggtcccctttaccacccccgtcgtacccgaaggtacggtaaccctacctttaacccgaaaacctaacgtactttaccttcggttaaaccttccttaaccgtaacacttacgacctaaacctaacttcgacgtacgtaacggtaccgaaccgaaccgacccgaccctaccttaatttacgtgtaccggtaccgcggaactcgtacgaaccttaccgtactacctaacgttacggtccgggggacctaggggtacccg

SEQ ID NO: 154830 - DNA, 597 bp, Homo sapiens
  misc_feature: GYAE6OF02GW67H.10.38.D05.1.454.CMB.1.raw
  modified_base (274)..(274): a, c, t, g, unknown or other
  misc_feature (274)..(274): n is a, c, g, or t
  modified_base (402)..(402): a, c, t, g, unknown or other
  misc_feature (402)..(402): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctcgcgtccgggtctcctggacagtcagtcaccatctcctgcactggaaccagcagtgactttgttgcttataactatgtctcctggtaccagcaccacccaggacaaacgccccaaactccttgttttgagtcagtaagcgcctnagacgtcctgatcggttctactgccctaccgaagttcgtcggactaacgaccggcccttcccgtgtaccccgtctccgtcgggcctccgaggtcctggacgactggaggtctgactttactactgacngcgtactatacttcgaccggcccctaacggagggttcgttgggacgggtacgggtaactagggtcggacccgttcggtcgggtaccacgtccaggcctaccgccccttcggacctctcgttccgtcccacctcctccgacttactactcgtaccgtcgacggccggtcgtcggacgtacgggcctcagtcgatcg

SEQ ID NO: 154831 - DNA, 598 bp, Homo sapiens
  misc_feature: GYAE6OF02IK3C0.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcaagtaacgactacatcgaccgtcgggcccgccgaggcctccgaggggaaggggctgggaggtgggtctcgtaagttatagaaacagatggacaactacataattatctagactaccgtaggaacgggtcccgttccaccctcgtcccgaagacgacctaccttaccaaaacactattcttagtacttcttacacatcaccaataactctaagacggtacgtcggaaccgaaccgaccggaccctaaccttattacgtgtcgccggacgaaccagtacgacctaccgtctacgttaacgttccgggacggggaccagggacccg

SEQ ID NO: 154832 - DNA, 118 bp, Homo sapiens
  misc_feature: GYAE6OF02I2MHY.10.38.D05.1.454.CMB.1.raw
  modified_base (118)..(118): a, c, t, g, unknown or other
  misc_feature (118)..(118): n is a, c, g, or t
tcagcatagtagtgcacgaccggtgctcgatttagtatctgatagttgggtttgggggggtctcaggaggcagcgctctcaggacgtcaccaccatggcctgggctctgctcctcctn

SEQ ID NO: 154833 - DNA, 707 bp, Homo sapiens
  misc_feature: GYAE6OF02HV9G5.10.38.D05.1.454.CMB.1.raw
  modified_base (320)..(320): a, c, t, g, unknown or other
  misc_feature (320)..(320): n is a, c, g, or t
  modified_base (382)..(382): a, c, t, g, unknown or other
  misc_feature (382)..(382): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgtgggttttccttgttgctattacaaaaggtgtccactgtgaggttcaacgtggtggagactggaggaggctggatccgagccggtcggggggtacctgacgtactcctccgtggtgcgagtcctcgtgggttcagtcatcgaagtaacgactacatcgaccgtcgggacccnccgtaacggccgtacgaggggaagggcgtgggacggtgggtctacgtagttagttagaaacnggaagtcgggactaacgtacagtttaatttagttactgtaccgttccggaggaaacggggttcccgttacctacccgttctacccgaggtaacctaccgtacccttaacgaacctaaacgtcgttacctttagtaactttccgttactactacgtacactaaacctacttaccgaggtacgacgttaccggaacttaacccggtaccggtaaccctacgtttaacttacggttagtacggccggtaagtaaccgtacgtaaccgtaacctaccggtaccgttactaaccggtttcgggacccgggtacggtaaccgggtacccgg

SEQ ID NO: 154834 - DNA, 465 bp, Homo sapiens
  misc_feature: GYAE6OF02HXTJ2.10.38.D05.1.454.CMB.1.raw
  modified_base (326)..(326): a, c, t, g, unknown or other
  misc_feature (326)..(326): n is a, c, g, or t
  modified_base (365)..(365): a, c, t, g, unknown or other
  misc_feature (365)..(365): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (449)..(465): a, c, t, g, unknown or other
  misc_feature (449)..(465): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaaagtctggcaacacggcctccctgaccgtctctgggctccaggctgaggatgaggctgattactactgcagcgcatatcaggccccaacngggtgtttggcggcgggactaaggtgaccgtctgggtcngcccaaggctcgccccctggtcacgtctcgttcccaccctcctcccactactatgctgngcgggcngggacaaggcgacatagnnnnnnnnnnnnnnnnn

SEQ ID NO: 154835 - DNA, 799 bp, Homo sapiens
  misc_feature: GYAE6OF02JL5ZV.10.38.D05.1.454.CMB.1.raw
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatcctcctgccactggaacccngcagtgtactttgtcgcttataactatntcctctggtaccagccaccacccagacaaacgaccccctaaactcctttggttgtacgtcgagttaacgccgtcctagacggacgtacctgtacgttccgttctcgtcgtcctccgtaagtccgttacgaccaacgtaccggtcccctcccgtacgacccgttcctcgtacgggcctaccgcggtcgtacggacggtacgtggtacgacgttaccgtaaccgttaacgttaaccggtacgtaccgtaaccgccggtaccgttaaagtttacccgttaacccggacccgggttaacccccgtaaacgggttcggggggttttaccggttaaccgggggggttacccggggtaacccggggggtttaaaggtaacccggggtttacccgggtaacccccggtttcgggttacccggggtaccgtaaccgggtaccccggtaaacgggtccccgtaccccgggtacccccggttcggtttacccggtaccccgtttacccgtttaccccggttaccccccggtaccctttaaccccccgg

SEQ ID NO: 154836 - DNA, 569 bp, Homo sapiens
  misc_feature: GYAE6OF02IFGVR.10.38.D05.1.454.CMB.1.raw
  modified_base (262)..(262): a, c, t, g, unknown or other
  misc_feature (262)..(262): n is a, c, g, or t
  modified_base (405)..(405): a, c, t, g, unknown or other
  misc_feature (405)..(405): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctntgggttcagcatcagtaacgactacatgacctgggccccgccgaggctccgaggggaagggcgtggaggtgggtctcgtagttatagaaacagagtggacactacatattatctgactcggtaggaacggccgttccacctcnccagacgactaccttacaaacacatcttagtacttctcacatcgcaactatcgtagagacgtacgacgtacgaccgtacctaaccttagttactggtacgcgcgtaacatccggaacttacggcctacgtaacgttccggtacggggacccgaggggaccccgg

SEQ ID NO: 154837 - DNA, 537 bp, Homo sapiens
  misc_feature: GYAE6OF02HGE3G.10.38.D05.1.454.CMB.1.raw
  modified_base (484)..(484): a, c, t, g, unknown or other
  misc_feature (484)..(484): n is a, c, g, or t
  modified_base (513)..(537): a, c, t, g, unknown or other
  misc_feature (513)..(537): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaactccttgttttgaggtcagtaagcggccctcaggactccctgatcggttctctgcctccaagtctggcaacaccggccctccctgaccgtctctggggcctccgaggctggaggatggaggctgattacctacgtgcagccgactatattccgacggacccccaaacggtaggggttggtttcggggcgggcgggtaacgtaggtcgacccgtcgtgggtccacgcccgaaggcctccggcccctggtccaccgtccttcgtccccaccctcccgtacctactactactcgtctcggacggtccgggngtccgggactaacgggccgtacagtagcnnnnnnnnnnnnnnnnnnnnnnnnn

SEQ ID NO: 154838 - DNA, 654 bp, Homo sapiens
  misc_feature: GYAE6OF02HJ5WP.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgctttataactatgtctcctggtaccagccaccacccaggcaaacgccccaaactccttgttttgagtcagtaagccggtccctcgaggacgtccctgacttcggttctctcgtcctccaagttctcggacaacgaccggccctcccgtgacccgtctcgtcgggcctccgaggtctaggaggattggagcgtagtactttactacgtgacgtacgccgtctaattacgttcgaccgggtaccccaaggtacggggtttcggtttcggggacccgggtacggggtaaccgttaaggggtccgtacccggttccggttgggtaccgtacggtaccccggtaacgggtcccttcccggccccccgttcgggttaccctaccgtttccggtcccgtttcccccgccccgttaccc

SEQ ID NO: 154839 - DNA, 662 bp, Homo sapiens
  misc_feature: GYAE6OF02IASS8.10.38.D05.1.454.CMB.1.raw
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacgagggtcctgggcccagtctgccctgactcacgcctccctccgccgtccgggtctccgtggacagtcagtcaccatctcctgcactggaaccagcagtgtacttttgtgcttaattaactatcgtctcctcggtacagccaccaccacggacaacgaccccctaaatcctttgttttcgaggtacaaggtaacgccggcctacgaggtcgtccctagtagttccggttctcgtacgcccttacgaacgtctacggacaaccgaccggtccttccctacgacccgttctcgtcgggcctccgaggtcctaaggaggtatggacgtcttaggaactttagtacgtcgtacgagtccgactatacgttccgaaccggtaccctaaggtgggtttcggttacgggcgggtacgggtaactaacgggtcgtacccggtcgtacgggtccgacggaccggtaggtccccgttaccgtcccccggttcggtacctaccgtttcccgtcctttaccccccgcctttacccg

SEQ ID NO: 154840 - DNA, 553 bp, Homo sapiens
  misc_feature: GYAE6OF02GZU6X.10.38.D05.1.454.CMB.1.raw
  modified_base (522)..(522): a, c, t, g, unknown or other
  misc_feature (522)..(522): n is a, c, g, or t
  modified_base (524)..(527): a, c, t, g, unknown or other
  misc_feature (524)..(527): n is a, c, g, or t
  modified_base (530)..(532): a, c, t, g, unknown or other
  misc_feature (530)..(532): n is a, c, g, or t
  modified_base (534)..(553): a, c, t, g, unknown or other
  misc_feature (534)..(553): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgtttttgaggtcagtaagcggccctcaggagtccctgatcggttctctgcctccaagtcctggcaacacggccctccctgacccgtctcgtgggcctccagggctgaggatggaggctgtattactacgtgcaggcgctattattccgacggacccccaaaggtagggttcggtttcggggcgggcgggtacgtaagggtcgtacccgtccgtggggtccacggccctaaggctccgccccccgttgggacctaccttccgtccgtccccgtcccttccctcctacctactactcgtcgtgaccggcggggtactcgggacgaacgggcgacgtagtagcgngnnnngcnnngnnnnnnnnnnnnnnnnnnnn

SEQ ID NO: 154841 - DNA, 625 bp, Homo sapiens
  misc_feature: GYAE6OF02HHQRJ.10.38.D05.1.454.CMB.1.raw
  modified_base (229)..(229): a, c, t, g, unknown or other
  misc_feature (229)..(229): n is a, c, g, or t
  modified_base (382)..(382): a, c, t, g, unknown or other
  misc_feature (382)..(382): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgtacttttgtgacttataactatcgtctccgtgtaccagccaaccacccgaggacaaaccgacccctaaacttcctttgttttcgaggtactaggtacgccggcctcgaggtactccgtgtacttcggttctcgcgtcctactagtcnggacaacgccgcctccgtcgtctcgtcgtcggcctccgagctaggagngtgagntgtattactcgtgcagcgatagttaccgtccggacccgaagtacggggttgttacgggcgggtacgggtaacgtacggtccgtaccgttccggtcggtacacccggtaccggtaaccgtccgtcccggtacccccggttggtccctaccgtttcccgtacccggtttcccccgtccccttcccgtaccc

SEQ ID NO: 154842 - DNA, 611 bp, Homo sapiens
  misc_feature: GYAE6OF02F2MRW.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatcgaccgtcgggccccgccgaggtcctccggaggggaacggggctagggaggtgggtctcgtagttagtagaaacgagagtggactactacattatttattctagtaccgtccggtaggtaacggggtcccgttaccacccctctaccgagacgtacctaccttaccaaactaactacttcttagttacttcttacactatcgacaactaatctagagtacgtccgaacgacgaccggaccctaaccttattattcgcgtccgacgtactagtacgtaccgtacgtcctacgtaacgttcggtacggggaccgagggacccg

SEQ ID NO: 154843 - DNA, 706 bp, Homo sapiens
  misc_feature: GYAE6OF02FLMXI.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctctgcactggaaccagcagtgtactttgttgcttaataactatgtctcctggtaccagcacccaccaggacaaacgccccaactcctttgttttagaggtcaagtaacgccgtcctcgaggactcctgtattcggttctctcgtcctaccaagttctaggaccaaccgtaccgtccctcccgtacgtacccgtccgtccgtcgggtcctaccgtaggcctaggacggagtgtaacgggtctagtacttacgttacgtcgacctacggaccgtactaacgtttacgttaccgaaccggtacccccgtaacggtggggttacggttaccggggaccgggtaccgggtaaaccgttaacggggttcccgtacccgggttccggttcggggtaccgtaacccggtaccccgtaacgggcccgttaccccggtcccccggttccggttacccgtacccgtttccccgtcccgtttacccccccaccccgtttaccccg

SEQ ID NO: 154844 - DNA, 640 bp, Homo sapiens
  misc_feature: GYAE6OF02IDI99.10.38.D05.1.454.CMB.1.raw
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggctggactccaggccgtggggggtccctgagactcctcctgtgcacgccttcgtgggttcagctatcgaagtaacgaactacatcggacccgtggcccccgccgacggcctccggaaggggacggggcgtgggagtcgggtctcgtagttagttagaaacagacgtggacaactactatatttatctgacctcggtaggacggtccggtttccaccctctccaagacgtaccaaccttaccaaacaactacttacttagtaacttccttcaactatcgaccaactatcgtagacgtagtacccggaacgtaccaacccggtacctaaacctttagttacgttggcgtaccgaccggtaactacgtccgtaacctccgtacctacgttaaccgtttcccgggtacggggaccccgaggggtacccg

SEQ ID NO: 154845 - DNA, 632 bp, Homo sapiens
  misc_feature: GYAE6OF02FP2H4.10.38.D05.1.454.CMB.1.raw
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (277)..(277): a, c, t, g, unknown or other
  misc_feature (277)..(277): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcggtccgggtctccgtggacagtcagtccaccatctcctgcacgtggaaccngcagtgtactttgtncttataactatgtctcgtggtaccagcaccncccagacaacgccccaactccttgtttgagtcagtagcgccngaggntcctgtagtcgttctctcgcctcatctgcacgcgcctcctgccgtntcgnggtcctcgacggctggagngtcgaggcttagtacttactacgtcgactacgccgtacgtacttacgttccgaccggtaacccgtacggtacggggtttggttacggggccgggtaacgggtacgttaaggggtccgtaccgggttccggtcggggtaccgccgggaacccgtaccgggtcccgtaccccggtacccccgttacgggttcccgtaacccgtttcccggaccccgttttaccccccacccgtttaccccg

SEQ ID NO: 154846 - DNA, 752 bp, Homo sapiens
  misc_feature: GYAE6OF02I4V9K.10.38.D05.1.454.CMB.1.raw
  modified_base (224)..(224): a, c, t, g, unknown or other
  misc_feature (224)..(224): n is a, c, g, or t
  modified_base (487)..(487): a, c, t, g, unknown or other
  misc_feature (487)..(487): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcaggcacagggtcctgggcccagtctgcctgactcagcctccctcgcgtccggtctctggacagtcagtcaccatctcctgcacgtggaaaccngcagtgtaccttttgtgactttataactatgtctcctgtaccacgcaccaccagacaaacgacccctaaactccttagttttagacggtacacgtaacgccggacctcgaggtacgtccgtgacgttcgttctctcgtccctacgtacgtctacggacaacgtaccgtcctacctcgtaccgtcgtcgtcggaccgttccgacggtctacgggtacggtcgtaggtacgggtactacgtaacgttaactaccgttcgacgacnccggtaactacgttaacttccggaaccggtaccccctaaagggttacgggtttacgggttcggggacccggggttaacgggtaaccggttaaacggggtcccggtaacccgggttcccggttaacggggtacccgtaacccggggttaaccccgtaaccggggttaaccccgttccccgggttaccccccggtaacgggtttccccgtaacccgtttacccggtttaccccccgttaccccccggtaccccctttaaccccccgg

SEQ ID NO: 154847 - DNA, 328 bp, Homo sapiens
  misc_feature: GYAE6OF02F8E3T.10.38.D05.1.454.CMB.1.raw
  modified_base (202)..(202): a, c, t, g, unknown or other
  misc_feature (202)..(202): n is a, c, g, or t
  modified_base (319)..(328): a, c, t, g, unknown or other
  misc_feature (319)..(328): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccaanagggtgtttggcggcgggactaaggtgaccgtcctgggtcagcccaaggctgcccctggtcactctgttccccacctcctccactactatgctgagcgggctggcaaggcgcatagnnnnnnnnnn

SEQ ID NO: 154848 - DNA, 618 bp, Homo sapiens
  misc_feature: GYAE6OF02HG5W3.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgcaggctcgagggagggctgggagtggtctcgagttatagaaacagatggactaatacataattattctagacttccgtaggaacgggtccggtttaccaccctcgtacccaagacgacctacttaacccaaacactattccttagtacttcttacactagtcgaccaactaatcgtaggaacgtacgtccgaaccgtaaccgacccggtaccctaaacctttagttacgttagggtccgaccgaccggtaactagttaccggaccttaaccggacttaccgtaagttttcccgggcgggggaccctaaggggtccccg

SEQ ID NO: 154849 - DNA, 628 bp, Homo sapiens
  misc_feature: GYAE6OF02IZT7M.10.38.D05.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (391)..(391): a, c, t, g, unknown or other
  misc_feature (391)..(391): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcactagggtcctgggcccagtctcgccctgactcagcctccctcgcgtccgggtctcgtggacngtcagtcaccatccnctgcacgtggaaccngcagtntactttgtncttaatactatcgtctctgtccancaccaccagacaaccgacccaacttcttgttttgacgtacagacgcgacctgacgtacgtcctgtcgtcgtctctcgtcctcagtctgacacgcgtcctcctcgtcctctcgcggtctccgngtcgtagagtacgtggcgtactagtacttactagtacgcgacgcgtctaattcgtacgaccgaccgtaacggtggggttacggttcgggaccgggttaacgggtaaccggttaacgggcgttaccggttcgggtaacggtccggtaacggacccggttaacgggtcccttacccggttaccccgtcggttaccgttacccgttcccgttttcccggttaccccctcccgtttacccc

SEQ ID NO: 154850 - DNA, 606 bp, Homo sapiens
  misc_feature: GYAE6OF02JHJ4A.10.38.D05.1.454.CMB.1.raw
  modified_base (350)..(350): a, c, t, g, unknown or other
  misc_feature (350)..(350): n is a, c, g, or t
tcagcatagtagtgcacgaccggtgctcgatttagtatctgatagttgggtttgcggggagaggagcccagcactgggattccgaggtgtttccattcgatgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctcgtggttcagcatcgagtaacgactacatgaccgtcgggcccgccgacggctccgagggagggctggaggtggctcgtagttatgaaacngagtgcactactatagttatcgtagtactcggtagacgggtccgttccacccgtctccgagtacgtacctaacttacccgaaactaaccgtattaccgttgtaacttccttacgaactacgtcgacaactaacgtcttaggagtacgtacgaaccgaccgtacggtccctaactttattacgtcggtcggaccgtacgtaaccgtagtaccggaacccttacggcctttaacgaacgtttcggccggggtaaccgg

SEQ ID NO: 154851 - DNA, 535 bp, Homo sapiens
  misc_feature: GYAE6OF02GLM7P.10.38.D05.1.454.CMB.1.raw
  modified_base (467)..(467): a, c, t, g, unknown or other
  misc_feature (467)..(467): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
tcagcatagtagtgcacgaccggtgctcgatttagtatctgatagttgggtttgggggggagaggagcccagcactgggattccgaggtgtttccattcggtgatcatcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggcccgccaggctccgaggggaaggggctgggagtgggtctcgtagtttagtagaaacaggatggacactacattatattctgtactcgtgaagggtcccggttacaccctctaccagacgactaccttaccaacaacattcttgtacttcctcactatgcacaatctgagngtcgacgacacgccactatntgtgcgngacatcgaactacgctactaattcggtcgggccagggaccg

SEQ ID NO: 154852 - DNA, 717 bp, Homo sapiens
  misc_feature: GYAE6OF02JYKJY.10.38.D05.1.454.CMB.1.raw
  modified_base (255)..(255): a, c, t, g, unknown or other
  misc_feature (255)..(255): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactcggaaccagcagtgtactttgtgcttaataactntgtctctgtaccagcaccaccaggacaacgaccccaacttccttgtttgacgtcagtagccggcctcgacggcgtcctgtacgttccggtcttcgtcgtccctaccgtaagttcctagggaccaaccgtaccggtccctcccgtacgtacccgttccgtccgtacgggcccttcccgagggtacctagggacggtacgtaggacggtcgttaaggtaacttaccgtaccgttcggactacgggacctacgttattaccgttacccgaaccggtaaccccgtaagggttacggggtttcggttcgggggaccggtaaccggggttaaacggtaaccgggttcgtacccgtttcgggtacgggtaccgtaacccgggcccgtaaacccgggtccttcccccgggaccccgtttccggacccttacccggttcccgttacccggttccccccgtcccttaccccg

SEQ ID NO: 154853 - DNA, 596 bp, Homo sapiens
  misc_feature: GYAE6OF02F493V.10.38.D05.1.454.CMB.1.raw
  modified_base (296)..(296): a, c, t, g, unknown or other
  misc_feature (296)..(296): n is a, c, g, or t
  modified_base (419)..(419): a, c, t, g, unknown or other
  misc_feature (419)..(419): n is a, c, g, or t
  modified_base (469)..(469): a, c, t, g, unknown or other
  misc_feature (469)..(469): n is a, c, g, or t
tcagcatagtagtgcacgaccggtgctcgatttagtatctgatagttgggtttgggggagaggagccagcactgggattccgaggtgtttccattcggtgatcagcactgaacacagaggactcaccatggagttttggctgagctgggttttccttgttgctatttcaaaaggtgtcactgtgtaggttcaactggtgagactggaggaggctggatcagccgtgggggtaccctgagactctcctgtcgcagcctcgtggtcagcatcagtaacactacatgacctcgggcccnccgaggtctacccgaggggaacgggcgtggagtcgggtctcaaggttctagaaacgagtactgggacacgtaacagttaactttacgtctacgtactccggtagaacggtccgtacacccgtntaccgagacgactacttaccaaacaactagtactagtacttactcctaancgtacgaacctaacgtacttcgtaacgagtacgtaccgaacgggacaccggtacctaactacttaagtcgtacgcgaacgactagtacacgaccgttcacttaagttccgtacgggacctaggaccg

SEQ ID NO: 154854 - DNA, 848 bp, Homo sapiens
  misc_feature: GYAE6OF02I1Y9L.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctccaccctcctcactcagggcacagggtcctgggcccagtctcgccctgactcacgcctccctcgcgtccggtctctggacagtcagtccaccatcctcctgcctacgtacggaacctagctagtcgtacttttgtacgactttaataactacttcgttacctccgttacggtacccacgacccaacccctaacccgacggaaccgaaaaccccgtacccccctaaaaccgtttacccggttttacgttttacgtaacggttaccgtaaacggttaacggtcccggtacccttacggaaggtacccgttacccgtacgtacggtttccggttcttcctaccgtacccgttaccgtaacgtcgtaccggaacctaccggacccggtccttcccgtaccggtacccggtccgttagggtttcccgaagggttccctacgggacggtacgtagggaagtccgtagggactttaccggaactttacggacctaggtccgtacgtaccgtacttaccgaaggttaccccctaaggtacccgggttacgtttaaccgggggtccggaaaccgggtttaccggtaacggggtccggtaacccggttaccgggtacggggttacccgaccgtccccgggtaagggtaccctacccggaaccccgggttccggttaccggtacccccgttccggttacccgttaccccctaacccgttcccgtttaccccccgtaacccg

SEQ ID NO: 154855 - DNA, 610 bp, Homo sapiens
  misc_feature: GYAE6OF02HO5XM.10.38.D05.1.454.CMB.1.raw
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (404)..(404): a, c, t, g, unknown or other
  misc_feature (404)..(404): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagcctccctccgccgtccgggtctcctggacagtcagtcaccatctcctgcactaggaaccagcagtgtacttttgtgcttaataactatcgtctcctggtaccagccaccaccaggacaaacgcccccaaattcctttgtttcgagtcagtacgcgccnagctccngactcgtctctcgcctacagtcncggacaacgcgtccctccgtcgaccgttctcgtacggcctacgnggtcttaggaggtagtggacgtacgtagtaacttacgtactgacgacgcgtacagtacgtaccgaccggtaccctaacggtagggttcgttcgggaccgggtcggaaacgtacgggtcgaccggttcgtggtaccaacggcccaaggtcctacccggtccccggttcgtcctcccgttccgttcccgttacccctaccctaccccg

SEQ ID NO: 154856 - DNA, 665 bp, Homo sapiens
  misc_feature: GYAE6OF02JMMY1.10.38.D05.1.454.CMB.1.raw
  modified_base (198)..(198): a, c, t, g, unknown or other
  misc_feature (198)..(198): n is a, c, g, or t
  modified_base (408)..(408): a, c, t, g, unknown or other
  misc_feature (408)..(408): n is a, c, g, or t
tcagcatagtagtgcacgaccggtgctcgatttagtatctgatagttgggtttgggggggtcgtcgaggaggcgagcgctctcaggacgtcaccaccatggcctgggctctgctcctcctcaccctctcactcaggcacagggtcctgggcccagtctgccctgactcagcctccctcgcgtccgggtctcctggacngtcagtcacatctactgcactggaaccagccagtgtacttttgtgctttaataactatgtctccgtggtacctagccaccacccaggaccaaacgacccccaaacttccctttgttttacgaggtctaagtacgaccggccctcgaggacgtcctgacgttcggtcttcgtcgtcctccaagtctggacaacgcgtacctcctcgacctntcgtcggctccaggtctacggagtacgtcgaggtctagtacttactccgtgaccacggccagtacttacgttccgaaccggtacccctaaaggtcggggtttagttccgggggccgggtaaccggggtaacgttaacggggtcccgtaccgggttaccggtaccgggtcggtaacccggaccggtaacgggtcccttaaccggtcccccgttcggtaccctccgtttacccgtccgtttacccccgcccttacccgg

SEQ ID NO: 154857 - DNA, 663 bp, Homo sapiens
  misc_feature: GYAE6OF02IUQMC.10.38.D05.1.454.CMB.1.raw
  modified_base (366)..(366): a, c, t, g, unknown or other
  misc_feature (366)..(366): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgcttatttcaaaaggtgtccactgtgaggtttcaactggtggagacgtgggaggaggctggatccagccgtgggggtccctgagactctcctgtcgcagcctctgggttcagcatcaagtaacgactacatcgacctcgggccccgccagggcctaccggaggggacggggctgggaggtgggtctcgtagttattagaaacngatcggacaactactattattacttctacaccgtacgtcggaacggggtccggtttcctacccgtacctaccgacgaacgtaacctaccttacccaaacaactacttacttacgttacttcgtttaccaccgtatacgaccgtaacctaataccgttaggagtaaccgtacggaaccgacgtaacccgacccgtacttaacgtttacgttgtcggaccgtacgtaacctaagttcgaaccttaccggtaaccttacgttaaccgttccgggtacggggacccggtagggaaccccgg

SEQ ID NO: 154858 - DNA, 612 bp, Homo sapiens
  misc_feature: GYAE6OF02I08RF.10.38.D05.1.454.CMB.1.raw
  modified_base (272)..(272): a, c, t, g, unknown or other
  misc_feature (272)..(272): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctgtaccagcaccaccaggacaacgccccaaatccttgttttgaggtcagtaagcgcctnaggctccctgatcgttctctgcctcaagtctggcaacaccggcctcctgaccgtctcgtcggtctccgaggtctggaggatcgaggtctagtattactctgcaggcgactatactacgacggaccccaaggcgggttgttcgggcgggtacgggtaacgtaacggtcggaccggttcgtggacacggaccgaacggtcctaccgccccgtcgtcctacctccgttaccgttccccgacccttcccgtaccctaaccttaccgttacgtccgtccgtaacgggtacgggcccggtcggttacggaaccggtaacgggcccgtaacgtacggtacgtagacg

SEQ ID NO: 154859 - DNA, 669 bp, Homo sapiens
  misc_feature: GYAE6OF02JD85G.10.38.D05.1.454.CMB.1.raw
tcagcatagtagtgcacgaccggtgctcgatttagtatctgataggttgggtttggggggggtctcaggaggcagcgctctcaggacgtcaccaccatggcctgggctctgctcctcctcaccctcctcactcagggcacagggtcctgggcccagtctgccctgactcagccctccctccgccggtccgggtctccgtaggaccagtcagtccaccatcctcctgcctacgtcggaaccaggccaagttgtacgttttgtcgactttaataacctagttcgtctccgtggtaccagccacccacccgagacaaaaccgcccctaaacttctttgtttgaggtcagtaagccgacctgaggtactcctgtactccggttctcgtcgtaccctacgaagttccgtacgggaccaaaccgtaccggtcccctacccgttacggaaccccgttcgtccgtacgggcccttccggacggtcgtaggaggtacgtaggacggtcttagtaactttaccgacgtgccgactccgactaacgtcgtaccgaccggtacccctaaaggtggggttcgttcggggacggtacggtacgtaaggtcgacccgtcgtacgggccacggccgacgtcgtcccgcccgttggtcctacgttcctcccgttaccccccgtacc

SEQ ID NO: 154860 - DNA, 613 bp, Homo sapiens
  misc_feature: GYAE6OF02JLKY7.10.38.D05.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
  modified_base (325)..(325): a, c, t, g, unknown or other
  misc_feature (325)..(325): n is a, c, g, or t
  modified_base (338)..(338): a, c, t, g, unknown or other
  misc_feature (338)..(338): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctctcactcagggcacagggtcctgggcccagtctgccctgactcagcctccctccgcgtccggtctccgtggacngtcagtcacntctcngacacgtggaaccngtcagtntacttttgtgcttataactatgtctctgtaccancaccacagcaacgcccctaaactccttgtttcgaggtcagtacgcgtcctgagctccngatcgttctcgtnccgtacagtcgtcgctaaccgcgtcctccgtcgaccgttctacgtcggaccttccgacgtctcgaggntgacgctagtacttactntacgcgtacgctctactattaccgacgtacccgaagttaggggtcgtttcgggacgtaccggggtaagtaccgggtaccggaccgtttaccgtcgggacctacggtacccgaagggtccccgttaccggccccccgttacgggacccttacccgttcccgttcccgggttacccctaccccgttccccg

SEQ ID NO: 154861 - DNA, 595 bp, Homo sapiens
  misc_feature: GYAE6OF02IE45G.10.38.D05.1.454.CMB.1.raw
  modified_base (362)..(362): a, c, t, g, unknown or other
  misc_feature (362)..(362): n is a, c, g, or t
  modified_base (452)..(452): a, c, t, g, unknown or other
  misc_feature (452)..(452): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcatcaagtaacgactacatcgacctcgggccccgccgaggcctccgaaggggaggggctgggaggtgggtcctacagttatagaaacgngatcggactactaacgattaattatctagactccgtaggacgggtccgttccaccctctccgagacactacttaccaaacacacttcttntacttccgttacactatcgacactaatcgagagtacgtaccgacgaacctaccggcctaaccgttattcgtgtacgtccgacgaactcgtagaacctacggtacctactaaggtttccgggacgggtaccgaggggtaccccg

SEQ ID NO: 154862 - DNA, 686 bp, Homo sapiens
  misc_feature: GYAE6OF02F6OPU.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgacttttgtgctttaataactatgtctctggtaccagccaccacccaggaccaaacgccccctaaacttcctttgttttgacggtcagtaacgccggtcctcgaggactccctgacttccggttctcgtcgccctacgaagtctaggaccaacgaccggaccctccgtcgtacccgttcgttccggtcgggcccttccggacgtcgtaggtaaggtacgtggaacggtcttaggtaactttaccgtacttcggacctaggccgtactaagttccttaacggaccggtaccctaacgggtaggggttggtttcgggaccggggtacggtaacggttaacgggtccggtacccggtaccggtcgggtacccacgggtaacccgtaagggtcccttcccggccccgtacggttccctaccgtttcccgttacccggttccccgtccccttacccg

SEQ ID NO: 154863 - DNA, 467 bp, Homo sapiens
  misc_feature: GYAE6OF02FGB24.10.38.D05.1.454.CMB.1.raw
  modified_base (226)..(226): a, c, t, g, unknown or other
  misc_feature (226)..(226): n is a, c, g, or t
  modified_base (324)..(324): a, c, t, g, unknown or other
  misc_feature (324)..(324): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
  modified_base (451)..(467): a, c, t, g, unknown or other
  misc_feature (451)..(467): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaatccttgtttttgaggtcagtaagcggccctcaggagtccctgatcggttcnctgcctccaagtctggcaacacggcctccctgaccgtctctgggctccaggctgaggatgaggctgattactactgcagcgcatattcaggccccaanagggtgtttgggcggcgggactaaggtgaccgtctgggtcagcccaaggctcgccccctggccactctcgtccccaccctcctccactactanacgctgacggcggtctggcaaggcgacatagncnnnnnnnnnnnnnnnnn

SEQ ID NO: 154864 - DNA, 690 bp, Homo sapiens
  misc_feature: GYAE6OF02JN1EO.10.38.D05.1.454.CMB.1.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctcgggcccagtctcgccctgactcacgccctccctccgcggtccgggtctccgtggacagtcagtcaccactcctcctgccactcggaaccagcagtcgtacttttgtgacttaataactntgtctccgtagtacngcaccaccagacaaccgacccctaaactctttgtttacgagtcagtaacgccgcctcgaggcgtcctgacgttcggtctcgtcgtacctactaagtctacgacaaccgaccggtccctacctccgaccgttcgtacgtcggtcctaccgtggtaccgtggaacggtgtaggacggtactgtaacttacacgttgacgacggcacgttatacgtaccgtaaccgggaccctaagggtgggtttcggtggggaccgggtacgggtaaacggttaacgggtaccgtaccggttccggttacggggtccgaaacggtacccggtaaacgggtcccgttaccccgggtacccccggttacggttaccctacccggttccgttcccggtttaccccccggcccctttaacccg

SEQ ID NO: 154865 - DNA, 678 bp, Homo sapiens
  misc_feature: GYAE6OF02H0REL.10.38.D05.1.454.CMB.1.raw
  modified_base (265)..(265): a, c, t, g, unknown or other
  misc_feature (265)..(265): n is a, c, g, or t
  modified_base (388)..(388): a, c, t, g, unknown or other
  misc_feature (388)..(388): n is a, c, g, or t
  modified_base (495)..(495): a, c, t, g, unknown or other
  misc_feature (495)..(495): n is a, c, g, or t
tcagcatagtagtgcacgaccggtgctcgatttagtatctgatagttggggtttgggggggaggagggagcccagcactgggattccgaggtgtttccattcggtgatcagcactgaacacagaggactcaccatggagttttggctgagcttgggttttccttgttgctatttcaaaaggtgtccatgtgaggttcaatggtggagactgggaggagggctggactccagccgtcggggggtcctgagtactctcctgtgacanctctgggttcagctatcagtaacactacatcgaacctggccccacaggtcaccgagggaacgggctggagtcgggtcataggttatagaaacaggatggaccaatacaatacttaaggttctnaaccgtcgtaggaaaggtccgttccgaaacccttcccgaagaagaaccctaaccttaccaaaacaaaccgtaatccgtttataaacctttcgttaccaaccaggtanaccttaaaaccggaaatcgtttacaaggtcgtaaacggtacccgaaagaaccccgggaccaaaacccgttttaatttcgttaaggggctaacgggcccaaaacgtaccgtacggttaaacccttaccgtaaccttaaccttaaaccggtttcgggaacccggggtacggaaccggggtaaccg

SEQ ID NO: 154866 - DNA, 495 bp, Homo sapiens
  misc_feature: GYAE6OF02FHB31.10.38.D05.1.454.CMB.1.raw
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (470)..(470): a, c, t, g, unknown or other
  misc_feature (470)..(470): n is a, c, g, or t
  modified_base (476)..(495): a, c, t, g, unknown or other
  misc_feature (476)..(495): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagccccccaaatccttgttttgaggtcagtaagcggccctcaggagtccctgatcggttctctgcctcaagtctggcaacncggccctccctgaccgtntcgtggctccaggctgaggatgaggctgattactactgcagcgcatacttcgacggccccaagagggttgtttcgggcggcgggtaactaaggtcgtacccggtccgtcggggttcacggacccgaaggcctccggcccccctggtccacctctcgtccccaccctcctccactactatcgctgacggcggcgtcggcaagggccncatagnnnnnnnnnnnnnnnnnnnn

SEQ ID NO: 154867 - DNA, 693 bp, Homo sapiens
  misc_feature: GYAE6OF02I92E8.10.38.D05.1.454.CMB.1.raw
  modified_base (235)..(235): a, c, t, g, unknown or other
  misc_feature (235)..(235): n is a, c, g, or t
  modified_base (506)..(506): a, c, t, g, unknown or other
  misc_feature (506)..(506): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcacgtcaccattcgtcctgcacgtcggaaacngtcaggtgtacttttgtgactttaataactattctctcctaggtacctagccacctacccgaggaacctaaacgaccccctaaacttccgtttggtttcgaacggtctaaggtacggccggcctacgaggacgttcctagtacgttcgtctctcgtcctcagtctaggaccaacgcgtaccctccgtacgaccgtcgtcgcggtacctccgtaggtcctggggaacgtacgtcgggacgttacgtaacggtacttaccgtagttccggacnggtaccggtatagttaccgtacgaacccgtacccgtaacgggtcgggttggttaccgggcggtaaccgggtacggtaaacggggtcttacccgggtcggttacgggacggaaccggtaccgaacgggtcctaccccggttccctaccgggtctaccgttccggtccctttccccggacccttacccg

SEQ ID NO: 154868 - DNA, 659 bp, Homo sapiens
  misc_feature: GYAE6OF02G2HKM.10.38.D05.1.454.CMB.1.raw
  modified_base (214)..(214): a, c, t, g, unknown or other
  misc_feature (214)..(214): n is a, c, g, or t
  modified_base (599)..(599): a, c, t, g, unknown or other
  misc_feature (599)..(599): n is a, c, g, or t
  modified_base (605)..(605): a, c, t, g, unknown or other
  misc_feature (605)..(605): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (626)..(626): a, c, t, g, unknown or other
  misc_feature (626)..(626): n is a, c, g, or t
  modified_base (649)..(650): a, c, t, g, unknown or other
  misc_feature (649)..(650): n is a, c, g, or t
  modified_base (653)..(653): a, c, t, g, unknown or other
  misc_feature (653)..(653): n is a, c, g, or t
  modified_base (655)..(656): a, c, t, g, unknown or other
  misc_feature (655)..(656): n is a, c, g, or t
tcagcatagtagtgcacgaccggtgctcgatttagtatctgatagttggggtttggggctttgcctgggtctcctggacagtcagtcaccatctcctgcactggaaccagcagtgactttgttgcttataactatgtctcctggtaccagcaccacccaggcaaagcccccaaatccttgttttgaggtcagtaagcgccctcaggagtcccgngactcggttctctcgtcctaccaagtctggaccaaaccgccggtcctacccgtcgaccgtctcgtgggcctccgaggtctagaggtatggaggtctaggtaacttacctacgtgaccgacggtcgactaacttacgttccgaaccggtacccccgaaaggtacgggttcggtttcggggacccgggtacgggtaaccgttaaacggtccggtaccccggttcggttacggggaccacggtacccggaacggtccgtcccgtacccccgttcggtacctaccgttcgttacccgtcccctacccctccctacccgtaccttaacgttacgtcgtacgtacggtacggtcgggtacgtacggtacgaacggccgtacgtacgtgacngtgtanacgtncgtncgcncgngtcgncgtcgtcgagtcatacgtgtcgnngcntnntcg

SEQ ID NO: 154869 - DNA, 754 bp, Homo sapiens
  misc_feature: GYAE6OF02HSRTE.10.38.D05.1.454.CMB.1.raw
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctcgcgtccgggtctcctggacagtcagtcaccatctctgcactggaaccagcagtgactttgtgtcttataactatgtctcctggtaccagccaccaccaggacaaacgcccccaaatcctttgttttgaggtcaagtagcggcctnaggacgtcccnggtatcggttcctgtacgccctacaagtcgtacggaccaacgaccggccttccctacggacccgttcgtccgtgggcctacccgaggctagggaaggagttacggcggtacgttcgtaaatttaccgtactaggccgtaaggccgtacctaatttacgttacccgaacgggaacccccgtaaacgtacggggtttgggtttacggggcggggtaccgggaaacggttaacgggttaccggtaacccggttccggtacggggtaccgtaaccggacccggaaacgggtcccgttcccgggtccccccgttaccggtacccgttaccgttcccgttacccggtttacccccctacccttcccccgttaacctaacccgttaccgtacgttaccggtaccgttacgggtaaccgggtccgggtaccggttcgggtaaccggtaaccggccggttaccgaacgtacggagc

SEQ ID NO: 154870 - DNA, 721 bp, Homo sapiens
  misc_feature: GYAE6OF02G5MO9.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcagccctccctccgcggtccggtctccgtggacagtcagtcacctatcctctgccactggaaccagctagtgtacttttgtgtcttaataactagtgtcctccgtcggtaccacgaccacccgacccgaggaacctaaccgacccccctaaactttccgttttaggttttacgaggtacctaaggtaacgtcccggtccctacgaggtaccgttccctggtacgttccggttctcctcggtcccttaccgtaagtccgtacggaaccaccgaccggtccctcccgtggtacccgtcgtcgggtacgtcctacccggtacggtctaagggacggtagttacggacggtcgttagtaactttaccgacgtgaccgtacgcgtacttaattaccgtaccggaaccgaccccgttaagggtagggtttcgggttacgggccggtaacgggtaccgttagggtccgtaccgttcgggacggtaccgaccggacgtacggtcgtaccccggtccccgttacggacctaccgttccgtaccctacccgtccccgttaccc

SEQ ID NO: 154871 - DNA, 777 bp, Homo sapiens
  misc_feature: GYAE6OF02F7MGC.10.38.D05.1.454.CMB.1.raw
  modified_base (412)..(412): a, c, t, g, unknown or other
  misc_feature (412)..(412): n is a, c, g, or t
tcagcatagtagtgcacgaccggtgctcgatttagtatctgatagttgggtttggggggtaggagggaggcccagcactgggattccgaggtgttccattcggtgatcagcactgaacacagaggactcaccatggagttttggctgagctgggttttccttgttgctatttcaaaggtgtccactgtgaggttcaactggtggagactgggaggaggctggatccgaggccggggggtccctgacggactctcctgtgcacgcctcgtggttcagcatcaagtaacgactacatgaccgtcggggccctacgagggcctaccggaggggaacggggtcgtagggtagggtcggggtaccgtcgtaaggtttacgttaggaaaaccgtagaacgtcgggaactaaccgttanaacgtttaatttacttcgtaacgacgttaccggttaggaaccggggggttcccgtttacccctaaccccgttcgtcccgtaaacggtacgtaacccgtaaccgtttaacccaaaccggaaacctttaacgtacccgtttttaggaacctttcccgtttaacgtaaccctaattaccgtaacgtaccgttaaactccgttaacgacggtaacgttacccggggaaaccctaaccggaaacccgggttccctaaacccgttaaatttaacgttcgtacgaccggaccggtaacacgttaccgtaaccgttacgaccgttacgtaacgtttccgggaccgggttaccggacgggtaccgtaaccccgg

SEQ ID NO: 154872 - DNA, 742 bp, Homo sapiens
  misc_feature: GYAE6OF02HBUJU.10.38.D05.1.454.CMB.1.raw
tcagcatagtagtgcacgaccggtgctcgatttagtatctgataggttggggtttggggggggtctcaggaggcagcgctctcaggacgtcaccaccatggcctgggctctgctcctcctcaccctcctcactcgagggcacgagggtcctgggcccagtctgccctgactcagcctccctccgcgtccgggtctcctggacagtcagtcacatctctgcactggaaccagcagtgtacttttgtgactttaataactattcgtcctccgtacggtaccagccaaccacccgaggaaccaaaaccgacccctaaagttccgttttaggttttacggacgtacgaaggttaacggccggtaccctaggaacggtaccttccgtagtacgttccggttctcgtcgacccttaacgaagttcgtacggaaccaacggccggtccctaccgtacgtacccgttctcgggtacgggtacctaccggacggtacgtagggacgtagtacggaaggtctaacgtacttaactacgtcgacgtacgacgtactaagttacgtaccgaaccgtaaccctaagggttcgggttaggttacgggaccgggtaacgggtaacgtaacgggtaccgtaccggtttaccggtacgggtaccaaccggtacccggtaagggtccccgtacccgggtaccccgttaccgggtaccttaccggttacccgttacccggttccccctcccgttaaccccg

SEQ ID NO: 154873 - DNA, 687 bp, Homo sapiens
  misc_feature: GYAE6OF02I20RF.10.38.D05.1.454.CMB.1.raw
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (653)..(654): a, c, t, g, unknown or other
  misc_feature (653)..(654): n is a, c, g, or t
  modified_base (656)..(657): a, c, t, g, unknown or other
  misc_feature (656)..(657): n is a, c, g, or t
  modified_base (662)..(662): a, c, t, g, unknown or other
  misc_feature (662)..(662): n is a, c, g, or t
  modified_base (671)..(671): a, c, t, g, unknown or other
  misc_feature (671)..(671): n is a, c, g, or t
  modified_base (674)..(674): a, c, t, g, unknown or other
  misc_feature (674)..(674): n is a, c, g, or t
  modified_base (680)..(680): a, c, t, g, unknown or other
  misc_feature (680)..(680): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtacagcaccaccaggcaaagcccccaactccttgttttgaggtcagtaagcggccctcaggagtccctgatcggttctctgcctccaagtctggcaacacggcctcctgaccgtctctggctccaggctgaggatggaggctgacttaactactgacaggcgacagttaacttcgacggacccccaaacgtaggggtttcggtttcgggggaccgggtacggggaaccgttaaaggggttccggaacccgggtttaccccggtgggggttacccaaacgggtcccccggtaaaacgggtcccgttacccggtccccccccgttcgggggttacctaccccgtttaccttccgggttttaccccccaccccccctttcccgaacccctaacccggtttaacccttaacggttcgtcccgttacggggaaccggtcccgggggtccttacggggaccgaaaccgggtcccgaaccgtacgtagtacgcctagtcgctatacncngacgcnncnngcgcncgcacgtcncgnacgcgncacgtgc

SEQ ID NO: 154874 - DNA, 668 bp, Homo sapiens
  misc_feature: GYAE6OF02FJXBU.10.38.D05.1.454.CMB.1.raw
tcagcatagtagtgcacgaccggtgctcgatttagtatctgatagttgggtttgcggggagaggagcccagcactgggattccgaggtgtttccattcgatgatcagcactgaacacagaggactcaccatggagttttggctgagctgggttttccttgttgctatttcaaaaggtgtccactgtgaggttcaactggtggagactgggaggaggctggatccagccgtgggggtccctgagactctcctgtcgcagcctcgtgggtcagcatcagtaacgactacatcgacccgtcgggccccgccgacggcctaccggaagggggaagggtcgtagggaggttcgggtctacgtaagttacgtagaaacgagtatggacacgtacattaattattcgtgtaccgtccggtaggaacgggtcccgttacccacccgtctaccgaaggtacgtaaccctaccttaacccgaaaacctaacctactttcgtttacgtaacctttcccttccgaaacttcgtacgaacctaactaacttcgtaagacgtacgtaccgaacccgacgtacccggtacctaactttagttacgtcgtcggacccgtacgtaacttacggtacgaacccgttacacccgtttaagtaacgtttcccggggagggtaccccgg

SEQ ID NO: 154875 - DNA, 715 bp, Homo sapiens
  misc_feature: GYAE6OF02JLPO6.10.38.D05.1.454.CMB.1.raw
  modified_base (316)..(316): a, c, t, g, unknown or other
  misc_feature (316)..(316): n is a, c, g, or t
  modified_base (392)..(392): a, c, t, g, unknown or other
  misc_feature (392)..(392): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagtttggctgagctgggttttcctgttgctattcaaaaggtgtccacgtgtgaggttcaactggtggagacgtggaggaggcgtggatccgaggccgtcggggggtccctggacgacctcctccgtggtgccacgcctcgtggttcagcatcagtaacactacagtcgaccgtgggacccccnccgtaggcctacccggaaggggtaacggggccgtgggacggttcggggtcctaccgtaaggttacgtagaaaacgngtacgtggaccactacgtattaactattcgtacgtacgtccggtaggaacgggtcccggtttacccaacccgttccctacgaacggtaacgacccttaccggttaaaccaaaccgtaaactaacgtttccgttagttaacgtttaccttaccaaccgttactcgaacccttaacgtaacgttccgtaggtaaccggaacgttaccgaaccgtaacccgtaccggaacccttaagttacttacggttacgcggtacccgtagaaccgtagtaccgtacgtacccgttacacgttaaacgttcggtacccgggaggtaacccggg

SEQ ID NO: 154876 - DNA, 760 bp, Homo sapiens
  misc_feature: GYAE6OF02G3B2E.10.38.D05.1.454.CMB.1.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
tcagcatagtagtgcacgaccggtgctcgatttagtatctgatagttgggtttggggggggtctcaggaggcagcgctctcaggacgtcaccaccattgcctgggctctgctcctcctcaccctcctcactcagggcacagggtcctgggcccagtctgccctgactcagcctccctcgcgtccggtctcctggacagtcagtcacatctcctgcactggaaccngctagtgactttgtncttataactatgtctctggtaccagcaccaccaggacaaacgccccaaactccttgttttcgaggtcagtaacgccggcctcgaggactcctgacttcggttctctgcctcgaagttctcggacaacgccggtcctccctcgtaccgttccgtacgtcgggcctaccgaggtcgtaggaggtacgtggtacgggtcttaggtaactttaccgtaacgttggacctaaggcccgtctaactttacgttacccggaaccggtacccccgtaaaggtacggggtttacgggttttaccggggccggggttaacgggggttaaaccgttaaacggggtttaccgggtaaccccggtttcccgggtacgggggtttaaccccggacccgggtaaaccccggttaaaccggggtccccgttaccccgggttaccccccccgggtttaccgggttaccccgtaaaccccggttttccccgttttccccggggttttaacccccccctaccccccggtttaccccccg

SEQ ID NO: 154877 - DNA, 644 bp, Homo sapiens
  misc_feature: GYAE6OF02GHD7U.10.38.D05.1.454.CMB.1.raw
  modified_base (364)..(364): a, c, t, g, unknown or other
  misc_feature (364)..(364): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgacgactctcctgtgcagcctcgtgggttcagcatcagtaacgactacatcgaccgtcgggccccgccaggcctccgaggggaacggggcgtgggagtgggtctcgtagttattacgaaacgngagtggacaacgtacaattattattctagacttccggtaggaacgggtcccgttacctacccgtctaccgagaacgacctactacccaaacaactacttccttagtacttcctacactatcgacaacctaatcctaggacgtagtccgaacgtaccgtaccggacccttaaccgttatttacgttcggtacgtacccgtaacgtaacctaagttacccggtaactaccgtaccctaacgttaccgtttccgggaccggggtacccgaacggggtaccccg

SEQ ID NO: 154878 - DNA, 833 bp, Homo sapiens
  misc_feature: GYAE6OF02H9GVE.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcacatggagttttggctgagcttgggttttccttgttgctatttcaaaaggtgtccactgtgtaggttcaacgtggtggagacgtggaggaggcgtggactccgacggccggttcggggggtccctaggacgtaccttccgtccgtggtcgcacggtcctcggttgggttacagctactacgacgtaacgaactacgaagtcgaccggtcggccccgacgacggcgtaccggaaggggtacgggcgtggggtacggtcggtcgttacgtaggttagtaacgaaacgagacgttacggacctaacgttaacgaactttacgtttaacgttccgttaacgtaccggttcccgggtaaggggaacccggggttcccgggtttaccctaaacccgttccgtaaccccggtaaacggtaaccggtaacccttaaacccgttaaccccaaaacgttaacctacgttttaccgtttaacggttaacctttccctttaacgaaccgttactaccggaacctaaaccgtttaaccgaacggtttagaaacggttaccgtaaccgggaaaccgaaccggttaaaccgtcccttaacgttaacgtttaccgtttggaccgaaacccgggttcaaaccgttagtaaccccggttacgtaacccggtacgttaacccggttaaaggtttccccggggtaccggggtaacccggtaacgggg

SEQ ID NO: 154879 - DNA, 679 bp, Homo sapiens
  misc_feature: GYAE6OF02IRL60.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggaggaggctggatccagccgtgggggtccctgagactctccgtgtgcacgcctcgtcgggttcagcatcaagtaacgactacatcgaccgtcgggccccgccgaggcctaccggaaggggacgggtcgtcgggaggtgggtctcgtagttaagttagaaactagagtcggacaactactaattatttacttcgtacgtaccgtccggtaggtaaacgggtcccggtaccaccctctaccgagacgaccacttacccaaagtacctattactttcgtaacttcttaccaactacgttacacctactaaacttcgtaaggacgtagttaacccggaacggtacccgaaacccgggccccttaaaacgttaagttttacgttcggcgtacccggtaacggtaaacctgtaaccgtaaccgtaccgtaccttacggtaaccgtttcgggacggggaccccgaggggtaaccccg

SEQ ID NO: 154880 - DNA, 728 bp, Homo sapiens
  misc_feature: GYAE6OF02I8AMV.10.38.D05.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatcctcctgcacgtcggaaccngcagtntactttgtgcttaatactatgtctctgtaccagtccaccacccgacggacaaacgccccctaaacttccgtttagttttggacgtctaggtaacgccggtccctacgaggtacgtcccgtacgtagttccggttacctcgtcggtccccgtaccgtaaagttccgtacggtacccaaaccgtaccggtaccccttcccgtaccggtaccccggttccttccggtcgggtccgttacccggaccgggtactacgggaagggtacgtgggtacggtactaggttaacttaccgtagttacggcgtaacgcgtaacctagttacgttaccgaccggtaaccccgtaaggtacggggtttcgtcggggaccggtacggggtaaacttaaccgggtccgtaccggtccggtacggtaccgaccggaccgtaacggccgtcccgttaccccgttacggtcccgtacgttcccgttaccgttaccccccgtccttacccg

SEQ ID NO: 154881 - DNA, 691 bp, Homo sapiens
  misc_feature: GYAE6OF02JCJ8E.10.38.D05.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggccacagggtcctgggcccagtctgccctgactcacgccctccctccgcgttccgggtctcctggacngtccagtcaaccnttcctcctgaccacgtggaaccagcaagtgtacttttgtgacttanaactatgtcctctggtacngcaccacccaggtaccaaacgccccctaaacttcgtttagttttcgaggtactaaggtacgccggtccctcgaggtaccgtccgtgtacttccggtctctcgccctcaagtctacggacaacgtaccggccctaccgtcgtaccgttcgttcgtcgggtacctaccggaggtccgtagggtaacggtactagggtcggtacttacggtaactttaccgtacgtacggtaccgtacaccgttactacgtttaccgttaccgacccggtaaccctagggtaccgggttcggttaacggggccggtaacggttacgtaaggtccgtaccggttagacggtaccgaacggtacccgaacggtccgtccgtccccgttagtcccgtcttccggtacccgttcccaccccgttacc

SEQ ID NO: 154882 - DNA, 802 bp, Homo sapiens
  misc_feature: GYAE6OF02FVKX3.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgcttatttcaaaaggtgtccactgtgaggttcaacgtggtggacgactgggaggaggctggatccacggccgtggggggttcccctggacgaccgtctccgtgtgcacgtccgtcgtgggttcaggtcagtctaacgtaacgactaacatggaacctcggggacccgccgtaggcctaccggaaggggaacgggtcgtgggtacgtcgggtcttacgtaagttacgttacgaaagagtacgtaggacgacttaacatttaagttacttcgtacgtaacccgttacgtacgggtaaacggggtccccgtttaccaccccgttacctccgaaacggaaccggtaacctacccgtttaaacccaaaacccgtaaacttaccgtttaacgttttaccgttaacgtttaccccttaagtaacttaccgttaacgcccgttaaacgttaaactcggtaacggtaacggtaccgggtaacccggtaaccggtaaccgaacccgggtaaccccttaaagttacctttaaggtttcgacccggacgttaacccgggaacttaacgggttaaccgtaaccgtttaaccggacctttaccgttaacggtttacccgggttacggggaccgggaacccggggtaaccccgg

SEQ ID NO: 154883 - DNA, 522 bp, Homo sapiens
  misc_feature: GYAE6OF02FQ4F1.10.38.D05.1.454.CMB.1.raw
  modified_base (297)..(297): a, c, t, g, unknown or other
  misc_feature (297)..(297): n is a, c, g, or t
  modified_base (403)..(403): a, c, t, g, unknown or other
  misc_feature (403)..(403): n is a, c, g, or t
  modified_base (441)..(441): a, c, t, g, unknown or other
  misc_feature (441)..(441): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (498)..(500): a, c, t, g, unknown or other
  misc_feature (498)..(500): n is a, c, g, or t
  modified_base (502)..(522): a, c, t, g, unknown or other
  misc_feature (502)..(522): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaactccttgttttgaggtcagtaagcggcctcaggagtccctgatcggttctctcgcctccaagtctggcaacacggcctccctgaccgtctcgtgggcctccgaggctagaggatggacggntgattactactgcagcgcatattcaggccccaagtgggtgttgggcggcgggactaaggtcgaccggtctgggtcacggcccgaaggctccgccccctcggtaccncctcgtccgttccccaccctcctaccctactaccttancggcttcggacggccgggtcgtcgggcgaaacgggccgactacgtacgncngnactnnngnnnnnnnnnnnnnnnnnnnnn

SEQ ID NO: 154884 - DNA, 1068 bp, Homo sapiens
  misc_feature: GYAE6OF02JBMN6.10.38.D05.1.454.CMB.1.raw
  modified_base (143)..(143): a, c, t, g, unknown or other
  misc_feature (143)..(143): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagtttgctgngcttgggttttccttgttgctatttacaaaaggtgtccactgtgtaggttcaacgtggtggagtacgtgggaggaggcgtggtactccgacggtcccggttcgggggggtacccctggaacggtaccgttccgttccgttcggtcgaccgtaccgtcccgttccggttcggggttaccgaagacctacgttaaccgtaaacggttaaaccgtaacccgttaaccgtaacgttccggtaaccccggttcccgggggaccccccgtacccggaaccggggtcccgttaaccccggggtaaggggggggtaaaccgggggccgggttaacggggtacggggtttaccggggttacccgttaaccggttaacgggttttaaacgttaacgggaaaaaccgtaggttaacggtacgggtaacccgttaaaaccttaaccgttaaattttaaacgttttaccggtttaccggttaacggttaacccggtttaccggggtaaccgggggtaaacccgggggtttaccccggtttaccccgtacccccgttaccgttaaccggaagggttaaacccgtaaaccccttaaaccccgtttaccccgaaaaactaaacccctttacggttttaccctttttaaacggtttaacccttttacccgtttaaccctaaacccgtttaacgttcccggtaaaacccttaaccgttaaaaccctttcgggtttaaaacccgaaggggttaaaccgtacccggttaaaaccccgggaacccttaccccggggtaaaacccccttttaagttaacggttttacccggttccggttaacgccggttaaacccggtaacttaaccggtaccgtaaccccgttacgtcccttttaaacggaccgtttttacgggaccccgggggtaccggaaccggggttacccgg

SEQ ID NO: 154885 - DNA, 603 bp, Homo sapiens
  misc_feature: GYAE6OF02FL2HX.10.38.D05.1.454.CMB.1.raw
  modified_base (424)..(424): a, c, t, g, unknown or other
  misc_feature (424)..(424): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgcccccaaactccttgttttgaggtcagtaagcggcctcaggagtccctgatcggttctctgcctccaagtctggcaacacggcctccctgacccgtctctcgggctccgaggctggaggtagtgacgctgattacctngcagcgactatattccgacggaccccaagacggggttggtttacgggccggggtcgggtaacttaaggggtcgtacccggttaccgtggggtccgtaaccggcccgtaaacgggccttccggccccccgttacgggttcccaaccgttcccgttccggtttacccccacccttaccccg

SEQ ID NO: 154886 - DNA, 879 bp, Homo sapiens
  misc_feature: GYAE6OF02JMZOQ.10.38.D05.1.454.CMB.1.raw
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (464)..(464): a, c, t, g, unknown or other
  misc_feature (464)..(464): n is a, c, g, or t
  modified_base (642)..(642): a, c, t, g, unknown or other
  misc_feature (642)..(642): n is a, c, g, or t
tcagcatagtagtgcacgaccggtgctcgatttagtatctgatagttgggtttggggggggtctcgaggaggcagcgctctcaggacgtcaccaccatggcctgggctctgctcctcctcaccctcctcactcagggcacaggtcctcggccgactntcgccncactactcgactccctccgcgtccgggttaccgtcctcgacgacgtcgacgtactacccaacttctcccttgaccaccgtacgaaccgaactacgactacggttattacgtttgtacttaacttaacgtaacttgtacgttccttcggtacgtaccacgacccgtaacccaaccgggtacgaaaccggtaaccccctaaccctttaccgttttcgtttttagttaccgggaccgtaacgtaaacgggtaccggtcccgtacctaggaccgggttccctcgtacggttaccgttcgtttccncgtaccgtaccctaagttcggtacgtacgaaaacctccggtccctacccttaccgacgttcccgttcagggtcccgtaccgagggtacccttagggacccggtaggtcgtacggggtaccttacggttaactttaccgttaccggtagtacccggaacgttcggtaacccctttaaanacggttttaacccaacgggtaacccccggttaaccggtaagggggttttcggtttaccgggggtaccgggggaccgggtttaaaccgggttaaacgttcccgggggtaacccgtttcccggggtgggtttaaaaccgcccgggtaaaccgtccgggtacccgggtcccttaccccccgggttaacgttccggaacctttaccccgggtccggttacccccgtccccgttaacccccg

SEQ ID NO: 154887 - DNA, 715 bp, Homo sapiens
  misc_feature: GYAE6OF02G2YS9.10.38.D05.1.454.CMB.1.raw
  modified_base (448)..(448): a, c, t, g, unknown or other
  misc_feature (448)..(448): n is a, c, g, or t
  modified_base (585)..(585): a, c, t, g, unknown or other
  misc_feature (585)..(585): n is a, c, g, or t
tcagcatagtagtgcacgaccggtgctcgatttagtatctgatagttgggtttgcggggaggaggagcccagcactgggattccgaggtgtttccattcggtgatcagcactgaacacagaggactcaccatggagttttggctgagtcgtgggttttcctttgttgtcttatttactaaaaggtcgtccactgtgtaggttcaacgtgggtggagacgtgggaggaggcgtggactccgacggccggtggggggtcccaggacgtctccttccgtgtacgacgtcgtccgttacggtgggttccaaggtcctactaccgtaaacgtaacggtacctaactaacgttcggacccggtcgggccccgaccgtacggaccgtacccggaagggggaacgggtcggtcgggtaggtcggtaccgtgtaagtttagtaacggtaacaggtanacggtacacgttaactacgttaattcttacgtgtacctcggtaggtaacggggtcccgttacccaaccgtccgtaccgtaagaccgtactaacccgttaccaaaactactacgtcttagttactcttaacgacactntaacccgattaaccacgtgaagtaaccggccaaccgtaaccgctacccgactttaattccgttagcggctaacggtcaagttccgaactttcccacttacggttaacgccggttaccgggacgaaccggg

SEQ ID NO: 154888 - DNA, 949 bp, Homo sapiens
  misc_feature: GYAE6OF02I2J01.10.38.D05.1.454.CMB.1.raw
  modified_base (262)..(262): a, c, t, g, unknown or other
  misc_feature (262)..(262): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgtggtttctgtagctattacaaaaggtgtccatgtgagttcaactggtggagactggaggaggctggactccgagccggtcgggggtccctggagactctccgtgtgcagcctntacgggtacagcacactaagaacgactaactagtacgtaccgtcgggaccccgccgaacggtacctacccgggaagggggaaaacggggccggttaagggtaagggttcgggttacctaccgttaagggttttaacgttagggaaaaaacctagggaaagttcggggaacctaaaacgttaacctagttttaaaacccgtttaagttttaaccttacggttaaacccgttacccccggggtaagggtaaaaccggggggttcccccggtttttaacccgaaacccccccgttttcggtaaaccccgaaaggttaaaacccggaacccgttaaaccctttaaaccccggtaaaaaaccgttaaaccgttaaccttttaacccggttttaacgtttaaccggtttaaccccgtttaacgtaaacccttaggtaacccggtaaccgtaaaaccgaaactttaaccggtttaaccgggaaggttaaaaccgggttacccggaaaccccggttaaaccggtaaccccgggtaaaccccgttaaacccggttttaaaccttttaaggttcccggtttaaccgggacgtaacccggacccttaaaggttaccgtaaaccgtaaccgggttaccctttaacgaacccggttttttacggaccccgggggttaccggtaaccgggtaaaccccggg

SEQ ID NO: 154889 - DNA, 535 bp, Homo sapiens
  misc_feature: GYAE6OF02F2R9H.10.38.D05.1.454.CMB.1.raw
  modified_base (484)..(484): a, c, t, g, unknown or other
  misc_feature (484)..(484): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagtttttgctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctgggcccgccaggctccgaggggaaggggctagggagtgggtctcgagttattgaaactgatggcactacatattagttctgactccgtgaacgggccgttcaccctctccagagacacttaccaacaacatcctagtatccttcacatcgcactaatctgagagtcgacgacacggccacttacttattcgngtcgcgaccatcggactacgctactaaagttcgtcggggacccagggaccg

SEQ ID NO: 154890 - DNA, 735 bp, Homo sapiens
  misc_feature: GYAE6OF02IFQFU.10.38.D05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcgagggcacgagggtcctgggcccagtctgccctgactcagcctccctccgcggtccggtctctggacngtcagtcaccatctctgcactcggaaccagctagtgtacttttgtgctttaataactatcgtctcctggtaccagccaccaccgacggaccaaaccgaccccctaaacttccgtttagttttacggacggttacgaggtaacggccggtccctacgacggtacgtcctagtacgttccggttctccgtcgtaccctacgtaacgtcgtcgacaacgaccggtccctccgtacgtacccgttctcgttccgggtacctccggacggtcgagggtaagtacgtaggacgtcgtagtaacttacgtacgtacgaccgtacggcgtactaacgtaaccgttaccgaacccggtaaccccgttaagggtacgggggttcggttacggggtaccgggtaccgggtaaacggttaacgggttcggaacccggttccggtagggtaaccctacgggacccggtaaccggtcccgtaccggtccccccggttacgtaaccgttacccgttacccgtttccccgttacccccggtcctaacccccg

SEQ ID NO: 154891 - DNA, 608 bp, Homo sapiens
  misc_feature: GYAE6OF02HRBWA.10.38.D05.1.454.CMB.1.raw
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctgggggtccctgagactctcctgtgcagcctctgggttcagcatacagtaacgactacatcgaccgtcgggccccgccgaggccgtccgaggggaaggggcgtgggaggtgggtctcgagttatagaaacagatggcactacatattatctgtactccgtaggaacgggtccgttccacccgtctacccagaacacctaccttacccaaactaactntaccgttagtacttccctttacaacttancgacctaacagtacctagaagtacgtaccgaacgaccgaccggtacccaaacgtttattagttcgtcggaccgacggtaccaagtcggaactacgaccttactaacgttcgggacgggtcccggagggaaccccg

SEQ ID NO: 154892 - DNA, 859 bp, Homo sapiens
  misc_feature: GYAE6OF02I7I1R.10.38.D05.1.454.CMB.1.raw
  modified_base (230)..(230): a, c, t, g, unknown or other
  misc_feature (230)..(230): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctctcactcagggcacagggtcctgggcccagtctgccctgactcagcctcctcgcgtccggtctcgtggacacgtcagtcaccatcctcctgaccacgtacggaaccngctagtcgtactttgtcacttaataactatcgtcctccgtcggtaccagccaccgaccgacggactaaaccgcccctaaacgttccgtttacggttttcggaaccggtaccgtaacggtaacggcccggtaccctacggtacggtaaccgttccctaggtaaccgttccgggttacctccgtacggtaccccttacggtaacgttccgttacggacctaaaccggtccggtcccttacccgtacggtacccggttaccgttccgggtacgggtccctaccggtaacgggtccgtacgggtaacgggtacgttacggtaccggtacgttacgggttaaccttaccggtaccgtacggaccgtacggtccgtaacgttaaccgtacgtttacccggaacccggtaaccccttaaacggggtacgggtttcgggtttaccgggaccggggtaccggggtaaccgttaaccggggtacccggttacccggtacccgggttacggggtaacccgtacccggggtaaacccggtacggggttcccccgtaacccgggttccccccgggttaggttaccccgtacccgtttacccgggtttccccggtttaccccctacccccgtttaaccccggg

SEQ ID NO: 154893 - DNA, 712 bp, Homo sapiens
  misc_feature: GYAE6OF02FRFRY.10.38.D05.1.454.CMB.1.raw
  modified_base (229)..(229): a, c, t, g, unknown or other
  misc_feature (229)..(229): n is a, c, g, or t
  modified_base (344)..(344): a, c, t, g, unknown or other
  misc_feature (344)..(344): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtccaccatcctcctgcactggaaccngcagtgtacttttgtcgctttaataacctatgtctcctggtaccagccaccacccaggaccaacgacccccaaacttccttgttttgagtcagtacgccgcctcgaggcgtcccngtactcggttctctcgtccctccgtaagtccgtaggccaacgtaccggtccctcccgtacgtacccgttctccgttacgggtcctcccggacgggtcctgggaacgggtacgttcgggacgggtaccttaggtaaacctttaccgttacttcggactacggtccgtactacgtttacgttaccgaacgtaccccgtaaaggtcgggtttcggttacgggccgggtacgggtaacgttaacgggtaccggtacccggttccgtacggggtacctaccgggaaccccgtaaacgggtcccctccgggttacccccccgtgggtaccctaccgttcccgtacccggtttaccccctaccccgtttcccccg

SEQ ID NO: 154894 - DNA, 797 bp, Homo sapiens
  misc_feature: GYAE6OF02GRWDP.10.38.D05.1.454.CMB.1.raw
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
  modified_base (344)..(344): a, c, t, g, unknown or other
  misc_feature (344)..(344): n is a, c, g, or t
tcagcatagtagtgcacgaccggtgctcgatttagtatctgatagttgggtttgggggggtcgtcgaggaggcagcgctctcaggacgtcaccaccatggcctgggctctgctcctcctcaccctcctcactccagggcacagggtcctgggcccagtctgccctgactcagccctccctccgcgtccgggtctccgtggacngtcagtcacatctcctgcactggaaccagcctagtgacttttgtgctttanaactatgtctctggtacagccaccaccaggacaacgaccccaaacctccttcgttttgacgtactagtaagcgtcctcgagtacgtccgngtacgtcggttctctcgcctcctaacgtctacgggcaacgaacggtcccctaccgtcgtacccgtctcgtcgggccttccgaacgggtccgtacgggggaactgggtaaggccgtaggtacgttaacctacggttacgcaaggtcccggtactaacgttacgtttccgaaccggggtaccccctaaaacgggtccgggggttttaccgggttttcggggacccggggtaccgggggtaaacggtttaaaacggggtttcccgggtaaacccgggtttccccggtttcgggggaccggtttaacccgaacccccgggggtaaaacgggttcccccgggttccccgggtaaccccccggttttccccgggggttacccttaaccccgtttacccgggtttccccgggtttacccccccccgttaaccccccggttaaccctttaccccccccggg

SEQ ID NO: 154895 - DNA, 661 bp, Homo sapiens
  misc_feature: GYAE6OF02IDR7X.10.38.D05.1.454.CMB.1.raw
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (577)..(577): a, c, t, g, unknown or other
  misc_feature (577)..(577): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaggtgtccactgtgaggttcaactggtggagacgtggaggaggctggatccagccgtgggggtccctgagactctctgtgcagcctctgggttcagcatacagtaacgactaacntacgaccgtcgggccccncgaggcctcgaggggaacgggctgggagtgggtctcgtagttatagaaacagaagtggacaactacgtattattacttcgtcgtaacttccggtagggaacgggtcccggtttacccaccctttcgtccgtaacggacgtaaccttacccgttaacccaaaccgtaaactctttaccgttagttaacttcccgtttacacttagtacgaccaactaacttcgtagaggacgttccgaaccgaccgccggaccctacttacgttgttcggtacnccggtacgtaacacggtcggtaaacccttcgtccccttaataaaccgtttcggggacccgggtacccggtagggtaacccccgg

SEQ ID NO: 154896 - DNA, 637 bp, Homo sapiens
  misc_feature: GYAE6OF02I4B8C.10.38.D05.1.454.CMB.1.raw
  modified_base (229)..(229): a, c, t, g, unknown or other
  misc_feature (229)..(229): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttataactatgtctcctggtaccagccaccacccaggaccaaacgcccccaaactcctttgttttgaggtcaggtaagccggtccctcgaggacgtccctgacgtccggttctcgtcgccctaccaagtctcggacaacgaccggtccctcctcgacccgtctccgtcgggcctccgaggctggaggtatggagtctgtacttactacgtgcgacgcgactaattacgttccgaacggtaccccctaaggtacggggttggtttcggggccgggtacgggtaacgttaaagggtccggacccgttccggtcgggtccacggacccgtaagggtccctacccggtcccccgttacggtcctaccgttcctacccggttcccccaccccgttccc

SEQ ID NO: 154897 - DNA, 691 bp, Homo sapiens
  misc_feature: GYAE6OF02JG6GH.10.38.D05.1.454.CMB.1.raw
  modified_base (174)..(174): a, c, t, g, unknown or other
  misc_feature (174)..(174): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (490)..(490): a, c, t, g, unknown or other
  misc_feature (490)..(490): n is a, c, g, or t
  modified_base (508)..(508): a, c, t, g, unknown or other
  misc_feature (508)..(508): n is a, c, g, or t
  modified_base (544)..(544): a, c, t, g, unknown or other
  misc_feature (544)..(544): n is a, c, g, or t
  modified_base (651)..(651): a, c, t, g, unknown or other
  misc_feature (651)..(651): n is a, c, g, or t
  modified_base (665)..(665): a, c, t, g, unknown or other
  misc_feature (665)..(665): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctctcactcgagggcacgagggtccgtgggcccagtctgccctgacctcncgtccctcccgtccgcgtccgggtctccgtggacagttccagtccaaccatcctcctgacctacgtacggaaccngcgtaggtntacttttggtacgtactttaataacttntcgttccttccgtacggtaccacnccaacccaccgacgaaccaaccgtaccccctaattccgttttaggttttacgacggtctaacggtacggcccgtccgtacgtacgggtccttcccggtagtaccgttccggttctccggtccgtcctacgtacgtccgacggacctaacccgccggtcccctaccgtcggtccctcgtcncgggtcctcgaacggttnaggtcggatcgggagtctacggtacttacgtacggngtacgcgtcgaacttgtaccgtcgaacccggtccgtaggtaggtcggttacgggcggtacggtaacggtcgtaccgcggttaccgtggacgaccgtcgacggttccnccgtcccgtcgtcnccttccgtcccgtaccccgttacccg

SEQ ID NO: 154898 - DNA, 619 bp, Homo sapiens
  misc_feature: GYAE6OF02JXU3A.10.38.D05.1.454.CMB.1.raw
  modified_base (258)..(258): a, c, t, g, unknown or other
  misc_feature (258)..(258): n is a, c, g, or t
  modified_base (372)..(372): a, c, t, g, unknown or other
  misc_feature (372)..(372): n is a, c, g, or t
tcagcatagtagtgcacgaccggtgctcgatttagtatctgatagttgggtttgggggggtctcaggaggcagcgctctcaggacgtcaccaccatggccgtgggctctgcctcctcctcaccctcctcactcagggcacagggtcctgggcccagtctgccctgactcagcctcctccgcgtccggtctcctaggacagtcacgtccaaccatcctccgtgccacgtaggaaccagcagtgtacttttgtgtcttanaacttatgtctcctgtaccaactaccaccagacaaacgcccctaaactccttgtttgacgtcagttaagccgtcctcacggctcctgacttcggtctcgtcgccgtctaagtcngtaccaacgacgcctcctagaccgttctcgtcgggacctcgacgtctacggaggtactgggactcgggttataacgtttacctaccgtgtaccgacggactaccggaacttcgtaccgacggtacccaaggttacgggtcggttcggacgggcggtaacgacggtcgacgtcgtggtcaccggccgtaacgccgtccgccccgttggtaccctacgttccgtaccgttcccctaccggtccctaccg

SEQ ID NO: 154899 - DNA, 736 bp, Homo sapiens
  misc_feature: GYAE6OF02JAGYM.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagactgggaggaggctggatccacgccgtcggggggtccctgacgactctcctgtgcacgccttcgtggttcagcatcagtaacgactacatcgacctcgggccccgcgacggtcctaccgaggggaacgggcgtagggaggtcgggtctcgtagtttagttacggaaaacaggtagtcggactaacgttactaatttactttacttcgttacgtaccttccggttaggtaacggggtcccgggtttacctaccccgttcgtacccgtaacggtaacgtaaccccgttaaccctttacccgaaaacctaaacttactttccggttacgttacttccgtttaccactattaccgacaaaccgttaacttcgtaggtaacggacgttaaccgggaacccgtaaccgaccggaccccttaacgttacttttagttacggttacgcccgtaacggtaacctcgttaccgtaaccttacgggtaccttaaccttaaccgggtttccgtaaccggggggtccctaagggggtaacccg

SEQ ID NO: 154900 - DNA, 690 bp, Homo sapiens
  misc_feature: GYAE6OF02JAHDR.10.38.D05.1.454.CMB.1.raw
  modified_base (494)..(494): a, c, t, g, unknown or other
  misc_feature (494)..(494): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
tcagcatagtagtgcacgaccggtgctcgatttagtatctgataggttgggtttggggggggtctcaggaggcagcgctctcaggacgtcaccaccatggcctgggctctgctcctcctcaccctcctcactcaggcacagggtcctgggcccagtctgccctgactcagccctcccgtcgcgtccgggtctacctggacagtcagtcaccagtctcctgcactcgggaaacctgcagtgtacctttgtcgacttaataacgttatgttcctccgttacggtaaccacgccaacccaccccgagggacctaaacccgaccccctaaacgttccttttaggtttttacgacggtacgaggtaaccgccggaccctcgaaggtccgtaccgtgaccgttcggttactccgtcgtacccgtacctaagtccgtacggaccaaccgcggtaccctcccgtagtacccgtcgtcgtcggctccgaggcctagacgtagngtgactagtacttactacgtgcncggcncgtactgtaccgaccgtacccgaggtacgggttcggttcgggaccggtacggtaaacgttaccgggtacgtacccgtaggttcggacccgacggttacccgaagtccccgtaccggtcccccgtcggtactacccttaccggttacccgtccccgttacctacccccg

SEQ ID NO: 154901 - DNA, 658 bp, Homo sapiens
  misc_feature: GYAE6OF02FSDFW.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttacaaaggtgtccactgtgaggttcaactggtggagacgtggaggaggctggatccagccgtggggggtccctgacgactctcctgtgcacgcctctgggttcagcatcagtaaccgactacatcgaccgtcgggccccgccaggcctacccggaggggaaggggctgggagttggggtctcgagtttagttaggaaacagagtggactactacatttattattctacgtactcggttaggaaccggggtcccggttaccaccctttcccgacccgaaggtaccgacctaaccttacccgaaacctaactacttctttagtacttccttacactagtcacctactaactcgtaggaagtcgtaccgtaccggaaaccgccgtaccgtaacctttaagtttcgttcggtcgacccggtacgtaacctagtccgtaaccgtaccgtccttaccgtaaaggtttccggacggggtacccgaggggtaccccg

SEQ ID NO: 154902 - DNA, 588 bp, Homo sapiens
  misc_feature: GYAE6OF02F57CK.10.38.D05.1.454.CMB.1.raw
  modified_base (360)..(360): a, c, t, g, unknown or other
  misc_feature (360)..(360): n is a, c, g, or t
  modified_base (466)..(467): a, c, t, g, unknown or other
  misc_feature (466)..(467): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactgggtggagactggaggaggctggatccagccgtggggggtccctgagactctcctgtgcagcctcgtgggttcagcatcagtaacgactacatgacccgtcgggccccgccaggcctccggaaggggaaggggctgggaggtgggtctcgagttatagaaacngatggacactactattattattctagtactccgtaggaacgggtccgtccaccctctaccaggacacctacttaccaaacaactacttcttgtacttcttacatannacactaactctaggagtacgtacggaacgaccgaccggacctaaccgttatttacgtgcgacgccgaactagtacgtacctacgccttagtaacgttccggacggggaccgtagggacccg

SEQ ID NO: 154903 - DNA, 645 bp, Homo sapiens
  misc_feature: GYAE6OF02H0O1E.10.38.D05.1.454.CMB.1.raw
  modified_base (454)..(454): a, c, t, g, unknown or other
  misc_feature (454)..(454): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttccaaaaggtgtccactgtgaggttcaactggtggagactggaggaggctggatccagccgtgggggtcctgagactctcctgtgcagcctctcgggttcagcatcagtaacgactacatgaccgtcgggccccgccgacggcctaccggaaggggaaggggctgggaggtcgggtctcgtagtttattacgaaacagtagtgtaccactacattatttacttctagacctcggtaggacggtccggttaccacccttgtacccaggactacctaccttaccaaanaactcgttctttagtacttcctaccaactagtcgtacactaagttccgagtaacggtactaccggaaaccgtaccgacccggtaccctaaccgttattacgttcggtacgcccgtaagtaaccctagtaccgtaaccctggttacctaccgtaaggttttcccggcgggggacccgtaacgggtaccccgg

SEQ ID NO: 154904 - DNA, 849 bp, Homo sapiens
  misc_feature: GYAE6OF02JQU8N.10.38.D05.1.454.CMB.1.raw
  modified_base (563)..(563): a, c, t, g, unknown or other
  misc_feature (563)..(563): n is a, c, g, or t
tcagcatagtagtgcacgaccggtgctcgatttagtatctgatagttgggtttgggggggtctcgaggaggcagcgctctcaggacgtcaccaccatggcctgggctctgctcctcctcaccctcctcactcagggcacgagggtcctgggcccagtctcgccctgactcagcctccctccgcggtccgggtctccgtaggacacgtcacgtcaccatcctcctgccacgtcgggaacccaggaccaggtcgtactttttggtcgtatttaactaacttagtacgttcctccgttcggtaacctaggaccctaaccacccgtacggaccgaaaccgaccccctaaaacttccgtttaggttttacggtacggtcgtaacggtaacgccggtacccgtacgaacgggtacgtcccgtagtacggtttccggtccttcgccgtaccgtaccgtaacgttccgtacgtaccgaaaccgtaccggtccccgtaacccgttcggtaacccgttccggtaccggtcggggtccctaccggtacggtacgtcgggaacggtatacggggngtacgttacggtaacgtttcccgacgttacgaccgtcgtacggtactacgttacgttacccgggacccggaaccccgtaaacgggttcggttcggggttacggggtccggtaaacgggttaccggtaaccgggttccgggtaacccggttacccgggtacgggtaccgtaacccggggtaccccgttaaggggtaccccttcccggtaacccccggtttaccggggtccctaaacccgggttttccccgtttaccccgtttacccccgtaacccccgtttccccgg

SEQ ID NO: 154905 - DNA, 772 bp, Homo sapiens
  misc_feature: GYAE6OF02JX5HG.10.38.D05.1.454.CMB.1.raw
  modified_base (198)..(198): a, c, t, g, unknown or other
  misc_feature (198)..(198): n is a, c, g, or t
  modified_base (260)..(260): a, c, t, g, unknown or other
  misc_feature (260)..(260): n is a, c, g, or t
tcagcatagtagtgcacgaccggtgctcgatttagtatctgatagttgggtttgggggggtctcgaggaggcagcgctctcaggacgtcaccaccatggcctgggctctgcctcctcctcaccctcctcactcagggccacagggtcctgggcccagtctcgaccctgacctcagccctcctcgcgtccggtctccgnggacacgtcagtcaccgatccgtcctagcctacgtcggaaccagcctagtcgaccttttggngacttaataacgtatcggttcctccgttaggaacccaggacctaacccgacccgaaggtacccaaaaacggtccccccctaaaagttccccgtttaggttttacgaccgggttacctaacgggtaacgccggtaccccctaggacgggaacttccccgtagtacttccgggttactccggtcgtaccctaaccgtaagtcggtacggacctaaaacgccggtcccgttccctacggggtaacccttccgtaccgggtttaccgggaccgttcccgtaacgggtccgtcgggaaaccggtcgttacggacggtacgtaacggtaacctttaccgaaccgtttcgacgtacgcggtactagtttaaccgtaccgcgtaacccgacgtaggggttaccgtttcggaacgtcgggtaaacgacggttccgtaccgtcggttaggcgtaaccggaccgttaggtcccgtaccgtccccggttgtaaccgtcttccggtacccttcccgacctccccg

SEQ ID NO: 154906 - DNA, 741 bp, Homo sapiens
  misc_feature: GYAE6OF02JRCF1.10.38.D05.1.454.CMB.1.raw
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
  modified_base (507)..(507): a, c, t, g, unknown or other
  misc_feature (507)..(507): n is a, c, g, or t
tcagcatagtagtgcacgaccggtgctcgatttagtatctgataggttgggtttgggggggtctcgaggaggcagcgctctcaggacgtcaccaccatggcctgggctctgctcctcctcaccctcctcactcgagggcacgagggtcctcgggaccctagtctgccctagacctcagccctccctccgcgtccggtctccgtgacagtcatccaccatcctcctgccacgtcggaaccagctaggtcgtactttggttnacctttaaagtaactactgttccttccgtcggttaaccngacctaacccgaccccgaaggaaccgaaaacccgcccccttaaaacgttccccgttttggttttacggaacgtttccgaaaggttaaaccgcccgggtaccccctagtaacgggtacgttaccctcgggtaacttccggggttacctcgtaccgtccccgttacgtaacgttcgtcgggaaccctaacggccgtaccccgttcccgtntaacccggttctccggtcgaaccgttccgacggtgtcgaaggctaacgtcgacgtgtacttacgtctacgcgaactcgactacgtctaccggtaccgaccctacggtaacggttggttcgggcccggtggtaacgtacggggtacgtaccggttaccgcggtacgaccggtaccgtaacggtccgtacccgtcccgtcgtaacctccttcggtcccttcccggtacctacccgg

SEQ ID NO: 154907 - DNA, 826 bp, Homo sapiens
  misc_feature: GYAE6OF02HJG06.10.38.D05.1.454.CMB.1.raw
  modified_base (249)..(249): a, c, t, g, unknown or other
  misc_feature (249)..(249): n is a, c, g, or t
  modified_base (481)..(481): a, c, t, g, unknown or other
  misc_feature (481)..(481): n is a, c, g, or t
  modified_base (531)..(531): a, c, t, g, unknown or other
  misc_feature (531)..(531): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcaggacacaggtcctgggcccagtctcgccctgactcagccctcccgtcgccggtccgggtctaccgtggacctaggtcagtcctaccatcctccgtacgctaaccgtacgggaaccngacgtacgtcttacgttttcgtacgtatttaactaacttcttccgtccgttaccggttaacggccgtaaccgacccgacccggtaaacgaccgggtaaaacccaaaccccgtacccccttaacgtttcggtttttacggttaacggtacgtacgtacggtaaccgtccgtaaccgtacggtacggttacctccggttaaggttccccgttcgtacctcgtccaacccgttancggtacggtcaaccgaccgtcccgtccttaccgagtccgtcggtcggtcnccgacgtacggtcgttacgggattacggggtctacgggtcttaaacgggttaccttaccggtacgttcggtaagcccgttacggttaacctcgtttaacccggaaccgtacccgttaaggttacggggtacgggttcggtaacccggggtacgggtaaccgtaaaccggttcgggttacccgtccggttacggacggtaccgcccgggtttaaaccggcgttccccgttaaccccgggcgttacccgtaccgttaccgtttcccggttaccccttaccccctaccggtttaaccc

SEQ ID NO: 154908 - DNA, 690 bp, Homo sapiens
  misc_feature: GYAE6OF02I9JO4.10.38.D05.1.454.CMB.1.raw
  modified_base (388)..(388): a, c, t, g, unknown or other
  misc_feature (388)..(388): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaggtgtccactgtgaggttcaacgtggtggagactggaggaggcgtggatccagccgtcggggggtccctggagactctcctgtgcacgcctgtgggttcagcatcagtaacgactacagtcgaccgtcgggcccgccgaggcctaccggaggggagggcgtgggaggtgggtctcgtagttagtagaacagatcggcactacattattatctanaccgtcgtggacggtccgttcaccctctacgagacgactacctaccaaacaacgtcttactttcgtacttcttaccgataacgttcgaaccctaactaaacgttcgtaacgggaacgtacccgggttaaccgaaccggtaacccgtaacccgggaccccttaaacccgtttaagtttagtttcgggaccggtacccgggtaacgttaaaccgttacgtaaccggttaacccgtaaccgttaccttacccggttaaacgtttcccggggggaacgggggttacccggaacggggtaaccccgg

SEQ ID NO: 154909 - DNA, 689 bp, Homo sapiens
  misc_feature: GYAE6OF02HZRJE.10.38.D05.1.454.CMB.1.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (499)..(499): a, c, t, g, unknown or other
  misc_feature (499)..(499): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctctcactcagggcacgagggtcctgggcccagtctgccctgactcagcctcctcgcgtccgggtctcctggacagtcagtcaccatctcctgcactggaaccagcagtntactttgtncttataactatcgtctacctggtaccagccaaccacccgaggaccaaacgacccccaaacttccttttagttttgacggtacaggtaacgccggccctacgacggtacgttcccgtggtaacgttccggttctcgtacgcccttacgaacgtcgtcggaccaaccgccggtccctcccgtgacccgttcgtcgtcgggtacctaccggacggtctagggaggtacgtaggacggtctagtactttaacgtactgacncgtacgctatactacgaccggacccaaggtcgggttcggttacgggaccgggtacgggtaacgtacgggtaccgtacccggttccggtacgggtaccgaacggaccccggtaaggtccccggtaccggttcccccgttacgggtaccttacccgttcccggtttcccggttacccccgtcccttaccccg

SEQ ID NO: 154910 - DNA, 615 bp, Homo sapiens
  misc_feature: GYAE6OF02I9UT9.10.38.D05.1.454.CMB.1.raw
  modified_base (465)..(465): a, c, t, g, unknown or other
  misc_feature (465)..(465): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgtgctatttcaaaaggtgtccactgtgaggttcaactggtggagactggaggaggctggatccagcctgggggtccctgagactctcctgtgcagcctctgggttcagcatcagtaacgactacatcgaccgtcgggccccgccgaggccgtccgaggggaacggggcgtgggaggtgggtctcgagttattagaaacagatggcactacattattattctagactccggtggaacgggtccgttccacccttctacccgagacgtaccacttcccaaataactatccttagtacttcttacactntacgaccataatcgtagagtacgtacggaccaaccgaccggaccctacgttatttacgttggtacgccggtacgtaacctagttaccggaacccttacggaccttaccgtaacggttttccggacccggggggtaccagggggtacccgg

SEQ ID NO: 154911 - DNA, 687 bp, Homo sapiens
  misc_feature: GYAE6OF02FF3AK.10.38.D05.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcacatctctgcactggaaccngcagtnacttttgtcgcttaataactatgtctcctggtaccagcaccacccaggcaacgccccaaactccttgttttgagttcagtaacgcggccctcaggtctccctgacgttcggttctcgtgccctccaagtcgtggacccaacgccggccttccctcggacccgttcgtaccgtcgggccttccgaaggtcctgggaacggacgttggaacggtccttagtaacttaaccgtacgttgacctacgaccgactacgttacgttaccgaaccgggtaccccaaaggttacgggggtttcgtttacggggaccgggtcggtaaacggttaaacgggtccgtaacccggttccggtagggacccgtaacgggaccccggtaaacgggtccctttacccggccccccgttcgggttaaccctaccgttcccgttacccgttacccccgaccccgtttaccccg

SEQ ID NO: 154912 - DNA, 566 bp, Homo sapiens
  misc_feature: GYAE6OF02FG99S.10.38.D05.1.454.CMB.1.raw
  modified_base (250)..(250): a, c, t, g, unknown or other
  misc_feature (250)..(250): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacttttgtgcttanaactatgtctcctgtaccagcaccacccaggcaaacgcccccaaacttcttgttttgaggtcagtaagcggcctcaggagtccctgatcggttctctgcctcaagtctggcaacgcggcctcctgaccgtctctggctccagctgaggtagtgagctgattactacgtgcacgcgcatattcgaggaccccaacgagggttcgtttgggcgggtcggtaacgtaagggtcgacccggttcgtcgggtacacggcccgaaacgggccttccggcccccgttcggtccaccgtccgttcccgtacccctaccctcccc

SEQ ID NO: 154913 - DNA, 514 bp, Homo sapiens
  misc_feature: GYAE6OF02F42BL.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagcctggggggtccctgagactctcctgtgcagcctctgggttcagcatcagtaacgactacatgacctaggcccgccaggctccagggaaggggctggagtgggtctcagttattgaaacagatggcactacatattattctgactccgtgaagggtccgttcaccctctccagacgacacttccaaacaacatcttgtattcttcacatgcacaatctgagagtcgacgacacggccacctattatgtgcgcacatgactacgctacaattcgacggggccagggaccg

SEQ ID NO: 154914 - DNA, 637 bp, Homo sapiens
  misc_feature: GYAE6OF02H437K.10.38.D05.1.454.CMB.1.raw
  modified_base (363)..(363): a, c, t, g, unknown or other
  misc_feature (363)..(363): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactgggaggaggctggatccagccgtggggggtccctgagactctcctgtgcagcctcgtgggttcagcagtcaagtaaccgactacatcgaccgtcgggccccgccgaggccgtaccgaggggagggctgggaggtcggtctctagttatagaaacgngagtcggacaactacatttattattcgtagtacctacggtaggtaacgggtcccgttaccgtacccctcgtacccgaaggtaccgaacctaccttaacccgaaaactacgtaactttccgtttagtacttcctaccaagacttcgaccaactaacgtctaggaagtacgtccgaacgaccgacccgtacctaacgttatttacgttgaccgtcgacgaactgtaacgaccttacggtctacgtaacgttcgggacggggtcccgacggtaccgg

SEQ ID NO: 154915 - DNA, 762 bp, Homo sapiens
  misc_feature: GYAE6OF02H3U1F.10.38.D05.1.454.CMB.1.raw
  modified_base (200)..(200): a, c, t, g, unknown or other
  misc_feature (200)..(200): n is a, c, g, or t
  modified_base (369)..(369): a, c, t, g, unknown or other
  misc_feature (369)..(369): n is a, c, g, or t
  modified_base (526)..(526): a, c, t, g, unknown or other
  misc_feature (526)..(526): n is a, c, g, or t
tcagcatagtagtgcacgaccggtgctcgatttagtatctgatagctgggttttccttgttgctatttcaaaaggtgtccactgtgaggttcaactgggtggagactgggaggaggctggatccagccgtggggggtccctgagactctcctgtgcagcctcgtgggtcagcatcagtaacgctacatgacctgggcccncagggcctccgaagggggacgggctgggagtgggtctctagtttatagaaacagagtggactactacattatttattctcgacgttcggtaggaacgggtccgttccacccttctaccaaggacgtactaaccttaccaaacaactactttcttacgttaattccttanaacctagttcacgtaacctaaatcgtaggtaacggacgtacggaacctaacgaaccggtccctaaacgtttaagtttacgtttcggtcggacgtacgaactagtacgtaccgttacgtctaacgttacgttccgggtacgggtccggacggggaccncccggtaacgggtccctaccggttcccctaccccgaacggtccccctaacccgaaacccggaaccgggtaccccctacgttacccgggtttccccttaccccggtggaccccgcccgttcggccccttaccgggaccggaaccggccccttaaacccgggccgtaaaccgggaccgtacccgaaccgaccgggtcccccggtcccggggttacggtcccgtacccgggttacccgg

SEQ ID NO: 154916 - DNA, 705 bp, Homo sapiens
  misc_feature: GYAE6OF02GL7OO.10.38.D05.1.454.CMB.1.raw
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacagggtcctgggcccagtctgccctgactcagccctcctcgcgtccgggtctcctggacagtcagtcacatctcctgcacgtggaaccngcagtgtacttttgtnacttataactattgtctccgtggtaccacgcaccaccagtacaaacgcccctaaacttccgttgtttgngtacaggtaagccgtcctcgagtacgtcctagacgttccggttctcgtcgcccttcgaacgtcgtacggacctaacgaccggtcccttcccgtacggtaacccgttccgtccggtccgggtaccgtacccgtacgggtccgttaagggacgggtacgtagggtaacggtacgttagtaacgtttaaccgtcgttacggaccgacggtccgtactaattacgttaccgaaccggtaccccgtaacggtaggggttacgtttcggggaccgggtcgggtaaaccggttacggtaccggtaccgttaccggttcgggtacgtaaccggaccgtacgggtccgtaccgtcccggtacgttccgtaccttccgttacccgttccccgtccctaaccccg

SEQ ID NO: 154917 - DNA, 696 bp, Homo sapiens
  misc_feature: GYAE6OF02G47BS.10.38.D05.1.454.CMB.1.raw
  modified_base (404)..(404): a, c, t, g, unknown or other
  misc_feature (404)..(404): n is a, c, g, or t
  modified_base (525)..(525): a, c, t, g, unknown or other
  misc_feature (525)..(525): n is a, c, g, or t
  modified_base (542)..(542): a, c, t, g, unknown or other
  misc_feature (542)..(542): n is a, c, g, or t
tcagcatagtagtgcacgaccggtgctcgatttagtatctgataggttgggtttgggggggagaggagcccagcactgggattccgaggtgtttccattcggtgatcagcactgaacacagaggactcaccatggtagttttggctgagcgttgggttttccttggttgcttatttacaaaaggtgtccactgtgagttcaacgtgggtggagacgtgggagggaggctggactccgagccggtcgggggtccctggacgacctctccgtgtgcacgtccgtcgtgggttcagcagtcaacgtaacgactacagtcgaccgtcgggccccgccgaggtccgtccggaagggggaggggtccgtaggggacggttcgggtcctagtaggtttagtacgaaaacgngtaagtcggactaactataagttattacgtcgtacgtaccgttcggagggtaccgggtcccgttcaccctgtaccgagtacgacctacgtacccaaagactagttcttacgtattccgtanaactagtccactaaacncgttcgagtacggacgtaccgaacccgggactacccggttaacctaaccgttatttaccggttcgacgggtacccgtactaacggactttacgaccgtaacctccgtttacgtaaccgttcgggggtaaaccgggccggttaaacggtccccgg

SEQ ID NO: 154918 - DNA, 758 bp, Homo sapiens
  misc_feature: GYAE6OF02IFB86.10.38.D05.1.454.CMB.1.raw
  modified_base (324)..(324): a, c, t, g, unknown or other
  misc_feature (324)..(324): n is a, c, g, or t
  modified_base (536)..(536): a, c, t, g, unknown or other
  misc_feature (536)..(536): n is a, c, g, or t
tcagcatagtagtgcacgaccggtgctcgatttagtatctgatagttgggtttggggggaggaggagcccagcactgggattccgaggtgtttccattcggtgatcagcactgaacacagaggactcaccatggtagtttggctgagcgttggttttccttgttgtctatttacaaaggtgtccactgtgaggtcaacgtggtggagacgtgggaggaggcgtggatccgacgccggtcgggggtccctggagacctctcctgtgacgcgtccgtcgttgggtcagcatcgaacgtaacgactacagtcgaccgtccgggcccnccgaggcctaccggaaggggagggcgtgggacggtggtctctaaggttattacgaaacgtagaagtcggactacgtaacatttaacttacttccgtagtaccgttacccgggtagggtaaccggggtcccgtttaccaaccccgttcgtacccgagtaaacgtacctacccttaaccgaaaactaactacgttcgtttacgaattcccttanaactacgttacgaccaaaccttaaagtcccgtaagggtaacgtacgggtaacccgtaaccggacctaacccgggtacccttaaaccgttttaatttaaccgtcgggttaccgaccggaacccgtaacgtcgttaaaccggtaaccccgttaccgacccttttaaaccggtacggtttaacccgggggtcggggaaacccccgggttaaggtaaccccccggg

SEQ ID NO: 154919 - DNA, 741 bp, Homo sapiens
  misc_feature: GYAE6OF02HSVP2.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttacaaaaggtgtccactgtgaggttcaacgtggtggagacgtggaggaggctggactccgacgccggtgggggtccctgacgactctcctgtcgcagccttcgtgggttcaggctaatccgaagtaacgtaacctacagtcggaccgtcgggaccccgccgacggtccgtaccggaaggggaagggtccgtaggggtacggttcgggtcgttacgtaacgtttagttaacgaaactaggtagtcggactaacgtactaatttactttacttctacgtaccttaccgggtacgggaaaccggggtcccggtttaccacccgttaccgtacccgtaaacggtaaaccgtaaacccttaaccaaaaccgtaactaacgttttacgttcgtaacctttaccttaccgtaactacgtacgacctaaacgttagtaccgtaggaacgtacggtacgaacccggaactacccgggtaccctaacgttacgttattcggtagtaccggtactaaccgactacggtacctacgtccttacgtaagttcccgggtacgggtacccggtaagggtaacccccg

SEQ ID NO: 154920 - DNA, 650 bp, Homo sapiens
  misc_feature: GYAE6OF02G9KB4.10.38.D05.1.454.CMB.1.raw
  modified_base (359)..(359): a, c, t, g, unknown or other
  misc_feature (359)..(359): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggagaggctggatccagccgtgggggtccctgacgactctcctgtgcagcctcgtgggttcagcatcagtaaccgactacatcgaccgtcggcccgccacggctaccgaggggaagggcgtggaggtgggtcctgtacgttagtagaaacngatcggacactacattattattcgtagtacctcggtaggaacggggtccgttacctaccctcgtcccaagggtacaccctaacctttaccccgaaaacaaacctaagttcctttagtacgttactttaccactagtcacaactaaactcgtagaacggtcgtacgaacccgtaaccgaccggtaccctaaccgttaatttattacggtccggaccggtacgtaaccagtaccggtaccttaaccggactttaccgtaaacgtttccggacgggggaccgtacggggacccg

SEQ ID NO: 154921 - DNA, 707 bp, Homo sapiens
  misc_feature: GYAE6OF02J1BHN.10.38.D05.1.454.CMB.1.raw
tcagcatagtagtgcacgaccggtgctcgatttagtatctgatagttgggtttggaggctctgctcctcctcaccctcctcactcagggcacagggtcctgggcccagtctgccctgactcagcctcctccgcgtccgggtctcctggacagtcagtcactatctcctgcactcggaaccagcagtgactttgttgcttaactaactatgtctctggtacacgcaccaccaggaccaaacgacccctaaactcctttgttttaggacgtacagtaacggccggccctcgagggactcccgtggtacgttcggttactcgtcggtccctacgaacgtcgtcggacaaaccgccggtcccttccccgtacggaccccgttcgtacggtcgggccccttacggacggtccgtacgggagtacgtcggtacggctaggtacttacacgtcgacgtgacctctattcgtaaccgaccggaccccgtaaggtcgggtttagggtccgggacgggtacgggtaactacggggtacctacccggttcggttcgggaccgaacggtacccggacgggtcccttcccggaccccggttctaccccgtcgttccgtccccgtttccccgcccgtaccgttcccactttaacggtcttcgggtacctggggtacccggccggttacgacgggtaccgggacgttaccgatacggacgtg

SEQ ID NO: 154922 - DNA, 907 bp, Homo sapiens
  misc_feature: GYAE6OF02J1YNP.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctggagtcgttgggtttttccttgttcgcttactttacgaaaggtgtcctactgttggtacggttactaacgtgggtaggacggtacgtagggagggacggtcgtgggacttccgacggtcccgggttcgggggggttcccctaggacgtaccttccttcccgttggtcgtccgacgtccgtcggttcgggttccgagacctacgttaccgaacggttaaaccgaaccttaacgtacgtaccggcccggtttccggggcccccgaccggtacggaccggtccgggaaggggggaccggggtcggtacggggtcgggtttcgggtaccgtacgttaacgtttacgttaacggaaaacggtacgacgtacggtaaccctacgtaattactttaacgtttacttcggttaaccgtaccggtttaccgggtacggggttaacccgggttcccggtttaccctaccccgttaccgtaccgtaaacggtacccgtaacctaaccccctttaacccgaaaccttaacgttaccgtttaacgtttacgttacccttttacctaccttaaccggtacttacgaaccctaagttaaacccgtcggtaacgaccgggttaccgttaaccggacccgtaccgtaaccccggactttaccggttaattccgggttcggacccggtaccgaacgtacctacgtaacggttaccccgtacgttaccggttacctacgggtttacccggggtacccggggaccggtaaccggtaccccgg

SEQ ID NO: 154923 - DNA, 687 bp, Homo sapiens
  misc_feature: GYAE6OF02H9IIV.10.38.D05.1.454.CMB.1.raw
  modified_base (471)..(471): a, c, t, g, unknown or other
  misc_feature (471)..(471): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctcctgcactggaaccagcagtgtacttttgtgcttataactatgtctctgtaccagcaccaccagacaaacgacccctaaatcctttgtttttagagttacagtaacgccggccctgacggacgtcccgtgacgttcggttctcgtcgcctcaagtcgtcggacaacgtaccggcccttccgacgtacccgttcgtcgtcgggtcctaccgacggtcgttggacgggtataggagtcgtagtaacttaacgttacncggtacacggaccgtactattacgttcgaaccgggtaccccgtaacggtacggggttacggttttcgggaccggggtacgggtaacgtaacgggtccggtacccgttaccggttcgggtacccgtacggaccccgtaaggtccccgttcccgtacccccggttgttacccgtacccggtttaccgttcccgtttaccccccggtcccttaccccgg

SEQ ID NO: 154924 - DNA, 615 bp, Homo sapiens
  misc_feature: GYAE6OF02F9AW4.10.38.D05.1.454.CMB.1.raw
  modified_base (373)..(373): a, c, t, g, unknown or other
  misc_feature (373)..(373): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtgggaggaggctggatccgagccgtcgggggtccctggacgactctcctgtgcacgccgtcgtcgggttcagcatacagtaacgactacagtcgaccgtcgggcccgccgacggctaccggaggggaacgggcgtgggaggtgggtctcgtagttatagaaacngatggacactactattattacttctagtacgtccgtaggacgggtccgttaccaccgtcgtacagacacctacctaccgaaacaactagttccttagtacttctacgactagtcgacctaataacgtctagacgtacgtacgaaccgacgacccggaccttaactagtttatcggtacgaccgtcgaactagtccgaacctacgtcttaacgtaagttccgggacgggaccgaacgggcccg

SEQ ID NO: 154925 - DNA, 690 bp, Homo sapiens
  misc_feature: GYAE6OF02FROPK.10.38.D05.1.454.CMB.1.raw
  modified_base (280)..(280): a, c, t, g, unknown or other
  misc_feature (280)..(280): n is a, c, g, or t
  modified_base (454)..(454): a, c, t, g, unknown or other
  misc_feature (454)..(454): n is a, c, g, or t
tcagcatagtagtgcacgaccggtgctcgatttagtatctgataggttggggtttgggggggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcagtcaccattcctcctgcacgtcggaaccagcagtgtacttttgtgacttaataactatgtcctcgtggtacncgccaccaccgaggacaaccgaccccaacttcctttgttttagacggtcaaggtacgccggtcctacgacggtacgtccgtcgtacgttcgttctccgtcgtccctaccgtaacgttcgtacggaccaaccgaccggtcccttccctacggtacccgtctcgtcggcctaccgnggctaggaggacgtggacgtctagtacttacgtacgtgcgagcactactacgttacgaccgaccgtaagggttcgggttcggttccggggacgggtacgggtaacgtaacgggttaccggtaccggtccgggtacgggtaccgaaccggtacccggtaaccgggtccgttaccccggttcccccgtacgggtacccgtacccgttccgttaccccgttaccccctccccgtacccc

SEQ ID NO: 154926 - DNA, 670 bp, Homo sapiens
  misc_feature: GYAE6OF02J15RO.10.38.D05.1.454.CMB.1.raw
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctctggtaccngcaccaccaggcaaacgcccccaaatccttagttttcgagtcagtagcggccctnaggtactcctagacgtcggttctctcgccctcgaagtctggaccaacgaccggcctccctcgaccgttacctcgttcggggcctccgaggcctacggaggtacgtcggaaggtcctaggtactttacgaacgtgaccgagacgtctaatacgttcgaccggacccgtaaacggtcgggttacggttcgggacgggtacgggtaacgtacgggtcgtaccggtcggtgggtaccgacgacccgaaggtaccgtcgtcccccgtcggtacctaaccggttccgttccgtacccccggtcccttaccgtcccttacgttaccctagtccggtaccgtaggtaccggtaccgggccgttacggaccggtacggggacctaccggacgttagtccgtacg

SEQ ID NO: 154927 - DNA, 626 bp, Homo sapiens
  misc_feature: GYAE6OF02FG2TF.10.38.D05.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (326)..(326): a, c, t, g, unknown or other
  misc_feature (326)..(326): n is a, c, g, or t
  modified_base (471)..(471): a, c, t, g, unknown or other
  misc_feature (471)..(471): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacttttgtgcttanaactatgctctggtaccagccaccacccaggcaaacgcccccaaatccttgttttgaggttacagtaacgcggccctnaggatccctgactcggttctctcgcctccaagtctaggcaacgccggcctcccgtgacccgtctcgtcgggactccgaggctggacggatcggagtcgtagacttactacgtgcagccgactatacgttcgaaccggcccaacgngggtttacggttcggcggggtacggtaacggttaagggtcgtaacccggttcgtacggggtaccgtaacggtaccgaaacgggtccgttacccggtccccccggttcggttaccctaccgttcccgttcccggttcccccgtaccccttaccccg

SEQ ID NO: 154928 - DNA, 798 bp, Homo sapiens
  misc_feature: GYAE6OF02IKXG6.10.38.D05.1.454.CMB.1.raw
tcagcatagtagtgcacgaccggtgctcgatttagtatctgatagctgggttttccttgttgctatttcaaaaggtgtccactgtgaggttcaactggtggagactggaggaggctggatccagccgtggggggtccctgagactctcctgtgcagcctcgtgggttcagcatcagtaacgactacatgacctcgggccccgccgagggcctaccgaagggggaacgggggcgtgggtagggttggggtccttacgtaaggtttaattacggaaaacgaggtagtacgggctaactactaattaatttatttcgtacggtacctaccggtagggaaacgggggttcccggttaccaccccgttcctacccgaaggtaccgaacctaacctttacccaaaaccgaactacgtttactttgtaaacttccgttaaccacctattacgacctaactaagttctaggtaaaggtaccggtacggaaccgaaccgtaccggaccctaaccgttactttagtttacggtcgaccggtaccgaactagtacgtaacttaccggcttaacgtaacgttcggtacgggggtaccggtacgggaccgtacccggtacggtacccgtacccgtcccgtaccccgtaccgccctacccgaaccgaacccgggaccctacggttacccggttcccgtttccccgtacggcccgtcccgtcgtacccgtacgacggacccgtaccgacccgttaccggacgtaccgaccgaccggacggcccggtaccggtccggtccggtacggtacccgg

SEQ ID NO: 154929 - DNA, 751 bp, Homo sapiens
  misc_feature: GYAE6OF02JJOT0.10.38.D05.1.454.CMB.1.raw
  modified_base (398)..(398): a, c, t, g, unknown or other
  misc_feature (398)..(398): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccggtctcctggacagtcagtccaccatctcctgcactggaaccagcagtgactttgtgctataactatgtctccgtggtaccagcaaccacccaggcaaacgaccccctaaacttccttgttttgacggtcagtaacgccggtcccctagaggacgttccctggtactccggttctcgtcgcccgtaccgaattcgtagccaaactaccggtccctcctacgaccgttcctcggtcggcctacgaggccttaggacggtanggacgtcgtacgtaattaaccgtactcggacnggtccncttaaacgtacgttaccggaccggtacccgtaaacggtacggggtttcggttacgggaccgggtacgggtaaccgtaacgggtaccggtaccgttaccggttcgggtaccacccggggtaacccgtaccgggtcgtaccccgggtacccccttaccgggttccgtaaacccgttccgttaccccgtttcccccgtaaaccccgtccccgttaccccgtaactttacccgtacgttaccggtacgtaccgggtaacggggtccgggttacgtacccgggaggtaccgggtaacccgtaccgtagtaccggtagtcg

SEQ ID NO: 154930 - DNA, 751 bp, Homo sapiens
  misc_feature: GYAE6OF02JLYGN.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagtttggctgagctgggtttccttgttgctattcaaaaggtgtccactgtgaggttcaactggtggagactggaggaggctggactccgagccggtggggggtcccctgacgactccgtcctggtcgacacgccgttcgtcgggttcagctatcaaggtaacgactacagtcgaccgtcgggccccgcgacggccgtaccggaaggggaacggggcgtagggacggtcgggtcctcggtagttagttacggaaaacgtggtaactcgggactaacgtactaagtttacttacgttcgtactaaccgtccgtacgggacgggttcccgtacacccgtccgtacgtacggaactacccgtaaccttacccgaaaacgtaaccttacgtccgttacgtaacgttaccttaccgtaaccgtgtacgtaacccgaacttaaccgttaccggttaaggacgggttaaaccggtacccggaaacgggttaacccggtaaccggtacccgtttaaaccgttagtttaccggttacgttacggacccggttaaccgacgttacgtaccgtaaccgtaaccgttacgtaacctcgttaccgggtacgggaccgacccgtaacccggg

SEQ ID NO: 154931 - DNA, 591 bp, Homo sapiens
  misc_feature: GYAE6OF02FMSCU.10.38.D05.1.454.CMB.1.raw
  modified_base (228)..(228): a, c, t, g, unknown or other
  misc_feature (228)..(228): n is a, c, g, or t
  modified_base (404)..(404): a, c, t, g, unknown or other
  misc_feature (404)..(404): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggaaccngcagtgactttgtgcttataactatgtctctggtaccagccaccacccaggacaacgccccaaactccttgttttgaggtcagtaacgcggccctcaggacgtccctgatcggttctctgccctccaagtctggacaacgacggccctccctcgacccgtctcgtcgggcctccgnggctggaggtagtggaggtcttaggaactttactacgtgcgacgcactatacttcacgggccccaacgtgggttcggtttcgggccgggcgggtaacgtaagggtcgtaccgttccgtgggtcgaacggcccgtaaggccgtccgcccccgtggtacctacgttcctccgttccccgcccttacccg

SEQ ID NO: 154932 - DNA, 640 bp, Homo sapiens
  misc_feature: GYAE6OF02F2HDO.10.38.D05.1.454.CMB.1.raw
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgtacttttgtgacttaataactatgtctctggtaccagcaccaccagacaacgccccaactcttgtttgagtcagtacgcgcctnagctcctgntcgtctctcgcctcagtctcgacaacgccgcctcccgtagaccgtctcgtggctccgaggtctaggagtatggacgtctagtaacttactacgtgactagccgtactaattaccgttaccgaaccggacccctaaacggtaggggttcggtttacgggccggggtacgggaaaccgttaacgggtccgtaacccggttccggtacgggtaccgaaccggaacccggtaaacgggtcccttaccccgggtacccccttccgggttaccacccggtttcccgtttaccccgttaccccccgtaccccttaccccg

SEQ ID NO: 154933 - DNA, 800 bp, Homo sapiens
  misc_feature: GYAE6OF02J3K1T.10.38.D05.1.454.CMB.1.raw
  modified_base (146)..(146): a, c, t, g, unknown or other
  misc_feature (146)..(146): n is a, c, g, or t
  modified_base (351)..(351): a, c, t, g, unknown or other
  misc_feature (351)..(351): n is a, c, g, or t
  modified_base (645)..(645): a, c, t, g, unknown or other
  misc_feature (645)..(645): n is a, c, g, or t
tcagcatagtagtgcacgaccggtgctcgatttagtatctgataggttgggtttgggggagaggagcccagcactcgggattccgaggtgtttccagttcggtgatcagcactgaacacagagacctcaccatggtagtttgctgngtcgttggtttttcctgttcgctacgtttacgaaaggtcgtacacgtgtgtacggttctaacgtggtcggagtacgtgggaggacggccgtggactccgaggccgtcggggtcctgacgtcctcgtccgtgtcgccacgtccgtcgttacggtcacgctactacgaacgtaccacttacgacgtaccgtaccggtccggaccccncggtaccgtcgacggggagggtaacgggtcgtagggtaccggttggtacctaacggtttagttacgttacgaacgtacgacggtacctacgtactacttagtttacttacgtcgtacgtacccgttcggaccggtacggtccctaccgtaacccgtcgtaaccggtacgaaccgttacccgtaaaaccttcccaaaaacgttcttaacctttcgtaacgtttaccttcggttaaacccttcgaacgtacgttacccaagtttaaccgtcgaacgtacggtaacacccggaaacncccgggtaaaccttcggttaaacccgttacgttcgggtacccctaggtaccccgtacccgttataaccccgttaccggaaaccccgttcggtacccgttaacggtttccccggttaccggggaaccggttaccccggggaccgttaacccccggg

SEQ ID NO: 154934 - DNA, 616 bp, Homo sapiens
  misc_feature: GYAE6OF02HQPRY.10.38.D05.1.454.CMB.1.raw
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
  modified_base (496)..(496): a, c, t, g, unknown or other
  misc_feature (496)..(496): n is a, c, g, or t
  modified_base (556)..(556): a, c, t, g, unknown or other
  misc_feature (556)..(556): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctggttttccttgttgctatttacaaaggtgtccactgtgtaggttcaactggtggagacgtgggaggaggctggatccgaggccgtcgggggtcctgagactctcctgtgcacgcctcgtggttcagcatacgagtaacactanatcgaccgcgggcccgccgaggaccgtccggaaggggacgggtcgtgggagttcggtntacgtagtttagtagaaacaggtagtgactactactattattagttcgtacgaacgttcggacggtaacggtccgttacccaccctcgtacccgagacgaacctaccgttaaccaaacgtactacttacgtttagtacttcctaacngtactgactaacatcgtagagtacgtcgaaccgaaccgcgtaaccagttactagtcgtancgacactactcgtaccacgtaccttacgtacgtaccggtacgggacccgtagggtacccg

SEQ ID NO: 154935 - DNA, 682 bp, Homo sapiens
  misc_feature: GYAE6OF02GXGNS.10.38.D05.1.454.CMB.1.raw
  modified_base (237)..(237): a, c, t, g, unknown or other
  misc_feature (237)..(237): n is a, c, g, or t
  modified_base (343)..(343): a, c, t, g, unknown or other
  misc_feature (343)..(343): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacagtcagtccacatctcctgcactggaaccagctagtntactttgtgcttataactatgtctctgtaccagccaccaccagaccaaacgcccctaattcctttgtttagacgtcaagtacgcgcctgagctcctgacgtcgtcnctcgcctactacgtctacgacaacgccgtccctaccgtcgtaccgtctcgtcggcctacggacggtcgtaggtaacggacgtaggacggtactaggtaaccttacgtcgttacgacgacggtccgtactacgtttacgttaccgaacccggtacccccgaaaggtttacgggggtttcgggtttacgggaccgggttacggggtaacgtttaaacgggtccggtacccggttaccgggtgggtacccgaacggtaccccggtaagggccctaccccggtaccccgttccgggttacctacccgtttccccgttaccgttcccccgtaccccgttccccg

SEQ ID NO: 154936 - DNA, 712 bp, Homo sapiens
  misc_feature: GYAE6OF02HORNQ.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcagcctccctccgcgtccggtctcgtggacagtcagtcaccatctcctgcacgtacggaaccagctagtgtacttttgtacgtacttaataactatcgtctccgtaggtaccagccaaccaccgaggacaaaccgacccctaaacttcgtttgttttacggacggtacaaggtaacgccggtacctagacggtacgtccgtaggtacgttcggttcctcgtccgcccttacgtaacgtcgtacgacgtaaccgaccggtcctacccgtacgtacccgttcgtcggtcggtaccctacggtaacggtcgtacggaggagtaggacgttacgtaacgtaacttacgtagtcgacgacgtacgtactaacttcgtaaccgaccgtaccgtaaggttggggttacggtcgggacggtaaccggtaacggtacggtaccgtccggttacggtacggtaccgaaccggtccgaaggtccccgttacccggaccccggttacgttcctaccggtttacccgtcccggtttacccccgcccgtttacccg

SEQ ID NO: 154937 - DNA, 787 bp, Homo sapiens
  misc_feature: GYAE6OF02HXSWU.10.38.D05.1.454.CMB.1.raw
  modified_base (216)..(216): a, c, t, g, unknown or other
  misc_feature (216)..(216): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcgagggcactagggtcctgggcccagtctgccctgactcagcctccctcgcggtccgggtctcctggacagtcagtcacatctcngcactaggaccagcagtgtattttgtgtacttagtaactagtcgtaccttccgtaggtaccacaccaacccctaaccgacgggtaaccaaacccggtacccccttaaaacgtttcccgttttaggttttttacggacgggttactaacggtaacgtccggccctacgacggtactcccgtaggacgtttcggttcctcgttaccgcccgtacgtaagtcgtcggtaccgaaccaccgggtcccttaccgtcgacccggttcgacgtcggggtccctaccggtcggtactgggtagtaacggtcggtaacggtgtaaacgttaccgtttacgtaactccgggtacgtacgaccgtacttacgtaaccgttccgggaaccgtaacccggttaaggtacggggttttccgggtcggggtaaccggggtacggttaacgttaacgggcccgttaaccggttccgggttacgggtacccgtaccggtaccccggtaaaggtccccgtttcccggaaccccggttcggttacccgaaccttttcccggttcccgtccccccgttaccccgttacccc

SEQ ID NO: 154938 - DNA, 801 bp, Homo sapiens
  misc_feature: GYAE6OF02IJB6Q.10.38.D05.1.454.CMB.1.raw
  modified_base (219)..(219): a, c, t, g, unknown or other
  misc_feature (219)..(219): n is a, c, g, or t
tcagcatagtagtgcacgaccggtgctcgatttagtatctgatagttgggtttggggggggtctcaggaggcagcgctctcaggacgtcaccaccatggcctgggctctgcctcctcctcaccctcctcactcagggcacagggtcctgggcccagtctcgccctgactcacgcctccctccgcgtccggtctcctggacagtcagtcaccattctctncacgtcggaaccagctagtgtacttttgtcgacttaataacttatgtcctccgtaggtaccagaccacccacccgagaaccaaaacccgccccctaaaacgttcccgttttggtttttacggacggttacctaaggtaacggcccggtccctaggacggtacgttccctagtcgttccggttctccgtcgtaccctacgtaacggttcgtacggaccaacggaccggtcccctaccgtacgtacccgtccgttcggtacgggtaccctccggtacggtacgtagggtaaggtactacggggtaacggtccgttaggttaacctttaccgtaacgttcggaaccgtcggtaacctcgttaaacttaccggtaacggaaccccggtaacccgtaacggggttaggggttttacgggttaccggggacccgggttacggggtaaaccgttacggggttacccggtaccggttccggcgggttaacccggaacggtaccccggaacgggtacccttccccggtacccccgttacgggtacccttaccgttccccggtaccccgtttaccccctaccccttaccccg

SEQ ID NO: 154939 - DNA, 705 bp, Homo sapiens
  misc_feature: GYAE6OF02H3YC3.10.38.D05.1.454.CMB.1.raw
  modified_base (232)..(232): a, c, t, g, unknown or other
  misc_feature (232)..(232): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacgagggtcctgggcccagtctgccctgactcacgccctccctccgcgtccgggtctcgtggacagtcagtcaccatcctctgctactaggaaccngctagtgtacttttgtgtacttaataactatcgtctcgtgtaccagaccacctaccgacggaccaaaccgtaccccctaaattcccgttttaggttttacgacggttacaagttaaccgccggtccctagcgggtaactcccgtaggactttcgggttacctcgtccgtacccttacgtaacgtctaggaacctaacgaccgtcctacccgtcgaccgttctacgtcggtacctcgtaggcgtaggtaacggngtaggacgtnttacgtaattacgtcgtgtacgtacgcctataactacgttaccgacccggtaacccgtaaggtggggttacggttacgggacggggtacgggtaaacgtacgggtaccgtaccgtacggttacgggacctaacgggaccctaagggtccctacccggccccgttacggtaccctaccgttacccgttaccctcccccgtaaccgttaccc

SEQ ID NO: 154940 - DNA, 636 bp, Homo sapiens
  misc_feature: GYAE6OF02IFS0W.10.38.D05.1.454.CMB.1.raw
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactcggaaccngctagtgacttttgtgcttataactatntctcctgtaccagccaccacccagacaaacgacccctaaactccgtttagtttttgacggttcaaggtacgccgcctcgaggtacgtcctgactcggttctctgtccctcaagtcgtggacaacaccggtcctacccgtcgaccgtctcgtcggcctccgagtctggagatggacgtcgtagtacttactacgtgacgcggccgtactataacgttcgaaccggtacccaaacgggtggggtttcggttcggggacgggtaccggggtaacgtacgggtaccgtaccggtcgttacgggtaccgaacggtacccgaacggtccctacccggcccccgttcggtcctaccgttcccgttaccgttccccgtccccttaccccg

SEQ ID NO: 154941 - DNA, 725 bp, Homo sapiens
  misc_feature: GYAE6OF02I4ZSA.10.38.D05.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctcctcactcagggcacagggtcctgggcccagtctcgccctgactcacgcctccctccgcgtccgggtctcctggacagtcagtcaccatctcctgcactggaaccngcagtgacttttgtncttataactatgtctctggtaccagcaccacccaggaccaaaacgcccccctaaaactttccctttggtttttcgacggttccaaggttaacggccggccccttacgaggtacgtccctggacgtttcgttctctcgcctcaagtcgtggacaacgtaccgcctcccgtcgaccgttctcgtcgggccttccgaaggtcctaggaggtgtacggtacggaccgttagtacttacgtacgttcggactacggccgtacttaactacgttaccgaaccgggtaccccctaagggtaccggggtttgttacggggccgggtacggggttaaacgtaaacgggttccgggtaacccggttccggtacgggttacccgaccgggtaacccggtaacgggtccccgttccccgggacccccgtttaccgggtcccgtaccccgtttcccggtttaccccggttcccccccggtccccttacccccg

SEQ ID NO: 154942 - DNA, 679 bp, Homo sapiens
  misc_feature: GYAE6OF02FS31R.10.38.D05.1.454.CMB.1.raw
  modified_base (298)..(298): a, c, t, g, unknown or other
  misc_feature (298)..(298): n is a, c, g, or t
  modified_base (620)..(620): a, c, t, g, unknown or other
  misc_feature (620)..(620): n is a, c, g, or t
  modified_base (632)..(632): a, c, t, g, unknown or other
  misc_feature (632)..(632): n is a, c, g, or t
  modified_base (638)..(638): a, c, t, g, unknown or other
  misc_feature (638)..(638): n is a, c, g, or t
  modified_base (665)..(665): a, c, t, g, unknown or other
  misc_feature (665)..(665): n is a, c, g, or t
  modified_base (668)..(668): a, c, t, g, unknown or other
  misc_feature (668)..(668): n is a, c, g, or t
  modified_base (670)..(670): a, c, t, g, unknown or other
  misc_feature (670)..(670): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
tcagcatagtagtgcacgaccggtgctcgatttagtatctgatagttggggtttgggggctttgcctgggtctcctggacagtcagtcaccatctcctgcactggaaccagcagtgtactttgttgcttataactatgtcctcctcggtaccagccaccacccgaggccaaacgcccccaaactccttgttttgacggtcagtaacgccgtccctcacggacgttccctgattccggttctctcgcctccaagtcctggccaacgcggcctcccgtgacccgtctctgggccttccgnggctgaggtatgaggtctagtaattacctacgtgcgtagccgtactagtactttcgaccggtacccctaaggtcggttcggtttgggccgggtacggtacgttaacggtctaccccggttccgtacgggtaccacggaccccggtaagtcctccccggtacccccgtcgggtaccctaaccgttccgttacccgttcccccgtacccctcccgtaccccaccgttaccgttaccgtcgtaccggtacggtaccgggtcggtaccgttccggaaccggtaacggcccggtacgaacgttacggacgtctacggtctcgtaacncggtcacggtcncgtagngtactgtccgtaagctacgctcgtacncgncncgncncncg

SEQ ID NO: 154943 - DNA, 657 bp, Homo sapiens
  misc_feature: GYAE6OF02G3NOF.10.38.D05.1.454.CMB.1.raw
  modified_base (255)..(255): a, c, t, g, unknown or other
  misc_feature (255)..(255): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcacatggagttttggctgagctgggttttccttgttgctattcaaaaggtgtccactgtgaggttcaacgtggtggagactggagggaggctggactccagccgtggggggtccctgacgactctcctgncgagcctcgtggtcagcatcagtaacgactacatcgaccgtcgggcccgccgacggccgtccggaggggaggggtctgggtaggtcggtctcgtagttatagaaacagagtggactactactattattattctacgtctacggtacggtacgggtcccggttcccacccgttccaccaagtacgacctaccttaccaaactactactcgtttattactcttacacgtactcgacctaactaacgttcgaggtacgtacggtaccgaaccgtaaccgacccggtaaccaccgtttaactttagttaccggtacgtcggaaccgtaacctacggtttaacgaaccccttacggttaccctaaccgtaccgttttccgggaccgggggtacccgtaacccggggg

SEQ ID NO: 154944 - DNA, 697 bp, Homo sapiens
  misc_feature: GYAE6OF02JCZQZ.10.38.D05.1.454.CMB.1.raw
  modified_base (429)..(429): a, c, t, g, unknown or other
  misc_feature (429)..(429): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgtacttttgtgctttataactatgtctcctggtaccagccaccacccaggacaaacgacccctaaacttcctttgttttcgaggtcagtacgccggcctgacggacgtccctgtacttcggttctcgtcgcctacgtagtcgtacggactaacgccggccctccgtcgacccgttctccgtacgggccttaccgnggtcgtggaacggagtcgggagtcgttacgtaacttacctacgtcgacgacgcgtacgtacttacgttacccgaaccgtaccccgtaaagggttacgggtttcggtttacggggacccgggttacggggtaacgttaacggggtccggttaacccggtcggttaccgggtccgaacccggaccggtaacgggttcccgtacccgggtccccgttaccggttccgaacccgtttcccgttccccgttaccccccgtaccctttaccccg

SEQ ID NO: 154945 - DNA, 716 bp, Homo sapiens
  misc_feature: GYAE6OF02HGII5.10.38.D05.1.454.CMB.1.raw
  modified_base (711)..(711): a, c, t, g, unknown or other
  misc_feature (711)..(711): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggacaaacgcccccaaatccttgttttgaggtcagtaagccggccctgaggtacgtccctgactcggttctctcgcctcagtctggcacgacgcctcctgaccgtctcgtcggctccgaggcgtacggaggtactggacggtctaggtaactttacgtaactggacacggccgactaacgttacgttaccgaccgggtacccccgtaaacggtaggggtttcgggtttcggggaccggggtaccggggtaacgttaacggggtccggttacccgggttccggttacggggtaccgaacgacccggtaacgggtcccgttacccgggtccccccgttcgggtaccctaccgttcccgttaccccgtttcccccgtaccccgttcccgtaccctacccgttaccttaacgtccggtccggttacggaccgggtccgggtaccgttacgggaccggtaacgggccgtaaccgtacggttacgngtacg

SEQ ID NO: 154946 - DNA, 805 bp, Homo sapiens
  misc_feature: GYAE6OF02F4XK7.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcactctgcagtgtcagtgtccaggcagggctgactcacgccaccctcggtactccgaacggacttggagacacgaccgccacacctccacctgaccacgtagggaacaacgaactaatggtacggacccgacgacggtacggtcggtttaggctaggcaacggcacgaccaacccgtacggggaccccctacccgtaccccgaaacggcccttaccctccgtacccggaccgaaggaaacctaaccgacctccccggccctacggaacgggtactaccgtacgaaggtagaacgtaacgttcctacgttacggcctaacgttcccgtaacgggttacggaacgggtaaacgcccgtaaccgtaccggtaccccgttaccccgtaccggtaaccccgttaacgtttaacccgtacggttacccgtaaccgtacgggttaccggtaacgggtaaccgaaacggtacggttacgttaacgttaaccttttaacgtttacgtaccgtaccgtaacgtcgtaacgtacgggtaccggtaccggtacccgtacgttacgtagttccgttacggggtttacgggtttaccggggtccggggtaacggtaaccgtaccggtaacgtaccgggttacccgtaccgggttacggaacccgtccggaccggtacccggtccccgg

SEQ ID NO: 154947 - DNA, 682 bp, Homo sapiens
  misc_feature: GYAE6OF02IE98X.10.38.D05.1.454.CMB.1.raw
  modified_base (402)..(402): a, c, t, g, unknown or other
  misc_feature (402)..(402): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccagtggtagttttggctgagtcttgggttttccttgttgctatttacaaaaggtgtccactgtgtaggttcaacgtggtggagacgtgggaggaggcgtggactccgaggccgtcggggggtccctgacgtactccgtcgtcgtgcacgtccttcgtcggttcaacgctatcaagtaacactacagtcgaccgtcgggccccgcgacggtctacggaggggtacgggcgtgggaggtggtctgtagttatgaacagagtgacacgtacattattntcgtacgtactcggtacggtacggtccgttccacctcgtacagtactactacccgtacaaacatacttcgttagtaccttcgttacaatacgtcgactaaacgtacttcgagacgtaacgtcgaacgtaaccgtacccgttacccgtaaactttaacgtttagttaccgggccgtaaccgtacccgtaaacggttacgtacccggttaacttcccggtacttaaccggtttaaacggtttcccgggggtaaccggggacccggtaccgggtaaccccggg

SEQ ID NO: 154948 - DNA, 727 bp, Homo sapiens
  misc_feature: GYAE6OF02HIP0F.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcggtccggtctcctggacagtcagtcaccatctcctgcactggaaccagcagtgtacttttgtgtcttataactatcgtctcctggtaccagccacccaccaggacaaacgccccaaactcctttgtttcgaggtcagtaacggcgtcctcgagacgtcctagacgttcggtctctcgtccctaccgaagtccgtacggaccaacgaccggtccctcccgtcgtacccgtctcgtcggcctccgaggtctaggagtacgtaggtacggtcgttacgtaacgttactaacggttcgacgacggtacgactacgtaacgtttaccgaacccgggtaacccccgtaagggtaccggggtttcgggtttacgggggacccgggtaccggggtaaacggtttaaccggggttccggtaccccgggtttccggttacggggtaacccgtaccgggaccccggtaacgggtcccgttaccccgggtcccccggttacgggtacccgtacccgtttcccgtttccccggtttacccccaccccgtttacccccg

SEQ ID NO: 154949 - DNA, 632 bp, Homo sapiens
  misc_feature: GYAE6OF02GTTFP.10.38.D05.1.454.CMB.1.raw
  modified_base (427)..(427): a, c, t, g, unknown or other
  misc_feature (427)..(427): n is a, c, g, or t
tcagcatagtagtgcacgaccggtgctcgatttagtatctgatagttgggtttgggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggaggctggatccgagccgtcgggggtccctggacgactctcctgtgcacgcctcgtgggttcagcatacaagtaacgactacagtcgaccgtcggcccgccgacggccgtacggagggagggcgtggaggtggtctacgtagttatacgaacagagtcgactactactattacttacgttcgtacgtacgtcggtacggtacggtcccgttaccncccgttcaccgagaaccgtacctaccgttacccaaactacctagttcgttagtacttctaccaactgacgacctaagtacctggtaacgacggtaacgtccggaactccgaaccggtaccttacgtttatcggtgtccgaaccgcgtaaccttaggtcgtaaccgtacgtctaacgtacggtccgggccggacggtaccggcccg

SEQ ID NO: 154950 - DNA, 770 bp, Homo sapiens
  misc_feature: GYAE6OF02JA142.10.38.D05.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacgagggtcctgggcccagtctcgccctgacctcacgccctccctccgcggtccgggtctccgtggacngtcagtcaccatcctcctgacacgtggaaccngcagtgtactttgtagcttaataacttntcgtcctcgtaggtaccacgccaacccaccgaggaccaaaccgacccctaaactttcgttttggttttacgacggtactaaggtaccggccgtaccctagacgggtactcccgtaggtacttccggttctactccgtaccctaccgtaagttccgtacggacaaccgtcccggtccctaccgtacgtaccgtcgtccgtacgggtcctacggacggtcgtaggtacgagtacgacggtctagttaaccgtacgtacgtcgtaccgagtccgaattactccgttaaccggaacccggtaacccgttaacggggttaggggttttccgggtacggggacccgggttaacgggtaacggttaaacggggtcccgttacccgggttccgggttcggtacccggtaacccggtacccgggaacgggttcccctacccgggttccccccggtaggtttacccgtaacccgttcccggtttacccgtttaccccccgtacccccggtac

SEQ ID NO: 154951 - DNA, 761 bp, Homo sapiens
  misc_feature: GYAE6OF02G66G2.10.38.D05.1.454.CMB.1.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
tcagcatagtagtgcacgaccggtgctcgatttagtatctgatagttgggtttgggggggtctcgaggaggcagcgctctcaggacgtcaccaccatggcctgggctctgctcctcctcaccctctcactcaggcacaggtcctgggcccagtctcgccctgactcagccctcctcgcgtccggtctccgtggacagtcagtcacatctcctgcactcggaaccagcagtntactttggtancttaatactatcgtctccgtaggtaccagtccaaccccaaccgacggtaccaaaaccgtacccccctaaaacgtttcccgttttaggtttttacgaacggttacaaacggttaacggcccggtacccgtagacggtaaccttcccgtgtacgttccggttctcgtcgtccttaccgaagttcgtcggaaccaaaccgcccgtccttcccgtacgaccggttcctacgtcgggccctacgacggtcctgggaacgtaggtggacggtacttacggttaacttacccgttaacgttcgccgaacggtaccggtactaaagtttaccgttacccgaaacggtacccccggtaacgtaacggggtttcggttacgggtacggggtaaccggggtaaaccttcggggtaccgtacccggtttccgggtaacgggttcccgaaaccggtaccgaaccggttacccgtccggccccccggttagacccgtaccgtttacccgttccgtacccccgtaccccgtccc

SEQ ID NO: 154952 - DNA, 684 bp, Homo sapiens
  misc_feature: GYAE6OF02G2CS4.10.38.D05.1.454.CMB.1.raw
  modified_base (362)..(362): a, c, t, g, unknown or other
  misc_feature (362)..(362): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactgggtggagacgtggaggaggctggatccagccgtggggggtccctgagactctcctgtgcagcctctgggttcagcatcaagtaacgactacatgaccgtcgggcccgccacggcctccgaaggggaacggggctgggaggtgggtctcgtagttattagaaacngatggacacgtaacagttattattcgtacgaccgttcggtaggaacgggtccggttacctacccctcgaccgaaggacgtaacctaaccgttaccaaaacaacgtattccgttagttacttccgttacaactattcgaaccaactaacttcgtagaacgtacggttaccgaacccgaacgtaaccccggtacctaaacccgttaattttaacgtttcggacggtaccggaaccgtaaacctacgtacggtaaaacccgttccgtaactacccgttaaaacggttccgggtttccgggggaaccgtaaccggggtaaccccgg

SEQ ID NO: 154953 - DNA, 705 bp, Homo sapiens
  misc_feature: GYAE6OF02HEHIA.10.38.D05.1.454.CMB.1.raw
tcagcatagtagtgcacgaccggtgctcgatttagtatctgataggttgggtttggggggggtctcaggaggcagcgctctcaggacgtcaccaccatggcctgggctctgctcctcctcaccctctcactcagggcacagggtcctgggcccagtctgccctgactcacgcctccctccgcgtccgggtctccgtggacagtcagtccaccatctccgtgacactggaaaccagctaagtgtacttttgtgacttagtaactattcgtctcctcggtaccagcaccaccgagacaacgacccctaacttcttgttttgagtcagtaacgcgcctagacgtactcctagtactcggttctctcgccctacgaacgtctacggaaccaacgtaccggtcccttacccgtacggtacccgtcgtccgttcgggcctaccgacggtcgtaggacggtatagggacgtcgtagtacgtttaactacgtcgacgtacgccgtacgtaattaccgtacgacccggtaacccctaagggtacgggtttacggttacgggacgggtaaccgggtaacgttaaacgggccgttaacccggttcggtttacggacccggtaacggaaccccgttaagggccccgttacccgggtacccccgtacgggttacctacccgttccgtttaccccgttaccccgttacccccgtaaccc

SEQ ID NO: 154954 - DNA, 1042 bp, Homo sapiens
  misc_feature: GYAE6OF02II3KO.10.38.D05.1.454.CMB.1.raw
  modified_base (1031)..(1031): a, c, t, g, unknown or other
  misc_feature (1031)..(1031): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgttggttttccttgttgctatttacaaaaggtgtccactgtgtagttacaactggtggagactgggaggaggcgtggactaccgacgtccggttcggggggtcccctaggacgtaccttccttcccgtggtcgtaccgtacggcccgtttccgttcgggggtttaccaacggtcctaacgtttacccgtaaacggttaaaaccccggtaaccttaaaccgtaagttacccgggtaacccccggtttacccggggggaccccccccggtaaccccgggtaaccggggtacccgttaacccccgggaaacgggggggggtaaaccggggggtaccgggtttacggggggtacggggttttacgggggttacccttaccggtttaaacgggttttaaacgtttaacgggaaaaaccgtacggggtaacgttacggggaacccttaaacccgttaaaccggttaattttaacgtttttaaccttttaccgttaaacgggtttaaccccggttacccggggttaagggggttaaaacccccgggggtttccccgggttttaaccccttaaccccccgttttacccgtaccccgggtaaaaagggtaacccggttaaaacccccgtttaaccctttaaaacccccggtaaaacccgttaaaaccgttactttttacccggtttaacgtttccctttacccgttttaaccgaacccgttagtaacccggtacctaaaaccgttaccgtaccggttacggacgttaccgtacggtaacccggaaccgtacccggtaccctaaacgtttattaaccgttggtccgtcggacctaacggtaactccggtaacctccgtaaccgtacgttaacggttccggcggggtaacccgnggtaaccccgg

SEQ ID NO: 154955 - DNA, 646 bp, Homo sapiens
  misc_feature: GYAE6OF02IRTQ8.10.38.D05.1.454.CMB.1.raw
  modified_base (643)..(643): a, c, t, g, unknown or other
  misc_feature (643)..(643): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctctgtccagcaccaccaggcaaacgccccaaactccttgttttgagtcagtaagcggcctcaggacgtcctgagtcgttctctcgcctaccgtaagtcgtggaccaacacggtccctcctacgacccgtctacgtcgggacttccaaggctaggaacggatggagtacgtgtaaactttacgtacgtcgactacgtaccgataacgttaacgttacgaaccggtaccccgaaacgtggggttacggtttacgggccgggaacgggtaacgtaagggtcgtacccgtcggtacggtacgtaaccgacccgaacggtcctccggtacccccgtcggtacctacgttccgttccgttccccgtccctccctaccgtactacgtactcgtactcggtacggccggtcgacgggtacaaccggcgaacgtacgtacgnacg

SEQ ID NO: 154956 - DNA, 841 bp, Homo sapiens
  misc_feature: GYAE6OF02HBVJ8.10.38.D05.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcacgccctccctccgcggtccggtctccgtggacngtcagtcaccntctctncacgtcggaaccngcagtcgtacgttttgtcgtacttaagtaacttattcgtccttaccgtacggtaaccacgccaaccccgaacccgacggaaccaaaacccgacccccctaaaacgtttcccgttttaggtttttacggaacggttcgtaaacggtaacggccccgggtacccctacggtaacgggtaccgttcccgtacgtacggtttccggttacctccgttccggtacccttaaccggtaacgttccgtacgggaaccctaaaacccggtcccggtaccccgttcccgtaccggtacccgtttccggttaccggttccgggtacccgtaccgtaacgggtaccggtagggaacgggtcgtacgggtacggtaccttaaggttaaccgtttaactcggtacgtcgacgtaccgtacttaacgttacttacctaccggtacccgtacccgtaaagggttccggggtttaggttccgggacgggttaaccggtaacggttacgggtaccggtaccgttccgggtaggtaccccgtaccggtaacccggtcgtcccgtaccccggtaccccgttcggttacccctacggtttcccggttcccccgtacccccgtcccccg

SEQ ID NO: 154957 - DNA, 620 bp, Homo sapiens
  misc_feature: GYAE6OF02ICVMC.10.38.D05.1.454.CMB.1.raw
  modified_base (213)..(213): a, c, t, g, unknown or other
  misc_feature (213)..(213): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
  modified_base (464)..(464): a, c, t, g, unknown or other
  misc_feature (464)..(464): n is a, c, g, or t
tcagcatagtagtgcacgaccggtgctcgatttagtatctgatagttgggtttggggggtcgtcaggaggcagcgctctcaggacgtcaccaccatggcctgggctctgctcctcctcaccctcctcactcagggcacagggtcctggcccagtctgccctgactcagcctccctcgcgtccggtctccgtggacagtcagtcaccatctccngcactggaacctgcagtgtactttgtgcttaataactatgtctcgtgtacagcaccaccacgcgaacaccccaaaccttctttgtttacgagtcagtaacgccgacctcgagacgtccngagtcgtctntcgcctactagtcgtacgacgaacgtaccgccgtccttccgaccgtcgtcgtcgggacctcgcgtacgngggacgtgacgnggttcacgtagttactacgttgcagtccgactattacgtanacccggacccctaaggtacgggttggtttaccggacgggaccgggtaataacggggtacgtaccggtccggttaggtaccgcgttaacccgggacgtcgtaccccggccccttacggtcctaaccgtttcctcccgggtttccctcccttaccccg

SEQ ID NO: 154958 - DNA, 742 bp, Homo sapiens
  misc_feature: GYAE6OF02GIAH7.10.38.D05.1.454.CMB.1.raw
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcacgtaggaaccagcagtgtacttttgtgtacttataactattgtctcgtcgtaccagacacccaccaggacaaaccgacccccaaacttcctttgttttcgaggttccgagtaacgccggccctcgaacggtacgtaccctgtacgttccggttctccgtcgtccctacctagtaccgtggtacctaacgtacccggtccctcccttaccggtacccgtcgtccgtacgggtcctacccgagggtccgtaggaaggtagtacgacgggtcttacgtaatttaccgtacttcggactacggtcgactacgtttacgttacgacccggtaaccccgtaacgttacgggggtttacggttttccggggccgggggttaccgggtaaacggttacggggtaccgtacggttacccggtggggtacccaacgggtaccccgaacgggttccgtacccgggtacccccggttaccgggttccgtaacccgttccggttaccccgttcccccgtcccccttaccccg

SEQ ID NO: 154959 - DNA, 614 bp, Homo sapiens
  misc_feature: GYAE6OF02JFQCD.10.38.D05.1.454.CMB.1.raw
  modified_base (371)..(371): a, c, t, g, unknown or other
  misc_feature (371)..(371): n is a, c, g, or t
  modified_base (488)..(488): a, c, t, g, unknown or other
  misc_feature (488)..(488): n is a, c, g, or t
  modified_base (545)..(545): a, c, t, g, unknown or other
  misc_feature (545)..(545): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactggaggaggctggatccagccgtgggggtccctgagactctcctgtgcacgcctcgtaggttcagcatcagtaacgactacatagaccgtcgggccccgaccgacggccgtccggaaggggaacggggcgtagggaggtcgggtctcgtagtttagtagaaacngagtgcactactattattacttctacgtacgtcggtacggtaacgggtccgttaccacccgtctaccgagtaacgacctaccttaccaaactactactcttatacttcctacactancgacatactgtagagtacgtcgaacgaacgtccggtaccctaagttagttagttcgnggtaccgaccgataacgcgtaaccgtactccgtaacttaggttcccgggcggggtaccaagggtccccg

SEQ ID NO: 154960 - DNA, 696 bp, Homo sapiens
  misc_feature: GYAE6OF02GFRIK.10.38.D05.1.454.CMB.1.raw
tcagcatagtagtgcacgaccggtgctcgatttagtatctgatagttgggtttggggggggagaggagcccagcactgggattccgaggtgtttccattcggtgatcagcactgaacacagaggactcaccatggagttttggctgagctgggttttccttgttgctatttacaaaaggtgtccactgtgagttcaactggtggagactgggaggaggctggatccaggccgtggggggtccctgagactctccgtgtgcacgcctctgggttcagcatcagtaacgactacatcgacccgtcgggccccgccacggcctaccggagggggaacggggcgtaggggtaggtggggtccgttcgtaaggtttaagttacggaaacaggtacgtgggtaccaactactaattatttactttacgcgtaccgttccggtacgggtacgggtcccggttaccacccttcgtaccgaggtaacgtacctaaccgttaccaaacctaactacttactttcgtaccgttcttacaactactcgtaacctaactaacgttcgtaaggacggtaaccgtacggaaccgaaccgtaacccggtaccctaaaccgtttaatttacgttacgtcggtaccgacggtaactacggtacgtaaccctcggtccttaacgtagtttccggacggggtacccagggggaccc

SEQ ID NO: 154961 - DNA, 755 bp, Homo sapiens
  misc_feature: GYAE6OF02FZ2ND.10.38.D05.1.454.CMB.1.raw
  modified_base (254)..(254): a, c, t, g, unknown or other
  misc_feature (254)..(254): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctcgggcccagtctcgccctgactcacgccctccctccgcgtccgggtctccgtggacagtcagtccaccatcctctgacacgtcgaaccgcagtgtaccttttggtntacttaataacttactgtcctccgtacgtaccagtaccaacccaccgacggaccaaaacccgacccctaaaccgtttccttttaggttttaggacggtaccgtaaagtacggccggtcccttacgaacgggtacgttccctagtaaccgttcggttcctacgttcacccgtaccaacggttctcgggaacccaaaccgtcccggtacccttacccgtacggtacccgtacgtccggtaccgggtccttacccggaggtcgtacggaggtttcgacggtgtaccgtaattaccgttaaacgtcgacggtaccaggtccgtacttagttacccgtacgaccgggaacccctaaggttacggggttgttcccggggacggtacggtaacgttaacgggtcgtcccgtgggtacggtccgaaccggtaaccggtacggtcccttacccggaccccgttcggttacccaccctttccgttccccgttaccccctaaccgttccccg

SEQ ID NO: 154962 - DNA, 876 bp, Homo sapiens
  misc_feature: GYAE6OF02H0Q0J.10.38.D05.1.454.CMB.1.raw
  modified_base (236)..(236): a, c, t, g, unknown or other
  misc_feature (236)..(236): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcgagggccactacgggtcctgggcccagtctgccctgactcagccctccctccgcgtccggtactcctggacagtcagtcaccatctcctgcacgtacggaaccngcctaggtcgtactttttggtgacctttaattaaactagttcgttcctccgttaggtaaccacgacctaacccacccgaaggtaaccaaaaccggtaccccctaaaacttcccgttttaggtttttacggacggtacgaacggttaacggccggtaccccttacgaacggtacgttaccccgttaggtaacgttccgggtttaccttccgttaccggtacccccttaaccgtaacgttaccgtacggaaccctaaaccgtacccggtcccttacccgtacggtacccgtttaccgtaccggttaccgggtacctacccggtaacggtcccgttaagggtaaacgggtacctagggtacggtaccttaacggtaaccttttaaccggtaacttcggaccgtaacgaccggtaaccttaactaaccgttacccggaccggtaaacccccgtaaggtacggggtttacggttaccggggaaccgggttaccggggtaaaccgtttaaaccggggtaccggttaacccgttaccgggttacggggttaacccaccgggtaaccccgggtaaaggtccccgttaccccgtcccccggtaggtaccctaccgttcccggttacccgtttcccccgaccttaccccg

SEQ ID NO: 154963 - DNA, 752 bp, Homo sapiens
  misc_feature: GYAE6OF02HXZVL.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctcgccctgactcagccctccctccgcgtccgggtctcctggacagtcagtccacctatcctcctgctactaggaaccagcagtcgtacttttgtacgtacttaataactattcgtcctcctacggtaccagccaccacccgaggaccaaaaccgacccccctaaaactttcccgttttagttttttacggaacgggttaccgtaacgggttaaaccgtccccggggtacccctttaccgggaacgggttaacccgttccccgttaggttaaccgttcccgggtttaccttccgttacgtcccccgttaccgtaaaccgttccgtacggaactaaacccgtccggtccccttacccgtcgtacccgttccttcggtccgggtcctaccggacgggtcgtacgggaggtcgtacggaggtcttagtacttaacgtaccgtcgacgacggctactatttacgtaaccgaccgtaccccgtaagggtcgggtttacggtcgggacgggtaccggtaagttacggtccgacgttccgtggaccgtacgccgacgtccctccggcccgtacgtccgacttccgtccttacccgccctacc

SEQ ID NO: 154964 - DNA, 663 bp, Homo sapiens
  misc_feature: GYAE6OF02F3MVO.10.38.D05.1.454.CMB.1.raw
  modified_base (485)..(485): a, c, t, g, unknown or other
  misc_feature (485)..(485): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagactgggaggaggcgtggatccgagccgtgggggtccctgagactctcctgtgcacgcctcgtggttcagcatcaagtaacgactacatcgaccgtcgggccccgccgaggccgtaccggaagggggaacggggcgtgggacggtgggtcctcgtagtttagttagaaacgtagtagtcggacctaactactattaatttacttcgtacgtaccgttccggtaggaacggggtcccgttccacccgtcctcgaagacgtacctaccttaaccaactaactntcttatacttccttacaagtactcgaacctaacgtaacttcggaggtaagtacggtaccgaaccgaccgaccggacccttaacgttatttacggttgccggaccgtacgaactcgttaacggtaacctacgtccttaacggtaactttcggggaccggggtaccgtaaggggaccccg

SEQ ID NO: 154965 - DNA, 640 bp, Homo sapiens
  misc_feature: GYAE6OF02JC8Q5.10.38.D05.1.454.CMB.1.raw
tcagcatagtagtgcacgaccggtgctcgatttagtatctgatagttgggtttgggggggaggaggagcccagcactgggattccgaggtgtttccattcggtgatcagcactgaacacagaggactcaccatggagttttggctgagcgtgggtttccttgttgctatttcaaaaggtgtccactgtgaggttcaactggtggagactgggaggaggctgggatccagccgtggggggtccctgagactctcctgtgcagcctcgtgggttcagcatacagtaacgactacatcgaccgtgggccccgcaggcctccgaggggaagggcgtggagtggtatcgtcagttagtacgaacaggtactgggacacgttaacaattatttagttactgtacctccgggtaggaaccgggtttccggttacctacccgttcttacccgacggtaacgacctaccgttacccaaactaacgtattaccttagttacttccttactaactctacggactaacaatctagaggtacgtaccgacgtaaccgacccgacctaccgttaattgttcgtaccggcgtaccgtatacggttctaaccgtaccgtcttaacgacgtttccggtacgggtaccgtaaccgggg

SEQ ID NO: 154966 - DNA, 678 bp, Homo sapiens
  misc_feature: GYAE6OF02G2YFU.10.38.D05.1.454.CMB.1.raw
  modified_base (240)..(240): a, c, t, g, unknown or other
  misc_feature (240)..(240): n is a, c, g, or t
tcagcatagtagtgcacgaccggtgctcgatttagtatctgatagttgggtttggggctctgctcctcctcaccctcctcactcagggcacagggtcctggcccagtctgccctgactcagcctccctccgcgtccgggtctcctggacagtcagtcaccatctcctgcactggaaccagcagtgactttgttgcttaataactatgtctcctggtaccacgcaccacccaggacaaacnccccctaaacttcctttgttttcgaggtccaggtaaccgccggtccctacacggtacgtcccgtagacgttcggttccttcgtgtccctactaacgtctacggaccaacgaacggtccctacccgtcgtaacccgtcttcgtcggcctaccgcgcgtagagtgtaggaggtcgtagtaactttaacgtacctggaccctaaggcccgtactacttacgtttaccgacccggtaccccgtaaaggtcggggtttacgtttacgggccggggtacgggtaaccgttagggtccggtaccggtaccggttggaccgacgtcccgaaggtccgtacccgtcccggtaccgtcctaccgttcgtcccttaccctacctccgtaccctactacgagttccgacgtcggacgtccggtcgtcgacgacggcccaagtctagatcg

SEQ ID NO: 154967 - DNA, 717 bp, Homo sapiens
  misc_feature: GYAE6OF02GC6F9.10.38.D05.1.454.CMB.1.raw
  modified_base (197)..(197): a, c, t, g, unknown or other
  misc_feature (197)..(197): n is a, c, g, or t
  modified_base (388)..(388): a, c, t, g, unknown or other
  misc_feature (388)..(388): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacgagggtcctgggcccagtctgccctgactcagcctccctccgcgtccgggtctccgnggaccagtcagtcaaccattcctcctgacctacgtacggaaaccagccgtaagtcgtacttttgtgctttaataactagttcgtctccgtggtaccacgtcaccaccgaggacaaccgcccctaaacttcccttgttttagacgtactaaggtaacgccgtcctgtacgcgtcctagacgttcggttctcncgacccgtacgtaacgtcgtcgtaccaacgtacggtccctacccgttagacccgtccgttacgtccggtaccgttacccgagggtaccgtaggtaacgggagtacggacggtacgttactaacgtttacctacgtcgactaccgccgtaacgtaacgtactaccgaaccgaacccgtacgggtagggtttccggttaccgggcgggtaacggtaacgttaacggtccggtaacggttccgtcgggtacgaaccggttaccggaaccgttcccggtaccgcccccgttgggtacctacccggttctaccccgtttcccgaccccttaccg

SEQ ID NO: 154968 - DNA, 723 bp, Homo sapiens
  misc_feature: GYAE6OF02HG8WP.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagtttggctgagctgggttttccttgttgctatttcaaaaggtgtccactgtgaggttcaactggtggagacgtggaggaggctggatccgagccgtcggggggtccctgagacctctcctgtgcacgcctcgtgggtcagcatcgagtaacactacatcgaccgtcgggccccgcgacggctaccggaggggaacgggtcgtagggaggtcgggtactgtagttatagaaacagagtggactaactacattagttactcgtagactcggtaggtaacgggtcccgtttacacccgttctaccgaagtagtaaccctacctttaaacccaaaacgtaacctagttacccttagtaaacccgtttctacccaaacgtacgttacgacccttaaactaagttcccgtagggtaacggtaaccgtccggaaacccgtaaccaaaccccgtaacccttaaaccctttagtttaaacgttccggtaagggcccgtaacggtaaccctacgttaaacggcccgttttaaccggccgttttaaaccgtaaccggttttcccgggggaacgggggacccggttaacggggaacccccg

SEQ ID NO: 154969 - DNA, 880 bp, Homo sapiens
  misc_feature: GYAE6OF02IIFIY.10.38.D05.1.454.CMB.1.raw
  modified_base (208)..(208): a, c, t, g, unknown or other
  misc_feature (208)..(208): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggtaggttttggctgagctgggttttccttgttgctattacaaaaggtgtccactgtgtagttcaacgtggtgganacgtgggaggaggctggactccaggccggttcgggggtccctaggagaccttctcctggtgacacggtccttcgtacggttcacgctatacgacgtaacgacgtacagtcggacccggtcgggccccgaccgacggccgtaccgggaaggggtacggggtcggtgggacgggttcgggtacgtacgttaacgttaagttaaggaaacgacggtacgtacggacctaacgtaactaattaacgttacgttcgtacgtaaccgttcggtaacgggtaacccggtccggttacccgtacccgttcctaacggacgtaacgtaaccccttaacccgtaactaaaaccgtaaacttaccgttacgtttaaaccgtttccttaacccgtttaccaaacgtttaccgaccggtaaccaactttaaacggttccggttaaacggtaaccgggtaacgggttaaaccccgggaaacccggtaccccggtaaaaccggggtaccccccttttaaaaccgggttttagttttaaccggttaccgggtacccgggacccgtaaacccggttaaaccggtttaaccggtaacgggttaaaccccttaaccccgggttattaacccccgggtttaaaggggttccccgggttaacccgggggaaccgttaaccccgggggacccgg

SEQ ID NO: 154970 - DNA, 715 bp, Homo sapiens
  misc_feature: GYAE6OF02HCEBX.10.38.D05.1.454.CMB.1.raw
  modified_base (256)..(256): a, c, t, g, unknown or other
  misc_feature (256)..(256): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgtactttgtgcttataactatgtctcctggtaccagcaccaccaggcaaacgccccaactccttgtttgnggtcagtaacgccggcctagaggtacgtccctgtacgtccggttctcgtcgcccttaccgaagttcgtacggaccaaccgaccgggtccctcccgtacggtacccgttctcggtcggtcctccgaggctaggacggtatcggaggtctagtacttaactactggcagcgactacgttactaccgaccggtaccccgtaaacggtcggggttcggttcgggtacgggtaccgggtaacgttaacggggtccggtaaccggtttccggtacgggtaccgtaccggacccggtaaccgggtcccgttacccggtccccccggttccggttacccgtacccgtttcccggtttacccgttccccccggtcccttaccccgtaccttacccgtaccgttacgtccgtccggttacggcggtaccggtccggtacggtaccgacgggtcgaccgtacgtgacgtc

SEQ ID NO: 154971 - DNA, 755 bp, Homo sapiens
  misc_feature: GYAE6OF02IZJGL.10.38.D05.1.454.CMB.1.raw
tcagcatagtagtgcacgaccggtgctcgatttagtatctgatagttggggtttggggggggtctcaggaggcagcgctctcaggacgtcaccaccatggcctgggctctgctcctcctcaccctcctcactcgagggcacagggtcctgggcccagtctcgccctgactcacgccctccctccgcgtccggtctccgtaggacagtcagtccaccattctccgtgacctacgtcggaaccagcgagtcgtacttttggtcgacttaataactatcgtcctacctcggtaccacgtccacccaccgaggaccaaccgacccctaacttccgttttggttttacggacgtactaacgtacggccgtccgtacgacgggtacctcctaggtacttcggttctctcgtccctactagtccgtaggaccaacgtcggtacccttccgtaccgtacccgtcgttccgggtacggtccctaacggtacggtcgtacggtaacgggtcttaccggggagttccgttaagtacttttaaccgtacggtctaacggacgttccgaacgttacgtacgttaacccggaacccggtacccgtaaaggtcggggttacgggttcggggaacgttacgggaaacgtacgggtttacccggaccgtttccgggacgttaccggaaaccgtccccggtaagtccccggtaccgttcccccgtggtacccttaccttcccggttccccgttacccccgcccgtttaccccg

SEQ ID NO: 154972 - DNA, 803 bp, Homo sapiens
  misc_feature: GYAE6OF02GB3NI.10.38.D05.1.454.CMB.1.raw
  modified_base (234)..(234): a, c, t, g, unknown or other
  misc_feature (234)..(234): n is a, c, g, or t
  modified_base (799)..(799): a, c, t, g, unknown or other
  misc_feature (799)..(799): n is a, c, g, or t
tcagcatagtagtgcacgaccggtgctcgatttagtatctgatagttgggtttgggggcgtctgctcctcctcaccctcctcactcagggcacagggtcctgggcccagtctgccctgactcacgcctccctccggccgtccgggtcctcctggacagtcagtcaccatctcctgacacgtcggaaccagcagtgtactttgttgtcttaataacttatgttctcctcggtacncgcaacccaccgagacaaacgccccctaaacttcctttgtttcgagtcagtaacgccgcctagacggtactccctagacttccggttctacgttcgacccttaccgtaacgtccgtcggtaccaaaccgtaccgggtccctacccgtccgtacccgttcgtcggtacgggtcctaccggacggtcgtaaggacggggtaatcggtaacggtcttacgggttaaacctttaccgaccgttaggacccgtacggtccgttaaccgtaacgtttaacgtttaccggaaccggaaccccgtaagggttgggggtttaccgggtttacgggccgggggttaaacggtaaccgggttaacgggtacccggtaaccggttcccgggttacgggtacccgacgggtacccggtaaccgggtccgtaccccgggtaccccgttaccggttccgtaccgtttcccgttaccggttccccccgttacctaccccgttaccgaacctttaccgtagtaccggttctacgggccggtaccgggtcggtaacgcccgtaagggcccgtaataccggtantacg

SEQ ID NO: 154973 - DNA, 905 bp, Homo sapiens
  misc_feature: GYAE6OF02HRF8C.10.38.D05.1.454.CMB.1.raw
tcagcatagtagtgcacgaccggtgctcgatttagtatctgatagttggggtttgggggggggtctcaggaggcagcgctctcaggacgtcaccaccatggcctgggctctgctcctcctcaccctctcactcgagggcacgagggtcctgggcccagtctgccctgactcacgccctccctccggcgtccgggtctccgtggacagtcagtcacctatcctctgactacgtacggaaccaggtacctagtcgttactttttggtgtactttaaagtaacttagtcgttcctaccgttggtaaccagacctaacccgaacccgaacggacctaaaaccgaccccctaaacgtttcccgttttaggtttttacgaaggtacctaaggtaacgcccggtaccccgtacgtaagggtaccgttaccctaggtaccttccgggttacctcgtccgaccttaccgtaaacggtcgtacggaaccctaacggtacccggtacccttaccccgttacgggtacccgtttaccctcgggtttacccggggtacccttccggtaacgggtccggttaagggaaccgggttaggtacgggttaagggtaccgttagttaaaccgttacgttaccggttacgtaccggaggtaccgtaacttaccgtttaaacgttaacccggaaacccgggtaacccccgttaacggggttacggggtttacggggtttacggggaacccggggttaaacggggtacggtttaacgggtaccgggttacccgttaccggggttacgggtaacccggtaacggttaccccggtaacgggttacccgtccccggttaaccccccgtacgggttacccaacccggtttcccgtttaacccgggttcccccctaccccggtttaccccg

SEQ ID NO: 154974 - DNA, 663 bp, Homo sapiens
  misc_feature: GYAE6OF02HMFII.10.38.D05.1.454.CMB.1.raw
  modified_base (200)..(200): a, c, t, g, unknown or other
  misc_feature (200)..(200): n is a, c, g, or t
  modified_base (245)..(245): a, c, t, g, unknown or other
  misc_feature (245)..(245): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcagcctccctccgcgtccgggtctcctggacngtcagtcaccatctcctgcactggaaccagcagtgacttttggtncttaatactatgtctcctggtaccagccaccaccaggaccaaacgccccaaacttccgttgttttgacggtcagtacgcggtcctacgaggcgtcctgtacgttcggttactcgtcgtccctacgtaacgtctacggaccaacgtccgtacctccctagacccgtctccgtcgggtcctaccgacggtcgtaggaacggtactggacggtctacggtactttaacgtacgttgacacggcagtacttacgttccgaacggtaccccgtaaagtcggggttcggttcgggccgggtaacgggtaacgttaacgggtcgtaacccggtcggtacgggtcctaacggtaccccgaagggtcccttccgggcccccgtttaggacctaccgtttcccgtcccgttccccgacccttaccccg

SEQ ID NO: 154975 - DNA, 667 bp, Homo sapiens
  misc_feature: GYAE6OF02GGLJN.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaacgactacatcgaccgtcgggccccgcgacggcctccggaggggacggggctgggaggtcgggtctcgtagttattagaaacgagagtggacactacattattattctagaccttcggtaggaacgggtcccggttccacccttctaccgaagacaccgtaccttacccaaactaacctacttacttacgttacttccttacaactatcgacctaactaacttcgtagaacggtacgtaccggaaccggtaaccgaacccggtccctaaacccgtttaatttaccgtttaggccggtccgtaaccggtaacctaacgttaccggtaaccttaccgtaccgttacgttaaaccgtttccggaacggggggtacccgtaaggggtaccccgg

SEQ ID NO: 154976 - DNA, 837 bp, Homo sapiens
  misc_feature: GYAE6OF02ILXFD.10.38.D05.1.454.CMB.1.raw
  modified_base (636)..(636): a, c, t, g, unknown or other
  misc_feature (636)..(636): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcaccatggtagttttggctgagtcgttgggtttttccttgttgcttatttacgaaaaggtgtccactggtgtaggttacaacgtgggtaggagtacgtggggaggaggcgtaggtactccgaggtcccgggttcggggggtcccctaggacggtaccttccgtccgttggtcgacgacgtccgttcggttacggggttacaggcctaagtaccgtaacggtaaccgactaacgtagtccggtacccggtccgggaccccgaccgacggccgtaccgggaacgggggtacgggaccgtggggtacggttacgggtcgtacgttacggttaagttaacggaaacgtaggtacgtcggtaacctactaacgttatttaacgtttactcgtacgtaaccgttccgggtaacgggtacgggtcccgtttacccaccgttaccgacgtaacggaacgtaaccctacccgttaaccaaacttaacgtactttcgtttaacgtaccttcgtttaaccncgttaaacgttcgaaaccctagttacctacggtacgtaacggtaccgggtaccgaacccggtaaacgttcccgaaccctttaactttaggttagttaccggcggtacccgacttaacgtaacctaacggggtaccctttaaccgacgtacgtttaacgggttcccggggtaaccggggaccggttaaccgggtaacccggg

SEQ ID NO: 154977 - DNA, 325 bp, Homo sapiens
  misc_feature: GYAE6OF02GVMV0.10.38.D05.1.454.CMB.1.raw
  modified_base (316)..(316): a, c, t, g, unknown or other
  misc_feature (316)..(316): n is a, c, g, or t
  modified_base (320)..(325): a, c, t, g, unknown or other
  misc_feature (320)..(325): n is a, c, g, or t
tcagcatagtagtgcacgaccggtgctcgatttagtatctgatagttgggtttgggaacctatgaacattctgtaggggccactgtcttctccacggtgctaccttcatgcgtgacctggcaacacggcctccctgaccatctctgggctccaggctgaggcgaggctgattatactgcagctcatatacaaccagcagcacttctgtattcggcggaggaccaagctgacccgtctaggtccacgcccaaggcctgccccctggtcactctcgtcccaccctcctcactactatgctgagcggctggcaaggccnatgnnnnnn

SEQ ID NO: 154978 - DNA, 820 bp, Homo sapiens
  misc_feature: GYAE6OF02HFODC.10.38.D05.1.454.CMB.1.raw
  modified_base (181)..(181): a, c, t, g, unknown or other
  misc_feature (181)..(181): n is a, c, g, or t
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (323)..(323): a, c, t, g, unknown or other
  misc_feature (323)..(323): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctcgccctgactcacgtcctcccnccgcgtccgggtctcctggacagtcggtcacatctccngcacgtcgacccagcaactgnttacggttgggactatttaacgttaccttgttcctccgttaggtactaccgaaaacgtaccgcccgaagtaaaccgaaacccncccccgaactaccgttaccgttacggtacttttaaggtagaaacgttcgtaacggttaaacggcccgggtacccctaggttacggggtttctacgttcgtccgtttctacgtcgtaccttaccgtaacgttactcggaaccgtaacgtcccggtaccctttacccaaggtaaaccctaagtttcccgcgttaccggggtcctaccgtacggtccgtaacgaacccggtacggtaacggtacctaacgttaaacgttaccgttacgttacgaaccgtgtacccttacgtaacgtttacgttaggttaaccggttagttccgggttacggtttaccctttaacgggtttttaaccgggtttaacggggttttacccgggtacggggtaaccgggtaacgtacgggtcccgtttaaccgggtaccccgttacgtaacggtacccgtaaccgtcccggtaaccggttcctacccgggtccccgttacgtaacccgtccccg

SEQ ID NO: 154979 - DNA, 484 bp, Homo sapiens
  misc_feature: GYAE6OF02G2E42.10.38.D05.1.454.CMB.1.raw
  modified_base (416)..(416): a, c, t, g, unknown or other
  misc_feature (416)..(416): n is a, c, g, or t
  modified_base (421)..(426): a, c, t, g, unknown or other
  misc_feature (421)..(426): n is a, c, g, or t
  modified_base (428)..(428): a, c, t, g, unknown or other
  misc_feature (428)..(428): n is a, c, g, or t
  modified_base (430)..(484): a, c, t, g, unknown or other
  misc_feature (430)..(484): n is a, c, g, or t
tcagcatagtagtgcacgaccggtgctcgatttagtatctgatagttgggtttggggaacctatgaacattctgtaggggccactgtcttctccacggtgcctcccttcatgcgtgacctggcaacacgacccttccctgaccgtctcgtgggctccgaggtctggaggatggaggtctgtacttactactgcagcgctattattcgaccggacccccaagtaggggttgtttcgggccgggtacgggtaacgtaagggtcgacccggttccgtgggtcacgacccgaaggccgtccgccccgtggtccaccttcgtccgttcccccggccccttcccgtcccctacttactagtcgtaccgtggacggggccgggtcgtcgggaacgaaccggggtaccgccgaagtacggtcgntcgannnnnnangnnnnnnnnnnnnnnnnnnnnnnnnnnnnnnnnnnnnnnnnnnnnnnnnnnnnnnn

SEQ ID NO: 154980 - DNA, 918 bp, Homo sapiens
  misc_feature: GYAE6OF02FS51D.10.38.D05.1.454.CMB.1.raw
  modified_base (270)..(270): a, c, t, g, unknown or other
  misc_feature (270)..(270): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacgagggtcctgggcccagtctgccctgactcacgccctccctccgcggtccgggtctccgtggacagtcagtcaccactctcctgccacgtcggaaccagcagtgtacttttgtcgtacttaataacgttntacgttcctaccgttcgggtaaccacgtccaaccccaacccgtaaggacccaaaacccgacccccctaaaactttccgttttcgggtttttacgacgggttacgtaacggttaccggccccggtccctacggacgggtacttcccgtggtacgtttccggtttctccggtacctcccgttaacgtacggttcgtacgggaaccaaccgtaccgggtccccttccctcggtacccggttcgtccggtcgggtcccgtccggtaacgggtctaacgggtagggttacgtccgggtacgggttacgtacggtttaaatttacccgtaccgtacggtccggtaaacggtcccgtaacgtttaaacgtttacccggttaacccggacccggggttaaaccccgttaaacggggtttccggggggtttttacggggttaacccggggggtaccgggggttaaaccgggtaaacggggttttaaaccggggtaccccgggtttacccggggttacccgggtaaccggggtttaccgaacccggggtacccccggttacggggtccccgttaccccccgggttaccccggtttcgggtaccccttccccgggtttcccgttaccccgggtttccccccccgaccctttacccccgg

SEQ ID NO: 154981 - DNA, 808 bp, Homo sapiens
  misc_feature: GYAE6OF02IXNEZ.10.38.D05.1.454.CMB.1.raw
  modified_base (333)..(333): a, c, t, g, unknown or other
  misc_feature (333)..(333): n is a, c, g, or t
  modified_base (563)..(563): a, c, t, g, unknown or other
  misc_feature (563)..(563): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgtctatttacaaaaggtgtccactgtgtacggttcaagtggtggagacgtggaggaggcgtggatccgagccgtcgggggtccctgacgacctcctcctgtgccacgtccgtcgtcggttcgacgcacgtacgaagtaaacgactaactagtcgtacccgtcgggccccnccgacggtccgtaccggaagggggaacggggtccgtaggggacggttcgggttacgtacgtaaggtttacgtaagaaacgtaggtacgtacggactaacgtaacttaagtttaagtttacgttaccgtagtacccgttaccgggttaacgggaaccggggttcccggtttacctacccgttacccgtacgaagtaccgtaaaccctacttaaccccgaaaataaaccttntttaccgttagttaccttacgttacaaccgttaatcccgaacctaaacgttaaccgtctaacgggttaacgaaccgttaccccgggaaacgtaccccgtaaacgggtacccccctttaaactttcgttttaaccgtttcggaacggtcccgggtaactaaacggttcccgttaacgtaaacccgttaccgttacgttacccgtaaacggtttccgggtccggggaacccgggtagggtacccccg

SEQ ID NO: 154982 - DNA, 717 bp, Homo sapiens
  misc_feature: GYAE6OF02F7MSL.10.38.D05.1.454.CMB.1.raw
  modified_base (237)..(237): a, c, t, g, unknown or other
  misc_feature (237)..(237): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacagggtcctgggcccagtctgccctgactcacgccctccctccggcgtccgggtctccgtggacagtcagtccaccatctcctgcacgtcggaaccngctagtcgtacttttgtgtactttaataacttatcgtcctccgtacggtaccacgaccacccgacccgaggaccaaaccgaccccctaaacttccgttttggttttaggacggtcaaggttaacggccggtcctacgaagggtccgtccgtgtacgttccggttactccgtcgtccctaccgtaagttccgtacggaccaaccgtccggtacccttcccgtacgtacccgttcgtccggtcggcctccgaacgtcgtaggaggtacgtggacgtcgtagtacttaccgtcgtagacgtacgctacgtacttcgtaccgaccggtacccgtaaggttcggggttacggtttcggggcgggtaaccggtaacggtaacgggttcgacccggttggtacgggaccgaaccggtaccggaaccgtccgtacccggttcccgtacgtccgttaccgtcctttacccgtcccctaccccgttaccc

SEQ ID NO: 154983 - DNA, 805 bp, Homo sapiens
  misc_feature: GYAE6OF02G9NRA.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgctatttcaaaaggtgtccactgtgaggttcaactggtggagacgtggagggaggctggactccgaggcccggtggggggtccctggacgtaccttccgtcctgtcgcacgtcccgttcgttcggggttcacgactactacgaacggtaaccgtactacaacgtccggaacccgtcggggcccccggaccgtaacgggtccccgttacccgggaacggggggtaacggggggtccgttagggggtacgggttccgggggttacgttaccgttaaaggttttaacgttaacggaaaccgtaaggtacggttacggtactaaacgttaacctaaagtttaacttttaacggtttcccttacggttaaccggttacccggtacggggtaaaccgggggtttaccccggtttaccctaaccccccgtttcgtaccgaaacgggtacgtaaccctaaccgttacccaaaacgtacttaccgttcctttaagtacctttcttaccgaatacgttacacgtaactaatctacggataacgccgtaaccgacgacccggtaacccttacttattacggttacgcgggacctacgtactagtacgtaacctgtaccctaattaccgggttcggcggggtacctaaccgggg

SEQ ID NO: 154984 - DNA, 665 bp, Homo sapiens
  misc_feature: GYAE6OF02GDZ0C.10.38.D05.1.454.CMB.1.raw
  modified_base (309)..(309): a, c, t, g, unknown or other
  misc_feature (309)..(309): n is a, c, g, or t
  modified_base (591)..(591): a, c, t, g, unknown or other
  misc_feature (591)..(591): n is a, c, g, or t
tcagcatagtagtgcacgaccggtgctcgatttagtatctgatagttgggtttggggggagaggagcccagcactgggattcccgaggtgtttccattcggtgatcagcactgaacacagaggactcaccatggagttttggctgagctggttttccttgttgctatttcaaaaggtgtccactgtgagttcaactggtggagactggaggaggctggatccgagccgtgggggtccctgagacctctcctgtgcgacgtcctcgtggttcagcagtccagtaacgactacatcgaccgtcgggccccnccgacggcctccggaaggggaacggggcgtgggacggttgggtccttccgtaagtttacgtagaaaaccgtagaagtcgggacaaccgtaacctatttaacttacgttcctacggtaccttaccgggttacggtaacggggtaccccgtttacccgaccccgttaccgtacccgtaacgacgtaaccgtaccttaacccaaacaaactacttcgttacgtacttcgttaccactactcgacctacaatcgagtagacgtcggacgtaccgacgaccttaacnctttagtcgtacggaccgcgtacacgtacgtaccgaccgtctactaccgttcggtaccgggtacgacggacccg

SEQ ID NO: 154985 - DNA, 760 bp, Homo sapiens
  misc_feature: GYAE6OF02HNQ2A.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagttctcgaccctgactcagccctccctccgcggtccgggtcctccgtggacaggtcagtccaccattcctcctgcacgtcggaaccagcagtgtacttttgtgacttaataactatcgttacctcgtaggtaccacgccaaccctaccgacggaccaaacccggtacccccctaaaatttccccgttttaggtttttacggaacggttacgtaacggttaaccggccccgggtacccctacggtaacgggtaccgttacccgtgtaaccgtttccgggttcctcgtccggtccctaccgtaagtcccgtacggaccctaaaccgccggtccctcccgtataccccggttctacggtccggtacctaccggaacggtcgtagggaacgtcgtacgggaggtccgttagtaacctttacggatccggacacggtccatacgttacgtaccgaaccggtacccgtaggtaggggtttcggtaggggtaccgggtagggtaaacctaggggtacgtcccggttggaccggttacggaaccgcccggtacggtccgtaccccggtcccgtggttaaccccggtttaccgtccgtcccccgtacctccccg

SEQ ID NO: 154986 - DNA, 703 bp, Homo sapiens
  misc_feature: GYAE6OF02HEWVJ.10.38.D05.1.454.CMB.1.raw
  modified_base (388)..(388): a, c, t, g, unknown or other
  misc_feature (388)..(388): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcacgccctccctccgcgtccggtctcctggacagtcagtcaccatctcctgacacgtggaaccagcagtgtacttttgtgtacttaataactattcgtctccgtacggtaccagcctaaccaccgacggacaaaccgaccccctaaattccgtttgttttacgagtcaagtacgccgccctgaggactccgtagtacttcggttctctcgccactagtcngacacgccggtctcccgtgtacccgttcgtcggtccgggtccaccggtggtccgtaggtaggacgttagggacggtacttaggtactttacctacgtcgactaggaccgttctaacttccggtacgaaccccgggtaacccgtaacggggtggggttttccggtaccggggacgggtaaacccggggtaacgtaaccgggggttctaccccgggttcgggtacggtaccgacccggtaccgtaaccgggtcctccccggtaccccgtggtaccctaccgtttcccgttcccggtttcccccgacccctttacccg

SEQ ID NO: 154987 - DNA, 665 bp, Homo sapiens
  misc_feature: GYAE6OF02GDQOV.10.38.D05.1.454.CMB.1.raw
  modified_base (398)..(398): a, c, t, g, unknown or other
  misc_feature (398)..(398): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcgttgggttttccttgttgcttatttacaaaaggtgtccactgtgaggttcaacgtggtggagacgtgggaggaggcgtggactccgaggtccggtcggggggtccctggacgacctctccgtgtgcacgtcctcgtgggttcagacatacaacgtaacgactacatcggaccgtcgggccccgccgacggtccgtaccggaaggggaacggggcgtagggaggtcgggtctacgtagttagtacgaaacngtagtcgactactactattattattctacgtacgtcggtaggtaacgggtcccgttaccgaccctcgtaccgagtacacctacctaccaaaactactattcgttagtacttccttacgaactatcgactaacgtatcgtagaacgtcgtacgacgacgaccgtaccttaacgttagttcgttaggacgtaccgaaccgtataacgtcgtaacccgtcgtaacgttcgtaaaccggtttccggggacgggaacccgtaggggtacccc

SEQ ID NO: 154988 - DNA, 635 bp, Homo sapiens
  misc_feature: GYAE6OF02I5M7N.10.38.D05.1.454.CMB.1.raw
  modified_base (133)..(133): a, c, t, g, unknown or other
  misc_feature (133)..(133): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (498)..(498): a, c, t, g, unknown or other
  misc_feature (498)..(498): n is a, c, g, or t
  modified_base (569)..(569): a, c, t, g, unknown or other
  misc_feature (569)..(569): n is a, c, g, or t
  modified_base (580)..(580): a, c, t, g, unknown or other
  misc_feature (580)..(580): n is a, c, g, or t
  modified_base (591)..(591): a, c, t, g, unknown or other
  misc_feature (591)..(591): n is a, c, g, or t
  modified_base (635)..(635): a, c, t, g, unknown or other
  misc_feature (635)..(635): n is a, c, g, or t
tcagcatagtagtgcacgaccggtgctcgatttagtatctgatagttggggtttggggctttgcctgggtctcctggacagtcagtcacatctcctgcactggaaccagcagtgactttgtgcttataacgtntgtctctggtacagcaccaccaggtcaaacgcccaacttcttgtttgacggtcaaggtacgcggcctcgaggactcctgattcggttctctgcctcaagtctggcaacacggcctactgaccgtctgnggctcgngctgagattcggagtcagacttactaacgtgcgacggtgacgattaacgttccggaacggacccctaaaggtggggtttcgttaacggggcgggtaaccgggtagttaaaggttccgaaccggttttccgagggttacaaccggtaaccggaagtccgtccggaacccccgttgggttacccaacgtttacctccggttacccccacctttacccgactacttaaccgtntaccgcgttcggacggtaccggtcgtaacggacgtacggtccgtaacgtagtaccattcgacacgtgcctnaacggtcttanacgtacgtacncgactcgaactcgagtacgtcagtcgtagtactgtacagtagtn

SEQ ID NO: 154989 - DNA, 629 bp, Homo sapiens
  misc_feature: GYAE6OF02HVU6G.10.38.D05.1.454.CMB.1.raw
tcagcatagtagtgcacgaccggtgctcgatttagtatctgatagttgggggtttggggggggtctcaggaggcagcgctctcaggacgtcaccaccatggcctgggctctgctcctcctcaccctcctcactcagggcacgagggtcctgggcccagtctgccctgactcacgcctccctccgcgtccggtctccgtggacagtcagtcaccatctcctgcactcgaaccagcagtgtacttttgtgtacttataactatcgtctccgtggtaccagccaccaccgagaccaaacgaccccaaattcctttgttttgacgtcaagtacgccgtcctcgacggtactcctgtacgttcggttcctcgtcgtacccgtactagttcgtcggaaccaacgaccggtcctaccgtacgtacccgttctcggtcggacctcgacggtctaggaggacgtgacggtctagtaacttactcgtcgtacagccgtatactactcgaccgtacccgaggtcgggttgtggacggcggtaactagggtccgaccgtcggtcggtacaccggaccgaaggtccgtacccggtcccgttcggtacctacgttcccgttccggtaccccctcccgtacccg

SEQ ID NO: 154990 - DNA, 836 bp, Homo sapiens
  misc_feature: GYAE6OF02G9EX1.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgcttatttacgaaaggtgtccactgtgaggttcaacgtggtggagacgtggaggaggctggactccgacggccggtcgggggtccctaggacggtactcctcctggtcgcgacgtccttacgttgggttacacgcctactacgaacgtaaccgaactacaacgtcggtacccgtcgggccccgaccgacggtccgtaccgggaggggtaacggggtcgtagggtacggtcgggttccgtacgttaggtttagttaacgaaacgtaagtacgttacgggacctaacgttaacgttaactttaacgttttaacgttaccgttaacggtacccgttaccgggtacggggtaaaacccgggtttccccgggtttacccctaacccgttacccgtacccgtaaaggtaccgtaacccgttacccttaaaccgaaacctaaaccttacgttacgttttacggttaactttacccggtttaccaaacggttaccgtttacgtaaccgttaacctaaacgtttacggacgtaacggttaccggacgtaacccgacccggtaaccgtaacccttaccgttagtttaacgttcgggaacgtccggtaaccgtacgtaacttacggtaacgtacccgttacgttaacctaaccgggtttcgggtaccggggaacccggtacggg

SEQ ID NO: 154991 - DNA, 227 bp, Homo sapiens
  misc_feature: GYAE6OF02HJT78.10.38.D05.1.454.CMB.1.raw
  modified_base (224)..(227): a, c, t, g, unknown or other
  misc_feature (224)..(227): n is a, c, g, or t
tcagcatagtagtgcacgaccggtgctcgatttagtatctgatagttgggtttgggtgccgaagttgctggaggtcaccgtctccccagcctccaccaagggcccatcggtcttcccctggcgccctgctccaggagcacctccgagagcacagcggccctgggctgcctggtcaaggactacttcccactactatgctgagcgggctggcaaggcgacatagnnnn

SEQ ID NO: 154992 - DNA, 746 bp, Homo sapiens
  misc_feature: GYAE6OF02IA3UK.10.38.D05.1.454.CMB.1.raw
  modified_base (222)..(222): a, c, t, g, unknown or other
  misc_feature (222)..(222): n is a, c, g, or t
tcagcatagtagtgcacgaccggtgctcgatttagtatctgatagttggggtttgggggctttgcctgggtctcctggacagtcagtcaccatctcctgcactggaaccagcagtgacttttgttgcttataactatgtctcctggtaccagcaccacccaggcaaacgcccccaaactcctttagtttttgaggtcagtaagcggccctcgaggagtcccngatcggtttctctcgcctaccaagtctggacaaccgacggccctaccctgaccgtctcgtcgggctccgaggctgaggatgaggctagattacacgtgacgacgtcgactacgttacttcgaaccggaccccaaagtaggggttcgtttcggggcgggacgggtaaccgttaaagggtcccgtaaccggttacggttacggggactaaccggacccgaaacgggtccgttaccggtccccccgttacggtaccctaaccgtttcccgtttaccccggtttaccccctaacccccgtttacccttacccctaaacccgttaaaccgtaacgtttcgggacgttaacgggaccgggtacccggggtacggttaccggggtaacccggaaacgggtaccccggtaaccgtacggttaaacgggaccttcggactagacgtacgtcgtacgtcgtagtactacgtacgtacgacgacgtacgtacgtacgtaacgtacgtagtactacgtaccgacgtacgtcgtata

SEQ ID NO: 154993 - DNA, 742 bp, Homo sapiens
  misc_feature: GYAE6OF02G7ZH1.10.38.D05.1.454.CMB.1.raw
  modified_base (434)..(434): a, c, t, g, unknown or other
  misc_feature (434)..(434): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagacgtgggaggaggctgggactccgacggtccggtcggggggtacccctggacgtaccttcgtccctggtgaccgtacgcccgttcgttcgggttcaacggtacacgttaccgaacgttaaaccgaacttaacgatcggaacccggttccgggccccgaccgtacggccctaccgggaaggggtaaggggcgttaggacggttgggtccttgtacgttaaggttacaaacgngtacgtggacctatacgtatttatacgttcttgacgttccgtaggaaccgggttcccgtttacacccgtccgtacctaagacgtaaccctccttaaccaaactaaacgtactttaccgtttacgttaccgttacctacctaactacgtaccgtaaacgtaaccctagttaccgaggtaaacgtaccggtaccgtaaccgaacccgtacggaccccttaagtttaactttacgtgggtccgtaacgtccgtaaactgtaacctccgtaacgtcttacgacgttccgggtacggccggaacggtccccgg

SEQ ID NO: 154994 - DNA, 807 bp, Homo sapiens
  misc_feature: GYAE6OF02JS3NU.10.38.D05.1.454.CMB.1.raw
  modified_base (144)..(144): a, c, t, g, unknown or other
  misc_feature (144)..(144): n is a, c, g, or t
  modified_base (651)..(651): a, c, t, g, unknown or other
  misc_feature (651)..(651): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagtttgctgngcgtggtttccttgttgctattactaaaggtgtacctactgtgaggttacaacgtggtaggagtacgtgggaggtacggcgtagggactccgaggtcccggtcggggggttcccctaggacgtaccgttccgttacccttggtacgtccgtaaccgtccgttccgttcggggttacaacgtcctacgtaccgtaaccggtaaccgaaccgtaacacgttaccggacccgtccggggcccccgtaccggaccggccgtacggaacgggggtaacgggccggtaggggtcggttacgggttcgtaacgttaagttaacgtaacggaaactggtacgtacggactaacgtacttaatttacttaacttcggtacgtaccgttacgggtccggtaacggggttcccgttaccccgtaccgtcccgtaccgaacggttaaccgaccctttaaccctaaacccaaaccttaaccgtaattttccggttaattaccttaacgttaccacggttnaacccgtactaaaccgttacgtaccggtaacgaacggtaccgaccggtaaccgtacccgtacccttaactaacgttgttacgacgtaccgaccgtagactacggtaccttagaccgttacgacgttcggaaccggacggtcggaaccgtaccccgg

SEQ ID NO: 154995 - DNA, 725 bp, Homo sapiens
  misc_feature: GYAE6OF02FT1UI.10.38.D05.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactttgtgcttanaactatntctctgtaccancaccaccgagacaacgccccaaacttccttgttttgaggtcagtaacgccggcctcgacggtacgtccctgtacttcggttcctcgtcgtcctaccgtaagtctcggaccaacgccggtcccctccgtcgacccgttcctacgtcgggtcctccggacggtccgtacggacggtacgtacgggacggtcgttacggttaaccgttaaccgttaccgtacggtacccgacggtaaccggacttacgtttaacgttacccgaaccgggtacccctaaaccggggtagggggttttcggtttaccgggggccgggtaaccgggtaacgttaacggggtcccgacccggtttccgggtacggtacccggtaacggaccccggaaggttccccgtacccggttccccgttaccggtcccgttacccttacggtttccccggttacccccggcccctttaaccccg

SEQ ID NO: 154996 - DNA, 690 bp, Homo sapiens
  misc_feature: GYAE6OF02JGXN2.10.38.D05.1.454.CMB.1.raw
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (506)..(506): a, c, t, g, unknown or other
  misc_feature (506)..(506): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacgagggtcctgggcccagtctgccctgactcagcctcctcgcgtccggtctctggacngtcagtcaccatcgtcctgccactcggaaccagccagtcgtacttttgtagcttataactatgtctcgtgtacancaccnccacggcaaccgaccccaaactcctttgttttgagtcagtaacgccggcctacagcgtaccctgacgttcggttcttcgtacgtcctaccgtaagtccgtacggacctaaacgtccgggtacccctcccgtacggacccgttcgtccgttacgggtcctaccggtaggtccgttggaaggtcgtacggtacggtcttagtaacctttaccgtacgttaggaccgcggaccncgtaattaacgttccgaaccgggtacccctaaaggcgggggtttcgttcggggaccgtacggggtaaactacgggtccgttaacccggtcggtacgggtaccgaccggtacccaggttaccccgcccggttaaccccgttcgggtctaccgttcccggtttcccgttccccgtaccccgttccc

SEQ ID NO: 154997 - DNA, 812 bp, Homo sapiens
  misc_feature: GYAE6OF02FQ588.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggttttccttgttgctatttacaaaaggtgtccactgtgaggttcaactggtggagacgtgggaaggaggcgtggactccgaggtccggtcggggggtcccctggacgaccttccgtccgttggtcgccgtacggtcccgttcggttcgggggttaccaaggtcaacgtcgaacggtaaaccgaaccttaaccagttaccggacccgtacggggccccccgcccgacgggtacccgttccggaaacggggaacgggggtcgtacgggggacggttggggtacccgttacgtaaggttttacgttaaacggaaacgtaagtacggtacggaccttaaacgtaccgtaactttaagtttacgttcttacgtaacccgttccggttaacgggtaacggggtccccgtttaacccgacccgttacctaccgtacggtaacgaacctaccgttaacccaaactaactacgtacttacggttacttctaactacgactgacctaactaacgtctaggacgacgttaccggaaccgaaccctaccggaccgttaccgtttaacgttcggttcgttaacggcgtaacccgtaacgtaaccgtaccggtaacttacccggtaccttacggttaaaccgttccgggtacgggtaccggacgggtaccccgg

SEQ ID NO: 154998 - DNA, 699 bp, Homo sapiens
  misc_feature: GYAE6OF02HCQJ2.10.38.D05.1.454.CMB.1.raw
  modified_base (228)..(228): a, c, t, g, unknown or other
  misc_feature (228)..(228): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatcctctgcactgaaccngcagtgtactttgtgcttataactatcgttctccgtggtaccagccaccacccaggaccaaacgcccccaaacttcctttgttttggaggttcagtaacggccggccctgaaggcgttcccngtacgtcggttcctcgtccgtcctacgaacgttccgnggacccaaacgaccggtcccctacccgtcggacccgttcgtccgtcgggccctaccgacgtcttagggacggtacgtgggtaagggtcctaggtaactttaccgtaaccgtggaccgtgaccgtctaagtttaccttccggaaccggtaacccccgtaaaggtcgggggttacgtttacgggggccgggttacggggtaacgtaacgggttccgaacccggtcggttacggtcgaaccgggaccctagggtcccgttacccggccccgtaggttccctacgttcccggtacctttcccccgccctttacccg

SEQ ID NO: 154999 - DNA, 730 bp, Homo sapiens
  misc_feature: GYAE6OF02HFZZN.10.38.D05.1.454.CMB.1.raw
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (546)..(546): a, c, t, g, unknown or other
  misc_feature (546)..(546): n is a, c, g, or t
tcagcatagtagtgcacgaccggtgctcgatttagtatctgatagttgggtttggggggggtctcaggaggcagcgctctcaggacgtcaccaccatggcctgggctctgcctcctcctcaccctcctcactcagggcacgagggtcctgggcccagtctcgccctgactcacgccctccctccgcggtccgggtctccgtaggacagtcagtccaccatcctcctgctacgtacggaaccngactagtcgtacgttttgtntcttaataactgtcgtcctcgtcggtacacgacctacccaccgacggaccaaaccgacccctaacttccgtttgtttacgacggtacaacggtacgcccggtcctacggacggtaccgtccgtagtcgttcggttctcgtccgacccgtacgtaagtcgtacggaaccaaccgtccggtacccttccgcgtaccgttctacggtcggtcaccgtggaccgttgggaacgagttcggacggttcttaacggttctacgtacgtcgtacgcggactacgtaacttntacccgacccggtaaccgtacgggtgggtttcggttacgggaccgggtacggtaaacggtacggtcggtacccggtcgttacgggaccgtacccggtaccgtaccgggtccccgttaccccggccggttaccgtacccgttacccgttcccggtttaccccgttacccccgaccccgttacccg

SEQ ID NO: 155000 - DNA, 810 bp, Homo sapiens
  misc_feature: GYAE6OF02ICXGF.10.38.D05.1.454.CMB.1.raw
  modified_base (228)..(228): a, c, t, g, unknown or other
  misc_feature (228)..(228): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagcctccctcgcggtccggtctccgtggacagtcagtcaccatcctctgcactggaccngcagtgtactttgtagccttatactatcgtctctggtaccagaccaccgaccaggaccaaaccgtacccctaaattcccgttttaggtttttacggacggttaccgaacggttaacggtccggtaccctacggaacggtccgtacccgtagtacgttcccggttcctcgtccgtacccttacgtaacggttccgtaacgggtaaccctaaaccggacccggtaccctacccgttacggtaccccgttacgttccggtacgggtaccttaccggaacgggtccgtaagggtaacggtacggtgggtaacggtcgttaaacgttaacgttttaccgaacggttcggaacgttacgggcctaacgtaacttaaccggttcccgtaacccggtaaccccgtaaggtacgggggtttcgtttccggggaaccgggtccgggtaacgttaaacggggtccgtaacccggttccgggtacgggtacccgaaccggtaaccccggtaacggtccccggttacccgacccccggtttcggaacccttcccgggttacccgtttcccggttacccccccgtccttaaccccg

SEQ ID NO: 155001 - DNA, 689 bp, Homo sapiens
  misc_feature: GYAE6OF02GSH1E.10.38.D05.1.454.CMB.1.raw
tcagcatagtagtgcacgaccggtgctcgatttagtatctgatagttgggtttgggggggagaggagcccagcactggggattccgaggtgtttccattcggtgatcagcactgaacacagaggactcaccatggagttttggctgagctgggttttccttgttgctatttcaaaaggtgtccactgtgaggttcaactggtggagactgggaggaggctgggatccaggccgtcggggggtccctggacgactctcctgtcgcagcctctggttcaggcatcaagtacgaactacatcgacctcgggcccgccgacggctccgaggggacggggcgtgggaggtcgggtctcgtagttacttaggaaacagagtggacctaacgtaactattattacttcgtagtacccgttccggtacgggaaccggggtacccggtttaccctaccccgttaccttcccgaaggaaccggaaccctaaccctttaacccgaaactaaaccctatttaccgttagtaccttccgtttaccaactatacgtccaactaagttctagacggtacgtaccggacgaacgtacccggccctaaccgtttaattcgttcggcgtaccggccaacgtaacgtaacgtaccgtacgtacctacgttacgtttaccggggcgggacccggtacgggtaaccccgg

SEQ ID NO: 155002 - DNA, 834 bp, Homo sapiens
  misc_feature: GYAE6OF02HJWSC.10.38.D05.1.454.CMB.1.raw
tcagcatagtagtgcacgaccggtgctcgatttagtatctgatagttggggtttgggggggggtctcgaggaggcagcgctctcaggacgtcaccaccatcggccgtgggctcgtgctcctcctcaccctcctcactcgagggcacgacgggtccgtcggggcccagtccgtcggcccctggacctcgacgccctcccgtccgccggtccgggtctccgtggacacgtcacgtccacatcctcctgcacgtacggaaccagctaagtctattttgtcgtcttaacttaacgtatcgttccttaccgtacggtaccagaccaccccgaaccgaggaaccggtaaacccctaacccctaaaccgttcccgtttttggtttaggtaccgggtacctaagggtaaccggcccgacccctacggtacgggtacctcccgttacggacgtttcccggttacttcggtaccgtacccttaccggtaacgttcgtacccgggaacctaaaccggccccgggttcccttaacccgttacccggtccgggttccctttacggggtcccggttaccggtcccgtaacgggtccggtagggtacggtacggtacgggtacggtaccgttacggttacttaaccggtaaccgttacggtcgacggtacccgtaatcgtaccgttccgaacccggtaaccgtaccggtagggtcgttacggggcggtacgggtaacgtacgggtaccgtaccggtccggtaggtaccggccgtaccggtcggtaccctccccggtaccccgtccggttaccgtccggttcccgtaccggtcccccgtacccttccccg

SEQ ID NO: 155003 - DNA, 724 bp, Homo sapiens
  misc_feature: GYAE6OF02IG4NG.10.38.D05.1.454.CMB.1.raw
  modified_base (234)..(234): a, c, t, g, unknown or other
  misc_feature (234)..(234): n is a, c, g, or t
  modified_base (448)..(448): a, c, t, g, unknown or other
  misc_feature (448)..(448): n is a, c, g, or t
tcagcatagtagtgcacgaccggtgctcgatttagtatctgataggttgggggtttgggggggggtctcaggaggcagcgctctcaggacgtcaccaccagtggcctgggctctgctcctctcaccctctcactcagggcacgtagggtcctcgggcccagtcgtgcccgtgactcacgtccctccctccgcgttccgggtctccgaggacagtcagtaccactactctccgtnactacgtacggaacctagctagtcgtattttgtgtacttaaagtaactatacgtcctaacgtcgtaacctcgaccaaccgaccgaacgaaccgtaaaacccgtacccctaaaattccggttttacgttttaggaacggttaccaaggttaaccggccggtcctaaggaggtaccgtcctaggtacgttcggttctacgctccaacgtcgtacgntaacccgaaccgtacccggcccgttaccgtacgtacccgtgtaccggacgtacgtccgagtaacggtacggtaaacgcgttcgggtacggtactaggttaccgtactacgccgagttacgactacgtacgtacgcgtaaccgtacgttaagggtcgggtaagtcccgggaggttccgtaaaggtccgtaacggtcgttcgaacggtcgaaccggtcggtaccggacgtccccggtagtccggtcttaaccggtcccgtttacccacctccccgtac

SEQ ID NO: 155004 - DNA, 744 bp, Homo sapiens
  misc_feature: GYAE6OF02F82S8.10.38.D05.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcagcctccctccgcgtccgggtctcgtgacagtcagtcacatcncctgcacgtacggaccngcagttgtacttttgtgtactttaataacttatcgttcctcctcggtaccagccacccacccagaccaaaccgaccccctaaacttccgtttagttttggagttacaggtaacgccgtcctgaggacgtccgtgtacgttcgtctcgtcgcctacgacgtcgtggaccaaccgcggtcccttaccgtcggtacccgtcttaccgggtcggtacccgtccgacggtcgtacggaaggttacggtacggtaacggtacgttaggtaacctttaacgtacgtcgggtaaccacggtaccgaccttaacgtaacgttccggaacccgggtaaccccttaacgggtaggggtttcggtttcggggaccgggtaccggttaaacggtacggggttaccgtacccggttcggttaccgggtccaaaccggtccccggtaacggtccccgttacccggcccccgttacggtacccgttacccggttcccgtaaccccgtttaccccccgaccccctttaccgg

SEQ ID NO: 155005 - DNA, 506 bp, Homo sapiens
  misc_feature: GYAE6OF02F50Z8.10.38.D05.1.454.CMB.1.raw
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
  modified_base (448)..(448): a, c, t, g, unknown or other
  misc_feature (448)..(448): n is a, c, g, or t
  modified_base (484)..(506): a, c, t, g, unknown or other
  misc_feature (484)..(506): n is a, c, g, or t
tcagcatagtagtgcacgaccggtgctcgatttagtatctgatagttgggggtttggggggctttgcctgggtctcctggacagtcagtcaccatctcctgcactggaaccagcagtgactttgttgcttataactatgtctcctggtaccagcaccacccaggcaaaagccccccaaactccttgtttttgaggtcagtaagcggccctcaggagtccctgatcggttctctgcctccaagtctggccaaacacggcctccctgacccgtntctgggctaccgaggctgaggatgaggctgattactactgcagcgnatattcgacggccccaaacgagggttgtttgggcggcgggtaactaaggtcgaccgtccgtgggacgacgacccgaacggctcgccccctcggtcctactcgtcgttccccaccctcctccaactactancgctgacggcgggcgtggactaaggcgacgatacgnnnnnnnnnnnnnnnnnnnnnnn

SEQ ID NO: 155006 - DNA, 728 bp, Homo sapiens
  misc_feature: GYAE6OF02FJI1K.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcggtccgggtctccgtggacagtcagtcaccatctcctgcactggaaccagcagtgactttggtgacttataactatgtctctggtacagcaccaccgaggaccaacgacccccaaacttccttgttttgagtctagtaagccggcctcgaggacgtccctagacgttcggttactcgtctccgtacctaagtctgggtaccaacgtacggcccttcccgtcgtacccgtactcggtcgggctccgaggtcgtacgggacgggtactcggaacgggtaccgttaggttaactttaacccggtatccgggtacctacgggtcccgtactaacggttaccgtttcgaaccccgggacccgtaaacgggttaacggggttttcggggtttcggggtacccggggtaccgggtaaaggtttaacccggggttcggtaacccgggttcccgtgggggtacccaaccgggaccccgtaaggtccccgttacccggtcccccggttcgtaacccgacctttacccggttccgtttccccccgcccgttacccccg

SEQ ID NO: 155007 - DNA, 655 bp, Homo sapiens
  misc_feature: GYAE6OF02IITLI.10.38.D05.1.454.CMB.1.raw
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccactcctcctgcacgtacggaaccagcagtgtactttgtntacttataactatgtctcctgtaccagccaaccacccaggacaaacgcccctaaactccttgttttgngtcaaggtacgccgcctgaggacgtcctgtacgtcgttcnctctccctacaacgtcgtacggactaaccaccggtccctcccgtgtacccgttcctccggtcggcctaccgacggtctacgggaggagtcggagtccgtagtaactttacgtacgtgacgacgcgacctattaacgtcccaaccggtaccctaagggtacgggttgggtttacgggcgggttaccgggtaacgtaacggggtcgtacccggtccggtgggtaccgaccggtacccgtacggccttcccgtccccggttcggtacctcccgttcgtcccgttccccctaccccgttacccc

SEQ ID NO: 155008 - DNA, 764 bp, Homo sapiens
  misc_feature: GYAE6OF02HAX7V.10.38.D05.1.454.CMB.1.raw
  modified_base (242)..(242): a, c, t, g, unknown or other
  misc_feature (242)..(242): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacacgggtcctgggcccagtctcgccctgactcagccctcccgtcgccggtccgggtctccgtggactacgtcaatccaaccatcctcgtgcacgtcggaaaccngactaggtgtacttttgtacgacttttaaactaactagtcgtccttccggtacggtaaccagtacccaaccccgaccgaacgggaacaaaccgaacccccctaaaacgtttcccgttttaggttttaggacgttacaacggtaaccggcgtcctacgaacggtcgtccctagtacgtcgtctcgtacncctacgntcgcgtacaacgccgtcctccgtacgtcgtactcggtcggcctacgagtcgtggacggagtagggacgcgttcggtaattaccgttaactcggacgtacgaccgtacgtacttaaccgtaccggtaacccggtaaccccggtaaggttaccggggttcgggtttaccggggaccggggttaacggggaaacccgttaaccgggacccggttacccggttaccggttcggaaccggtaaccggacccggtaaaccgcccggttacccggtaccccggtttaccgtcctaccgttacccggttcccgttccccgttaccccgttacccc

SEQ ID NO: 155009 - DNA, 710 bp, Homo sapiens
  misc_feature: GYAE6OF02FSCPP.10.38.D05.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctcgccctgactcacgccctccctccggcgtccgggtctccgtggacngtcagtcaaccntctcctgcactggaaccngcagtgtactttgtntcttaatacttatcgtcctcgtaggtaccagcctaaccccgacaaggaccaaaccgtaccccctaaaactttcccgttttaggtttttacggacggtactaacggtaaccggtccggtaccccttacggaacggtaccgttcccgtggtaaccgtttccggttctacgtccgtaccctacgtacgtcgtacggacaacgtaccggtcctaccgtcgtaccgtcgtccgcgggcctccgaggtcctaggagtcgtacgggactgttacgacttaccgtacgtgaccacgcgtactactaccgtacgaaccgtaccggtaacggtagggtttcggtccggacggggtcgtaaacgtacgggaccgtcccggttgtacgggtccgaacgtacccgtacgggtccgtacccggtccccgtaccgtcggtacccttaccggtcccttacccgttcccctaccccg

SEQ ID NO: 155010 - DNA, 661 bp, Homo sapiens
  misc_feature: GYAE6OF02G8JE1.10.38.D05.1.454.CMB.1.raw
  modified_base (241)..(241): a, c, t, g, unknown or other
  misc_feature (241)..(241): n is a, c, g, or t
  modified_base (328)..(328): a, c, t, g, unknown or other
  misc_feature (328)..(328): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcacatctctgcactgaaccagcagtgacttttgtnacttatactatgtctctggtaccagcaccaccagacaaacgacccctaaactcttagttttgacggtacaagtaacgccgtaccctnacggacgtccctagacttcggttactcgtcgccctacgaagttcctacggactaacgaccggtccctcccgtacgtacccgtctcgtcgggcctaccgacggtcgtaggacggattacgggaggtactggtaacttaaccgtacgtaggactacggaccgtactacgttaacttaccgaacccgggtaccccaaagtaggggttcgtttcggggaccgggtaccgggaacgttaaggtccgtaaccgttccggtacgggtacgcggtaacccgaagggcctacccggtcccctaggtccctacgtcccgttaccgtacccccacccttacccg

SEQ ID NO: 155011 - DNA, 764 bp, Homo sapiens
  misc_feature: GYAE6OF02GNNZA.10.38.D05.1.454.CMB.1.raw
  modified_base (287)..(287): a, c, t, g, unknown or other
  misc_feature (287)..(287): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctctggtaccagccacacccaggacaaacgccccctaaactccttagtttttgaggttcaagttaacgccggtccctnaagggtacgtccctaggaacttccggtttctcgtacgtcccttaccgaagttcctagggtacctaacgaccgggtcccttacccgtacggaacccgttctccggttcggggccttccgaggtcgtagaggagttggacgtgtacggtacttaacgtcttagctaggccgtactactagttacgaccgtaccccgaacgtaaggggttccggttgggtccgggacggggtactaacgggttaccggaccggttccgttacgggtaccgtaaccggacccggtaaccgggtccgttcccgtacccccgtaccgggttcccgtaccgtttccgtttaccccgtttccccggtcccctttaacccggtaccccttaccgtttaaccttacggttacccggtacgttaacggaccggggttaccgggttacccgttcggggaaccggacggggttacccgtagaaaccggttcgtcggtacg

SEQ ID NO: 155012 - DNA, 833 bp, Homo sapiens
  misc_feature: GYAE6OF02FQBBH.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtggagggaggctgggtatccgagccggtcgggggggttcccctggagctctccgtgtgcacgcctctcgggttccagcatcaacgtaaccgactaacagtcggtacccgtcgggcccccgccgacggccgtacccggaagggggaacggggtcgtaggggacggttcgggggtaccttcgtaaggttttaacgttaaggaaaaccaaggtaagtaggaccctaaacttaaccgtaaattttaaattttaactttccgttacggtaacccgtttccccgggttaaggggtaaacccgggggttcccccgggttttacccctaaccccccgtttacccggttaaccccgaacggttaaaaccggtaacccctaacccgtttaaaccccaaaaccgttaaaaccctaacgtttaccctttacggtttaaccttacccgtttaaccctaacctacgttacgtaccgaactaaactccgtaagtaggaacggtacccgtaacgaacccacccgggtacccaaaccctttaagttacgtttcggaccggtaccggacaactacgttaacggacccgtttaccgcttaaccttaacggtttcccggtacggggtacccggaaggggtaccccg

SEQ ID NO: 155013 - DNA, 872 bp, Homo sapiens
  misc_feature: GYAE6OF02GCH9B.10.38.D05.1.454.CMB.1.raw
tcagcatagtagtgcacgaccggtgctcgatttagtatctgatagttgggtttgcgggggagaggagccccagcacgtgggtacttccggaggttcgtttcctagttcgggtagatcgacgctacgtacgaaacaacgaaggacggtacctaccaacctagtgggtttaggttttcggctaggacgtcggttttcgggtttttcctttggttcgtactttaactttaaacggtaaaagggttcgtaccctagttggtagggtacggttacctaacggttgggtaggaacgtacggtaggggaagggaggtcgtaggtacctccgacggtccgggggttccgggggtccctaggacgtccttcctccgtggtcgcgaccgtccttggtcggttacagactactacgtaacggtaaacctactacgtacgtaccggtaccggtcccggggaccccgacggaccggtccgaccgggggaaacggggggtacggggtcgtaggggtacgggttcggttaccgtagttaacggtttagtaaacggaacgtaggtacgtacgactaacgtaattatttaatttcgttactacgtaccgttcggtaacggggtaaccggttccgtaccctaccgtccaacggtaacgtaactaacccgttaacccttaaccgaaactaccttcgtttacgttaacgttacttcctaacaatacgtaactaactgttacgagtacggtaccgtaccggaacacggtacccctaacgttaacttacgtttgacgtccggaacgtaaccggttaatccgggtaaccctaccgttaccgtacgttaacgttaacccgggttcggggaccggggtaccggaaccgggtaccccg

SEQ ID NO: 155014 - DNA, 730 bp, Homo sapiens
  misc_feature: GYAE6OF02IRV98.10.38.D05.1.454.CMB.1.raw
  modified_base (119)..(119): a, c, t, g, unknown or other
  misc_feature (119)..(119): n is a, c, g, or t
  modified_base (145)..(145): a, c, t, g, unknown or other
  misc_feature (145)..(145): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
  modified_base (562)..(562): a, c, t, g, unknown or other
  misc_feature (562)..(562): n is a, c, g, or t
tcagcatagtagtgcacgaccggtgctcgatttagtatctgataggttggggtttggggggggtctcaggaggcagcgctctcaggacgtcaccaccatggcctgggctctgctcctcncacctctcactcgaggcacgcggtcncggcccagtctcgccctgactcacgcccttccgccggcggtccggtctccgaggacagtcacgtaccaacctntcctccngactacgtacggaacngtcaagttcgtactttgtactcttaactactattcgtcctacgtcggtaccacgaccacccgaacgtacggaaccaaaccggtaccccttaactttccgtttaggttttacggacgtaacgtaacggaccggccgttaccgacggtacggtcctaccggtagtccgttcggtcttacgccgtaccgtacgtaacgttcgtacggacccgtaacgtccggttcctaaccgtccgtacgtcgtcgtacggccttacggcgttacgagggcgtacgttggaacgtacgttagtaactacgtcgtggacngtaccngtttaaacnccgttcgaaacgcccggttaaagttcgggtacgggttacggcgggaacggttaaagtaccgggtaccttaccggacggttcgaaccgaccggttacccggaacgttcccggtacccggaccggttcggtccctacgtttcccggtacccttccccggaaccttacccg

SEQ ID NO: 155015 - DNA, 719 bp, Homo sapiens
  misc_feature: GYAE6OF02JK9XG.10.38.D05.1.454.CMB.1.raw
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgacgggtcctgggcccagtctcgccctgactcagccctccctccgcgtccgggtctcctggacagtcagtcaccatcctcctgcacgtggaaccagcagtctacttttgtgtacttaataactatgtctcgtggtaccagccaccaccgaggaccaaaccgtaccccctaaacctttccgtttaggtttttacggaggttacctaaggtaacggtcccggtaccctacggaacgggtaccgtccctggtacgttccggttctccgtccgcctaccgtaacgtcgtacggaccaaccgccggtcccttcccgtcgaccgtccgtcggcgggtccctaccggacgtcgtaggaggtacgtggacggtntagtacttacctngcgagccnctataccgtccgaccgacccgtaagggttcgggttacggttgggacccggtaacgggtacgtaacgggtcgtaacccgttcgggtacggaccgtaaccggtacccgtaacgggtccctaccccggttaccccggttcgggttaacccttcccgttacccgggtttccccgttacccccgtacccgttaccccg

SEQ ID NO: 155016 - DNA, 698 bp, Homo sapiens
  misc_feature: GYAE6OF02GP1PJ.10.38.D05.1.454.CMB.1.raw
  modified_base (303)..(303): a, c, t, g, unknown or other
  misc_feature (303)..(303): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatcgacctcgggccccnccgaggctccgagggaacggggctggagtgggtctcgtagttattagaaacagatggcaacgtactatagttattctagtacctccgtaggtaacgggtcccgttccacccttctaccaggaacgtaccaccgttacccaaaactaaccgtattaccgtttacgtaacttccctttaccgaacctattccggtaaccaaccgtaacttccgttaacggaaggtacggttccgaaaccggtacccgtaaccgggtaccccctaacccgttaagttttaacgtttcgggttaccgacccggttccggaaccgtagtttaccgaacccgtttaccgtaccgttaccgttaaaccggtttccgggtacccggggggtaccgtacgggggtaacccccgg

SEQ ID NO: 155017 - DNA, 815 bp, Homo sapiens
  misc_feature: GYAE6OF02GEMYZ.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtcgtactttgtgacttataactatgtctcctggtaccagccaccgacccgaggaccaaaccgacccccaaacttcctttgttttagacggttacagtaagccggtcctcgaggtactccctagacgttccgttctcgtcgcccttaccgaaacggttcctacggaccaaaccgaccggtcccttccccgtacggtaacccgttccttccggtacggggtcccttaccggaacgggtaccgtttaggaacgggtacgttacgggaacggtccgttacgtaaacgtttaccttacgttacggacgaggtaccgactaactttaaccgtccgaaccgggtaacccccgtaaagggtttacgggggtttaccggttttaccggggaccgggggttaaccggggtaaaccgttaaacgggggttccggttaacccccgggttccggttaccgggggtaaccctaacccggggtaacccccgttaacggggccccgttacccgggttaccccccccggtttagggttaccccttaaccccggtttcccgtttaccccggtttacccccccgtaccccctttaacccccg

SEQ ID NO: 155018 - DNA, 907 bp, Homo sapiens
  misc_feature: GYAE6OF02H18IY.10.38.D05.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (683)..(683): a, c, t, g, unknown or other
  misc_feature (683)..(683): n is a, c, g, or t
tcagcatagtagtgcacgaccggtgctcgatttagtatctgatagttgggggtttggggggggtctcaggaggcagcgctctcaggacgtcaccaccatggcctgggctctgctcctcctcaccctctcactcgagggcacgagggtcctgggccctagtctgccctgactcacgccctccctccgcgtccgggtctcgtggacagtcagtccaccatcctccgngaccaccggtacggaacccngtcgtagttcgttacgttttggttcgtactttaactaacgttattcggttaccttccggttaccggtaaccacgtacccgaaacccgtaaccccggtaacggaaacccaaaaccccgtaaccccccgttaaaacttttcccggttttttacggtttttagggtaaccggtttaccgaaaacgggttaaacccgggccccgggttaccccgtaacgggtaaccgggttaccccgttcccggttaacggttaccggtttcccgggttaccttcccgttacccgttacccgttaccgtaaaacgttccggtaaccgggtaacctaaacccggtcccgttccctacccgtttaacgcccgttcgtacgggttccggtaccttccggacgggtcttacgggagggttgtacgggtatacgtaacgttaccgtttaaccgtcgnggaacgaccggtaccgttaataccgttttaaccgtcccggaaccccggtaacccgtaggggtttaccgggtttgggttaaccggggacggggttaacggttacgttaacggggtcccgaccgggtttcccgggaggaccgtacccggtaaaccggtccgggtcctacccccgtcccggtattcccgaccgtttacccgtttccccgtaccccgtacccgttccc

SEQ ID NO: 155019 - DNA, 942 bp, Homo sapiens
  misc_feature: GYAE6OF02ISY48.10.38.D05.1.454.CMB.1.raw
  modified_base (177)..(177): a, c, t, g, unknown or other
  misc_feature (177)..(177): n is a, c, g, or t
  modified_base (888)..(888): a, c, t, g, unknown or other
  misc_feature (888)..(888): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcaccatggagtttggctgagctgggtttccttgttgctattacaaaaggtnccactgtgaggttcaactggtaggagacgtgggagggaggtcgtaggactccgacggtcccggttagggggggtcccctgaggacctccgtccgtgtgcgagccttcgtcgggttacagtcaactcgaacgtaaacggtactaacgagtcgaaccgttcggaccccgccgtacgggtaccttaccggaagggggaacggggctacgggaggttcggggtactccgtaaggttttaacttacgggaaaacgtagtaacgtcggggtaacctaacttaaccgtaaacgtttaatttaaccgtttacgacggttaacccggtttaacccgggttacggggtaaacccggggggtttccccgggttttaaaccccgtaccccgtttacccgtaaccccggtaaaaggtaacccgggttaaaaccccttaccccttttaaacccccgaaaaacccgttaaaacttacccgtttttaccggtttaaacggtttaccctttaaccccgtttaaacccgaaacctttacgggtaacccggtttaacaaaaccgtttaaaccgttccggtttaaggaaaccggttaacccggtttaccgggaaacccggtaaaccgttaacccccgggtaaccttaaacccggtttaagtttttaaaccggttcggtaccggtaccggtaaccgtaacttaaccgggtacccgtttaaccgaaccggttnttaaaccccggttagtttacccggggacggggtacctaaacccgggggtacccg

SEQ ID NO: 155020 - DNA, 859 bp, Homo sapiens
  misc_feature: GYAE6OF02FGE0Q.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactggaggaggctggatccgagccgtggggggtccctggacgactctcctgtcgcacgcctcgtggttcaggcatcaagtaacgactacatcggacctcgggcccgccgtacggcctaccggaggggtaacggggcgtaggggaacggttcggggtccttacgtaaggtttacgttaaggaaaacgtagagtacggaccgtaactacgtaattaacgtttacgtttacgacggtaacccgttccgggtacggggtaaaccgggggttcccgggtttaacccctaaccccgtttacgtaccccggtaaggtaaacccgggtacccttaaacccgtttaacccaaaaaccttaaaccgttaacgttacccgttacggtttaacctttaccctttaaccgtaaccgtaaacgttccgtaaacctaaaccgttaaacgtcgtaacggtaacggtaaccgttacgggaacccgtaacggtaccccggaacccgttaacctttaacggtttaacgtttaccggtaccggtacccgggttaacccgaacgttaacccggttaccggtaaaacccggtttacccggtaccgttaacccggttttaaacccggtttccggggtcccggggggttaacccggtaaccggggggttaacccccggg

SEQ ID NO: 155021 - DNA, 593 bp, Homo sapiens
  misc_feature: GYAE6OF02F95SL.10.38.D05.1.454.CMB.1.raw
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttcctgttgctatttcaaaaggtgtccactgtgaggttcaactggtggagactgggaggaggctggatccagccgtggggggtccctgagactctcctgtgcagcctcgtggtcagcatcagtaacgactacatgacctgggccccgccaggctccgagggaaggggctggaggtgggtctgtagttattagaaaacgtagatgggacacgtaacataatttattcgtagtcgtaccgttagggaacggggtcccgtttccacccttctaccgagacaaccgtaccttacccaaccaaactatcttcgttaacttcgttacaacgatcgacaactaatctagagagtacgtaacgaccacggacctaactattagttgacgtcgcgacatcgaccgttacgacctacgtaactttccgggcggggtaccaggggtaccg

SEQ ID NO: 155022 - DNA, 229 bp, Homo sapiens
  misc_feature: GYAE6OF02HLQM5.10.38.D05.1.454.CMB.1.raw
  modified_base (221)..(229): a, c, t, g, unknown or other
  misc_feature (221)..(229): n is a, c, g, or t
tcagcatagtagtgcacgaccggtgctcgatttagtatctgatagttgggtttgggtgccgaagttgctggaggtcaccgtctccccagcctccaccaagggcccatcggtcttcccctggcgccctgctccaggagcacctcagagagcacagcggccctgggctgcctggtcaaggctacttcccactactatgctgagcgggctggcaaggcgcatgnnnnnnnnn

SEQ ID NO: 155023 - DNA, 718 bp, Homo sapiens
  misc_feature: GYAE6OF02HX3SN.10.38.D05.1.454.CMB.1.raw
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (466)..(466): a, c, t, g, unknown or other
  misc_feature (466)..(466): n is a, c, g, or t
  modified_base (705)..(705): a, c, t, g, unknown or other
  misc_feature (705)..(705): n is a, c, g, or t
tcagcatagtagtgcacgaccggtgctcgatttagtatctgatagttgggtttgggggctctgctcctcctcaccctcctcactcgagggcacagggtcctgggcccaggtctgccctgactcgacgccctcccgtcgtgtcgtcgggtctccgtggacagtccatcaccatctccgtgctacgtcggacccaccgtagttactagttagtaataatagaagttatcgttcctaccgttacggtaacaaccgtacgtaccgacggactaaaccgacccccgaaatcatgttacttancgtattgactaagtaactccgtaccgtcggtaggtttactgacgttctactttntttccgcctagagtcgtacgacaaccggtactcccgtacctagctacttgcgtacgtccgacgagacgtggaaggcgtaggtctagtaaccgttatacgcgtactaggtccctanacctataaacgaggtccgcggtagggttacgggtgggtacggggtccgggtacggggacctaacgggcttaaccggggtacttaaccgggtacggtacgaaacccgtacgggtaacccgtcggtaccccgtccccggttacggaccctttaccggtccgttacccgttccccttaaccggttccctactaacccttggacccgtagtttacggccggtaacggccgtagggtaacccgnggtaccagggtcc

SEQ ID NO: 155024 - DNA, 818 bp, Homo sapiens
  misc_feature: GYAE6OF02GM9VD.10.38.D05.1.454.CMB.1.raw
  modified_base (565)..(565): a, c, t, g, unknown or other
  misc_feature (565)..(565): n is a, c, g, or t
tcagcatagtagtgcacgaccggtgctcgatttagtatctgatagttgggtttggggggggtctcaggaggcagcgctctcaggacgtcaccaccatgcctgggctctgctcctcctcaccctcctcactccgagggccacgacgggtcctgggcccagtctcgaccctgacctcagtccctccctccgccggtccggtctccgtggaccagtccagtccacctagtcctccgtgaccacgtacggaacctagaccgaagtttacgttacgttttggtttacgtaaccttttaattaaaacgttgttacgttccgttacccgttaggtaaaccccaacgtaccccaaacccccgacccggtaaggaacccctaaaaccccggtaccccccttaaaaccgttttcccggtttttaggtttttacggaccggttaccaacgggttaccggccggtacccctaaggtaaccggtaccgttccctaggtacgttcgttacctccgtccgtacccgtaccgtaagtcgtacgactaacgccgtcctccgacgtacgtctcgtcgccacgngtgacgaagtgtaacggctcgtacgtaactttaccgcgtagaccgtagtccgtatacgttactccgggaacgtaccggtaggttacgggttgggtaccggtccggaacggttaaccggtacgggttaccgtacccgggttcgtacgggaacccgtccggtaaccgtaacccgtcccgtcccccgggtttacccgtaaccggttcccgttaccgtttcccggttacccccgttcccccttaacccggttacccc

SEQ ID NO: 155025 - DNA, 616 bp, Homo sapiens
  misc_feature: GYAE6OF02I2C8V.10.38.D05.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
tcagcatagtagtgcacgaccggtgctcgatttagtatctgataggttgggtttgggggggagaggagcccagcactgggattccgaggtgtttccattcggtgatcagcactgaacacagaggactcaccatggtagttttggctgagcgggtgttggctaaggctactagtaaggntcanagtgacggtcactgtgagctaggaggngtcctagctaggcnggtcgggaccctgtacgctctctagcncgagtccntaagggtcngacgttatacagaccagttnacgtcgacgtcgcctacggtacgacggaagtaggtcacgtagtcgntcgtaagtactaanaccgtnacgtacgactanacgtatccgtaactggacgtccgtagaccgggtacgtacctcctaccgtatcgagtacggaacctttgacctacggtactacgttaacgtgacttcgaacggttactgtacgtacgtacgtacgtacgacggtacgtacgtacgtaccgaacgtacgtacgtacgtacgtacgtacgtacgtaccgtacgtccgtacgtaccgtaccgtacgtacgtaccggtaccgtacgtacggtaccggtaccgtacg

SEQ ID NO: 155026 - DNA, 747 bp, Homo sapiens
  misc_feature: GYAE6OF02I550F.10.38.D05.1.454.CMB.1.raw
  modified_base (164)..(164): a, c, t, g, unknown or other
  misc_feature (164)..(164): n is a, c, g, or t
  modified_base (527)..(527): a, c, t, g, unknown or other
  misc_feature (527)..(527): n is a, c, g, or t
tcagcatagtagtgcacgaccggtgctcgatttagtatctgatagttggggtttgggggggggtctcgaggaggcagcgctctcaggacgtcaccaccatggcctgggctctgctcctcctccaccctcctcactcgagggcacgagggtcctgggcccagtcncgccctgactcacgccctcccgtccgcggtcccgggtctccgtggacacggtcacgtccaccgacttcctacctgacctacgtacggaaacccagcaggttcgttacttttgtacgtactttataaaccttattcgttaccttccgtacggtacccacgaccaaccccaacccgtacggaaccaaacccgtacccccttaaactttccgttttcggttttacggacggtacgtaacggtaaccggccggtccctcggaacggtccgtcctcgtacgttcggttctctcgtacctccgtaacgtcgtcggacaccgccgtccctcgtcgtaccgtcgtggtccgcgtcgacggtcgtaggacgngtacgacggtctacgttactacgtcctagccgtgacctagtaacttccgtaacggaccggtaacccgtcgggtacggggtttacggtcgggaccggggtttaagacccggttaagggtccgtacggtacgtacgggtcccgaacggacccaagggtccccgttacctcccccgggttagtccccgtttacgtcccgttaccccgttcccctaccctcccg

SEQ ID NO: 155027 - DNA, 613 bp, Homo sapiens
  misc_feature: GYAE6OF02IFUBR.10.38.D05.1.454.CMB.1.raw
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (585)..(585): a, c, t, g, unknown or other
  misc_feature (585)..(585): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgctactggaaccngcacgtgacttttgtgcttaataactatgtactcctggtaccagtcaccacccagcaaacgccccaaactccttgttttgagtnaacgtagcgtcctagagacgtccctgtagtcggttcnctcgcctcaacgtctcggactaacgccgtcctacccgtgtacccgtcgtacgttcgggccttccgaggtctacgaggtactcggagtctacggtaacttaccgtacttacgcgacggtccactagtacttacgaaccgaccctaaaggtgggttgtttcgggaccggtcgggtaaccgtaacggtcgaccgttccgtagggtcaacgcccgaaggtccctccgccccgttggtaccnccttacgttccgtccccgccttaccccg

SEQ ID NO: 155028 - DNA, 705 bp, Homo sapiens
  misc_feature: GYAE6OF02GZ5EU.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacacgggtcctgggcccagtctcgccctgactcacgcctccctccgcgtccggtctcgtggacaggtcggtcaccattctcctgcactcggaacccagcactgattggttggactattaactaccttgtctccgtgtactacaacaccgccaagaccaaccgccccactaccttctgtactttagtaggtaacgtcaacggtaacggcggtacccttcggtaacggggtttcctacggtcctaccttcgttcgtccgtcctaccgtaatcgtacggacctaacccgccggtaccctccctagaacctaacgttcccgtacggtcggtccgtaccgacggtacgtacgaccggaacggacggtaccgtacgttaattaacttacgtcggacacgtacgtactacgttattagtacgtaggtcggttacgttaccgtttaccgtttaacggttacggtttcggaccgggttacggacgtaccggtacgtaaccggtaccgttaccgtaacggtccgtaaccggtaccgtacggtcccgtacccggtccccgttccggtaccgttaccccg

SEQ ID NO: 155029 - DNA, 823 bp, Homo sapiens
  misc_feature: GYAE6OF02H6R4X.10.38.D05.1.454.CMB.1.raw
tcagcatagtagtgcacgaccggtgctcgatttagtatctgatagttgggggtttggggggggtctcaggaggcagcgctctcaggacgtcaccaccatggcctgggctctgcctcctcctcaccctcctcactcgagggcacgacgggtcctcgggcccagtctcgccctagactcacgtccctcccgtccggccgtccgggtctccgtaggactagtcacgtaccacctacttcctctcgacctacgtacggaaccacgtcgtagttcgtacgttttggtacgtaactttaattaaccgtattccgttacctaccgtacggtaccacaccaaccccgacggaaccgaccaaaccctaaccccttaactttccgttttaggtttacggacgttaccgtaacggtaccggtccgtaccgtacggacggtacctccgtacggtacgttccgttactccgtccgtaacctcgtaaggtccgtacggaaccctaccgtaccggtcccttacggtccgtcgttaccgccgggttaccgtaccgtaccggacggttccggtaagggtacggtaacggtcggtacggttacgttacgttaacgttaacgcggttacgaacgtcggacttacgtaaacgttaccgaccggaaccgttaaccggacggggtttacgggttaccggggtcgggaaccgggtacgggttaacggttaccgggcggttaccggtcgggttaccggtaacgaccggtcccggagttaccccgttcccggacccgttacgtcccgttaccctttcccggtaaccccggtccctaccccggttaccg

SEQ ID NO: 155030 - DNA, 679 bp, Homo sapiens
  misc_feature: GYAE6OF02IOCXA.10.38.D05.1.454.CMB.1.raw
tcagcatagtagtgcacgaccggtgctcgatttagtatctgatagttgggtttgggggggggtctcaggaggcagcgctctcgggacgtctccaccatggcctgggctctgctattcctcaccctcctcactcgaggcacagggtcctgggcccagtctgccctagctcagcctgacctccgtgtcgtgggtcctccgtaggacagtcgatcactatctctgcactgcaccagcagtcgactataggtcgtacttataactatcgtcctcgtacgtaacctaacaaccacccgacggcccgaccgccccgagtacctcactctatttcgtgactcgtcgtagtgtaacgtccggttccgttagggtacttttacgtaacttcgtaccttctcctacgtccctacgtacgttcgtacggtacctaaccgtaccggtacccttcccgtacgtaaccctcgttacccgtcccgggtccttaccgtaaccgccgtaggacgggtaacgacggtaccttacgtaactttacgtactcgacgtacgtaccgtacttaactaccgtaccgaccggtaccggactaccgttcgtaccggtatacgttacggtcgggtaccgggaacggtaccgtcgggtaccttccggtaccgttaccgtaccggtaccgacggtacccgtaccggg

SEQ ID NO: 155031 - DNA, 780 bp, Homo sapiens
  misc_feature: GYAE6OF02H0QW9.10.38.D05.1.454.CMB.1.raw
  modified_base (512)..(512): a, c, t, g, unknown or other
  misc_feature (512)..(512): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacgagggtcctgggcccagtctgccctgactcacgccctccctccggcggtccgggtctcgtcggacacgtcacgtcaccatcctccgtgcctacgtaggaaccagcagtgtactttggtgtacttaataactatcgtctccgtcggtaccacgaccaccacccgaggaccaacgaccccctaaacttccttttggtttagacggtaccaggtaaccgccgtacccgtcgaacgggtacctcccgttaggtaccgttcggttcctccttccggtccccttaccgtaacggttcgacggtaaccaacggtacccgtccctacccgtacgtacccggttccgtcgtcgggtccctaccgacggtcgtacggtaggngtacgggtacgtcgtaagttacttaaccgttaccacggtaccgacggtaccgtcgttaacttaccgtacccgtaacccggtacccgtaaacgggttacgggttcggtttaccgggggccggttaacggggtaaaccgttaacgggttccggtaccgttacggggacggttaccgaccgggaacccggttacggcccgttccccggtaccccgttccggttcccgtacccgttccccggtttaccgttccccccgtacccgttaccccg

SEQ ID NO: 155032 - DNA, 813 bp, Homo sapiens
  misc_feature: GYAE6OF02GLDHX.10.38.D05.1.454.CMB.1.raw
  modified_base (799)..(799): a, c, t, g, unknown or other
  misc_feature (799)..(799): n is a, c, g, or t
tcagcatagtagtgcacgaccggtgctcgatttagtatctgatagttgggtttggggggggtctcaggaggcagcgctctcaggacgtcaccaccatggcctgggctctgctccttctcaccctcctcactcagggcacgagggtcctgggcccagtctgccctgactcagcctccctccgcggtccgggtctcctggacagtcagtcaccatcctcctgcactcggaaccagacagtgtacttttgtgacttataactatgtctcctcggtaccagaccaccacccaggaccaaacgaccccctaaacttcccttttaggttttagacggtacgtaaggtaacgccggtcccttcgacggtacgtcccgtgtacgttccgttcgtctcgtaccctaccgaacgttccgtacgggtaccaaccgtaccggtacccctttacccgtaccggtaccccgttcgttcccggtacggggtcccttacccggacgggtccgttacgggaaagggtacgttcgggaacggtccttagggtaaaccttttaccgttacgtacggaccgtacggtaccggtaacttaacgtttaacgttacccgggaaaccgggtaaccccctaaaggggttaccggggtttcgggttttccgggggaccggggttacggggaaacccgtttaacgggggttaccgacccgggttccgttccggggtaaccgtaaccgggaccctaacggggtcccgttacccggtcccccggttaccgggttccttaacccggttccttaccccggtttacccccncccccgttaacccc

SEQ ID NO: 155033 - DNA, 798 bp, Homo sapiens
  misc_feature: GYAE6OF02H4BF5.10.38.D05.1.454.CMB.1.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctctacactcgagggcacgagggtcctcgggcccagtctcgccctgactcacgccctccgcgcgtccggtctcgtaggactgtcacgtcaacctntcctcctgaccaacgtacggaaaccngtacaggttcgttacgttttcggttacgtactttaacgtaacgttacttcgttccgttaccgttacggaccgtaacgaccgaaccccgaaccgtaacggacctaaaacccgtaacccccttaaagtttcccgtttttagttttacggacggttaactacggtaacggtccgtaccgtacggaacggtacgtcccgtagtaccgttcgttctacgtcgacctaccgtaagtcgtacggtaacaaccggtccgtcccttaccgacgtacccggtttaccgcggttacccgggtactaccgggtacgttacggtacggggtaaacggtggttaaccgtacgggacgttaagttaacccgtttacgtacggtcgtaccgaacggtacgtaacttacggtaccgttaccggaacccgtaccgtaaaccgggttgggtttacggtacgggtaaccgggcggtaaaggttacggaccggtcggttaccgaacgggccttacggacccgaggtcccgtcccgtcccgttagtacctcggttccctaccgtccctacgtaccc

SEQ ID NO: 155034 - DNA, 774 bp, Homo sapiens
  misc_feature: GYAE6OF02JPQV9.10.38.D05.1.454.CMB.1.raw
  modified_base (253)..(253): a, c, t, g, unknown or other
  misc_feature (253)..(253): n is a, c, g, or t
  modified_base (735)..(735): a, c, t, g, unknown or other
  misc_feature (735)..(735): n is a, c, g, or t
tcagcatagtagtgcacgaccggtgctcgatttagtatctgatagttgggtttggggggtaggagggagcccagcactgggattccgaggtgtttccattcggtgatcagcactgaacacagaggactcaccatggagttttggctgagctgggtttccttgttgctattcaaaggtgtccactgtgaggttcaactggtggagactggaggaggctggatccgagccgtcgggggtcctggagacctctccngtcgcacgcctcgtcgggttcaggcacttacgacgttaaaccggtactaactacttagaacccgttcggggaccccggtaccgaaggtccgtacccggaagggggaacgggtcggtacgggtagggtcggggtaccgttcgtaaacggtttaactttagggaaaaactaggtaagttcgggacctaaacttacctaaagtttaatttacgttccgttacggtaacccgttaccggtagggtaaaccgggggttccccgtttaaccggaccccctttcgtacccgggaaagtaccgaaaccgttcccttaaaccgaaacctaaaccgtacttcgttacgttacttcctttacgaacttacgctaacccgaacttaacgactttccggaagtacgggttacccgaagccccgttaaaccggccctttaaacctagtttaacgttgacgggtcctaacgctaaacgggtcaacgttcccgtaacncgttaacttccgggtacccgggagttaccgggaccccgg

SEQ ID NO: 155035 - DNA, 818 bp, Homo sapiens
  misc_feature: GYAE6OF02F6OSJ.10.38.D05.1.454.CMB.1.raw
tcagcatagtagtgcacgaccggtgctcgatttagtatctgataggttgggtttggggggagaggagcccagcactgggattccgaggtgtttccattcggtgatcagcactgaacacagaggactcaccatggagttttggctgagctgggttttccttgttgctatttacaaaaggtgtccacgtgtgtacggttcaacgtggtggagacgtgggaggaggcgtcgggactccaggtcccgggttcggggggttacccctaggacgtaccgttccttccgtcggtcgctacggtccgtcgttgggttccacggctatacaacgtacgtactacagtcgacccgtacgggcccccgacgacggcctaccgggaagggggacgggtacgtcgggaacggtcgggtacgtcgtaaggtttacgttagaaaacgagtacggtacgggacctaacgtaaccgttatttaacgtttaactttccgtagtaacccgttcccggtaaggggtaaccggggttccccggttacccgtaaccccgtttcccgtaacccgtaccggtaaacccgtacgttaaacccccgtttaaccaaaacccggtaaacccttaaccttttaccggtttactttaaccttacctaccctaacggtttaactacggtaacctaacccgttaaagttaccgtaaggaacgtacgggttaccgtaccgaaccgacccgtaccaaccgtttagttaccgtacgtcggtaccgtacgtacctacgttcgaaccgtcgaccttacggtaaccttcgggaccgggtacgacgggtaaccccgg

SEQ ID NO: 155036 - DNA, 734 bp, Homo sapiens
  misc_feature: GYAE6OF02F5CJ8.10.38.D05.1.454.CMB.1.raw
  modified_base (388)..(388): a, c, t, g, unknown or other
  misc_feature (388)..(388): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgttgggttttccttgttgctatttacaaaaggtgtccactgtgaggttcaacgtggtggagacgtgggaggaggcgtggatccgaggcccggttcgggggtccctggacgtacctcgtccgtgtcgcacgtccttcgtggtacagcatcgaagtaaccatacagtcgaccgtcggcccgccgcggtccgaccggaggggaacgggtcgtagggtaggtcggtcttgtagttagtagaaacnggacgtgactactactattacttctcgtgaccgttcggtacggaacgggtcccgtacctaccccgtactaccgtaaggaccgtaacctaaccccttacaaaacctaacttccgttacgttaacgttccttaccgtaccgtataccggtataaccctaactattccgtaaacggacggttaccggaccggaaccgtaacccgggacccgttaaccctaaacgttttacgttacgttcggaccggtaccgaaccggttaagtaaccgtaaccggttaacccgttaacgttcccgtaacgtttaaccggtttccgggggacggttaccccgggtacgggtaacccccgg

SEQ ID NO: 155037 - DNA, 631 bp, Homo sapiens
  misc_feature: GYAE6OF02GSUK6.10.38.D05.1.454.CMB.1.raw
  modified_base (506)..(506): a, c, t, g, unknown or other
  misc_feature (506)..(506): n is a, c, g, or t
tcagcatagtagtgcacgaccggtgctcgatttagtatctgatagttgggtttgggggggaggaggagcccagcactgggattccgacggtgtttccattcggtgatcagcactgaacacagaggactcaccatggtagttttggctgagcttgggttttcctttgttgtcttatttacaaaaggtgtcctactgtgtaggttcgaacgtgggtggagacgtagggagggaggcgtggatccagccggtcgggggtccctggagactctcctgtcgcacgtcctcgttggttcagccatacgtagtaacgtacctacatcgaccgtcgggcccgcgacggcgtaccggacggggaagggtcgtggaggtgggtctcgtagttatagaacgagagtggacactactattattacttcgtgtaacctcggtacggacggtccgtccaccctcacctagacacctactaccaactaactatcttgtacttctacacgtatacgcctaanacttcgagacggtagacgaccggtaacacccgggtacctaacgttacttgtttacggcgtcggactaacgcgttaacgccttaaccgccttaccgtagttccgggtacgggtccggaagacccgg

SEQ ID NO: 155038 - DNA, 610 bp, Homo sapiens
  misc_feature: GYAE6OF02G2HKD.10.38.D05.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (269)..(270): a, c, t, g, unknown or other
  misc_feature (269)..(270): n is a, c, g, or t
  modified_base (278)..(278): a, c, t, g, unknown or other
  misc_feature (278)..(278): n is a, c, g, or t
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
  modified_base (462)..(462): a, c, t, g, unknown or other
  misc_feature (462)..(462): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcacgccctccctccgcgtccggtcctcctggacngtcagtcaccatctcctgcacgtggaaccngcagtgtactttgtgcttataactntntctctgtaccnncaccaccngacaaccgccccaacttcgttgtttgacgtcagtacgccgtcctgaggaccgtcctgtacttcggttctcgtcgtcctactagtcngacaacgacggctacctcccgtcgtaccgttctcgtcgggtcctccggcggtcgnggtaggtcgtaggacggtatacgtactttacgtacgtgaccgngactctaagttacgtccgaccgtacccgtagggtcggttacgtcgggaccggtacggacgtacgggtcgtaccggttcgtcgggacctacgacccgtagtcccgtcccgtcccgttcggtaccgtccgttcgttcccgtccccgtccc

SEQ ID NO: 155039 - DNA, 764 bp, Homo sapiens
  misc_feature: GYAE6OF02JP0L0.10.38.D05.1.454.CMB.1.raw
  modified_base (247)..(247): a, c, t, g, unknown or other
  misc_feature (247)..(247): n is a, c, g, or t
tcagcatagtagtgcacgaccggtgctcgatttagtatctgatagttgggtttgggggggtaggaggagcccagcactgggattccgaggtgtttccattcggtgatcagcactgaacacagaggactcaccatggagtttggctgagctggttttcctgttgctattacaaaggtgtccactgtgaggttcaacgtggtggagacgtggaggaggcgtggacgtccgagccggttcgggggtcccnggaacgcctcctccgtggtcgcgacgtcctcgtggtacttcggccctcgtcggagtttcgaaccgtttcgacgtgtaacctactacatcggaccgtggtcccgccgacgtccgtccgggaaggggtacggcgtgggtaggttcgggttcagttaacgtagttttacgtccgttaggtaggttacaacgtttaccaacgttaacttaaccgtacggacaaaacggttaccgttcgtacggtagggtaaaccgggccccggttataccctaaccgtactcgttaaacccggaggaaacctaccgaaccgtaaacgtaactcccgggtattaaccgtacggtttaacgaaccaaagttacccgtaaccaaccgtcggaccgaaccggtaccggaaacgtccggtaaaccggttaccttaaagttccgttaacggcgtaccggggtaaacgtaaaccttaaccgttaacccgggtttctcggtttaacccggtttacgtttacccgttaacggtaacccgg

SEQ ID NO: 155040 - DNA, 656 bp, Homo sapiens
  misc_feature: GYAE6OF02FUL4C.10.38.D05.1.454.CMB.1.raw
  modified_base (259)..(259): a, c, t, g, unknown or other
  misc_feature (259)..(259): n is a, c, g, or t
  modified_base (501)..(501): a, c, t, g, unknown or other
  misc_feature (501)..(501): n is a, c, g, or t
tcagcatagtagtgcacgaccggtgctcgatttagtatctgatagttggggtttggggggggtctcaggaggcaggcgctctcgggacgtctccaccatggcctgggctctgctattcctcaccctcctcactcgagggcacgagggtcctgggacccagtctgccctgactcagcctgcctcgtgtctgggtctcctggacagtccatccaccagtcctcctgcacgtcgacccacagttacattaggaatatgaatntgtctctcggtaccaacacgtaccaggacaaacgcccccaaactgatcgtatttatagtatagtactaagtaacgtaccgaccgtcggtaggggtttctagtactcgtactttcgttcgcctaccgtaacgtcgtacgaccaacgaccggtccctaccctacgacctacgtccgtccgtagggccctaccgacggtacgtacggaccggacgtacggctagtactttaactacgtcgacgancctaccactaacgtaccgaacggtcgacgtacgggttggggttacgggttcggttaccggggccggggtacccacgtaccgtacgggtacccgttacggtacggtaccgaccggtacccgaacggtccgtacccgcccgtcgtactccgttcccg

SEQ ID NO: 155041 - DNA, 659 bp, Homo sapiens
  misc_feature: GYAE6OF02HKNZF.10.38.D05.1.454.CMB.1.raw
  modified_base (378)..(378): a, c, t, g, unknown or other
  misc_feature (378)..(378): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccagtggagttttggctgagcgttgggtttttccttggttgctatttcaaaaggtgtccactgtgaggttcaacgtggtggagacgtggaggaggcgtggatccaggcccggttcggggggtcccctaggacgtaccttccgttccgtgtcgccacgtcccgttcgtgggttcagctatcgaagtaaccgactaacacgtcgaccgtcgggaccccgccgacggccgtaccggaggggacgggcgtgggnggtcggtctagtagttatagaacgagagtagactactactaattattattcgtacgaccgtcggtacggacggtccgttccaccctcgacgacgacgtactacctacaaacgtactacttacgttctacttactcgactgttcactacgtaactcgtaggacgtacgacggaaccgaccggacccgtacctaacgtttattacgttcgtacggtaccgccgtagtactacgtaccctacgtacgtacttaacggtccgggcgggtaacccggacggacccg

SEQ ID NO: 155042 - DNA, 807 bp, Homo sapiens
  misc_feature: GYAE6OF02JKYCB.10.38.D05.1.454.CMB.1.raw
  modified_base (239)..(239): a, c, t, g, unknown or other
  misc_feature (239)..(239): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctctcactcagggcacagggtcctgggcccagtctcgccctgactcacgcctccctccggcgtccgggtctccgtggacagtcacgtcaccatcctacgtcgacacgtcggaaccnggacaggtcttacgttttggtcgactttaacttaacgttacgtcgttcctccggttacggtaccacgcccaaccgacccgacggtaccaaaccggaccccctaaactttccgttttaggttttacgacggttaccgtaagggtaaccgccggtaccccgttacgacgggtaccgttacccgtaggtacgttccggtttccgtcctacggtacccttaccggaacgttccggtacggacctaacccggtccggtacccttcccgtacgttcccggtccgttcggtacgggtccctaccgggtacgggtcctacgggaacggtacggtcggtaacggtctttaacggtactttaacggtccgttcgacgtaccgtcgttaactacttaccgtacccgaaccgggttacccgtaacgggttacgggttccgggttacggggaaccgggtccgggttaaacgtaacggggtaccggtcccgggttacgtacgggacctaccgggtaccggaacggttccgcccggtacccggttcggtcctaccgttccggtacccgttcccgccttacccg

SEQ ID NO: 155043 - DNA, 784 bp, Homo sapiens
  misc_feature: GYAE6OF02JES9G.10.38.D05.1.454.CMB.1.raw
  modified_base (220)..(220): a, c, t, g, unknown or other
  misc_feature (220)..(220): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctaccngtccactaggaaccagacacgtggtacgttggtaggttaactaactatctctccgtacggtaaccaaacaaaccgacctagaaccaaaaccgaccccctaaacgtactaacttagtaattttagactagtactaagtaacgtcgacccgttacggtagggtttactaacgtcgtaccttcgtcgtcgtacctacgtaaagttccgacgaccaaaccggtaccggtacccttacccgtacgtaacccacgttccgtacggttccgtaccgtacccgtaagggacgtcggtaaacgggacggacggtacgttacgtaactttaacgttaacgtactaccggtacgtaccgtaaactaacgtaaaccttaaccgaaaccgaacgtaccgaccgtaccgtttaaccgtttcgtttagttaaccgggttaccggaaccgggtacgggtaaccgtaacgtaccggttacccggttaaaccgttcccggttaaacggtacccgaacccgttaacccggaacgggttaacccgtccccgggtacccccgtttacgggtaccccttaacccgg

SEQ ID NO: 155044 - DNA, 740 bp, Homo sapiens
  misc_feature: GYAE6OF02H7QQP.10.38.D05.1.454.CMB.1.raw
  modified_base (419)..(419): a, c, t, g, unknown or other
  misc_feature (419)..(419): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcaccatggtagtttggctgagtcgtgggtttttccttgttgtcttatttacgaaaaggtgtccactgtgtaggttacaacgtgggtggagacgtgggaggaggctggctccgagtccggtcgggggtcctgacgtactctctgtgcacgtctcgttcgggttacacgactataccgtaagtaaccgactaactacgtcggacccgtcgggccccgccgtacggccgtaccgggaagggggaaggggcgtaggggtacggttcgggttctacggttaagttagttaggaaaacnggtagtcggactataacgtatttacgttattcgtcgtaccgttcggagggtaccgggtccgttacccgtacccttccgtaccgacggtaaccgtaactaacccgtaaccaaaacgtaacctactttaccgtttgttaaccttcctttaacgaactaccgttgaacctaactacttagtaccggacgttaaccgtaccggaaccgaacccgtaccgtaaccctaacttgtttacgttgtccgtacggacctactaacggtaacgtaccctacggtaccgtttacctagggttccgggtacgggaccgggaccgggtaccccg

SEQ ID NO: 155045 - DNA, 781 bp, Homo sapiens
  misc_feature: GYAE6OF02HLMRR.10.38.D05.1.454.CMB.1.raw
  modified_base (614)..(614): a, c, t, g, unknown or other
  misc_feature (614)..(614): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgttgggttttccttgttgcttatttacaaaggtcgtccactgtgtacggttcaacgtgggtaggacgacgtagggaggaggcgtaggactccgaggtccggtcggggggtccctgagtacctctccgtgtcgcacgcctcgttcggttcagcatacgtaagtaacgactaacgagtacgaccggtcgggaccccgacgaccggtccgtacgggaacggggacggggtcgtcgggacggttcgggtaccttagtacggttacgtaacggaaaccgaggacgtacgtacctaacctaaccgtatttaacgtttacgttacgtacgtaacccggtcggtaacgggtacccggggttacccgttacccgtacccgttaccgtaaccggtaaaggtaaccgtaaccctacccgtttaaacccaaaccgttaaactccgtttagttacgttaactcccttaccgaacttacncggtaacaaaccggttataccggaggtaccgtacggtacccgaaccgtaccggaccggttaaccctaagtttgttaacgtcgtaccggaccgtcgaacctacgttacgaaccttaacggccttaccggttacggttacccgggaccggacggaacccggtacccggg

SEQ ID NO: 155046 - DNA, 627 bp, Homo sapiens
  misc_feature: GYAE6OF02JUBFZ.10.38.D05.1.454.CMB.1.raw
  modified_base (141)..(141): a, c, t, g, unknown or other
  misc_feature (141)..(141): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (516)..(516): a, c, t, g, unknown or other
  misc_feature (516)..(516): n is a, c, g, or t
tcagcatagtagtgcacgaccggtgctcgatttagtatctgatagttgggtttgggggggtctcaggaggcagcgctctcgaggacgtcaccaccatggcctgggctctgctcctcctcaccctcctcactcgagggcacngggtcctgggccctagtctgccctgactcgacgccctccctcgcgtccgggtctcctggacngtcagtcacctatctcctncctatcggaacctgcagtgtactttgtancttaatactatcgtctccgtacgtaccngtaccacctacccgaggaccaaccgacccctaaacctttcgttcgtttcgagtctaacgtacggccgtccgtacgacgtacgtccgtagtacgtcggtacctgtcgtaccgtctacgtcctgacctaaccgtcggccctaccgtcgaacctgtacctcgtacggcctaccgccgtctaggtacgagtcgagtctaacgtattacttagttccgtgtacctactatcgtcggtaccgnggttaccgtacgtcggttggtccgtacgggacggtaccgagtacgtcgtcgtaacgtcgtaagccgtacgcgtaccggtcgtaccgtccgtacgactccgtccttacccgg

SEQ ID NO: 155047 - DNA, 703 bp, Homo sapiens
  misc_feature: GYAE6OF02F6F43.10.38.D05.1.454.CMB.1.raw
  modified_base (224)..(224): a, c, t, g, unknown or other
  misc_feature (224)..(224): n is a, c, g, or t
  modified_base (267)..(267): a, c, t, g, unknown or other
  misc_feature (267)..(267): n is a, c, g, or t
tcagcatagtagtgcacgaccggtgctcgatttagtatctgatagttgggtttgggggctctgctcctcctcacctcctcactcagggcacagggtcctgggcccagtctgccctgactcagcctccctccgcgtccgggtctcctggacagtcagtcaccatctcctgcactggaaccagcagtgtacttttgttgtcttataactatgtctccgtggtaccngcaccacccaggacaaaccgaccccaactccttgttttgagtnagtagcgcctgaggacgtccagtacttcggtctctcgcctcagtcgcgacaccgccgcctcccgagtcccgtcgtcgtggtacctcgcggtcgtggaggagttggacggtctagttacttactacgtgtacgacgtccgactagttaccttccggtaaaccggaccccgtaaacggttcggggttaggtttccgggggccggtaccggggtaagtacggggtcgttacccgggtaccggttcggggaacctacgggacccgtaacggtccgttccccggtaccccggtacgttacccgtccggttacccgtttcccgttaccccccgttccccttaacccgtacccttaaccgttaccggtacttccgggtacttcggggaaccgttaccggggccgttaacgggacccggaccgggtacgacgtaccgtgagtcg

SEQ ID NO: 155048 - DNA, 812 bp, Homo sapiens
  misc_feature: GYAE6OF02GDB9L.10.38.D05.1.454.CMB.1.raw
  modified_base (233)..(233): a, c, t, g, unknown or other
  misc_feature (233)..(233): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcagcctccctccgcgtccgggtctccgtggacagtcagtcaccatctcctgcacgtggaaccngcagtgtactttgtgtacttataactatgtctctgtatcagccaccaccaggaccaaaccgtccccctaaactttccgttttaggtttttacggacggttacgaaggttaaccggcccggtaccctacgaacgggtaccggttaccccgtaggtaccgtttccgggtttcctcgtcggtcccttaccgtaaggttccgtacgggacctaaccggtacccggtccccttacccgtacggtacccgttcctacgggtcggggtaccctaccggtaggtcgtagggaggtacgtcggacggtcgttacgtaactttaccgtacgtcgtaccgtacgggccttactacgttacgttacccggaacccggtaccccgtaaagggttcgggggtttcgggtttaccgggggaccgggtaaccggggttaaacggttaacggggttccggacccgggtttaccgggttacggggtacccgtaaccgggtaaccccgggtaacgggttccccgttccccgggtacccccggtttacgggtacccgttaacccggttcccggtttccccggttaccccccgttccccg

SEQ ID NO: 155049 - DNA, 671 bp, Homo sapiens
  misc_feature: GYAE6OF02IT1K7.10.38.D05.1.454.CMB.1.raw
  modified_base (178)..(178): a, c, t, g, unknown or other
  misc_feature (178)..(178): n is a, c, g, or t
  modified_base (211)..(211): a, c, t, g, unknown or other
  misc_feature (211)..(211): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgagggtcctgggcccagtctgccctgactcagcctcccnccgcgtccgggtctcctggacagtcagtcaccntctctgcactggaccagcagtgtacttttgtagcttaataactatcgtcctcctcggtaccagaccaccccacccgaggaccaaaccgaccccctaaacttccctttaggttttacgacggtctaaggtacgccggccctacgacggacgttcccgtgtacgttccggttcctcgtcgtaccctacgtaacgtccgtcgaccaaccgaccggtcccctccgtacgacccgttcgttccgtggccttaccgaggtcgtacgggaggtagttcggacggtctaggtaacttaccgtagtcgacgcgtcgtactactacgtacgaccggtacccgtaggtcgggttcgttcgggcgggtaccggtagtacgggtcgccggtacgtcgggtaccaccggaccggacgtccgtacccggacccgtccgggtacctaccgttccgtcccgttccccgcccttaccc

SEQ ID NO: 155050 - DNA, 747 bp, Homo sapiens
  misc_feature: GYAE6OF02IOG5G.10.38.D05.1.454.CMB.1.raw
  modified_base (568)..(568): a, c, t, g, unknown or other
  misc_feature (568)..(568): n is a, c, g, or t
  modified_base (685)..(685): a, c, t, g, unknown or other
  misc_feature (685)..(685): n is a, c, g, or t
tcagcatagtagtgcacgaccggtgctcgatttagtatctgatagttggggtttggggggagaggagcccagcactgggattccgaggtgtttccattcggtgatcagcactgaacacagaggactcaccatggtagtttggctgagtcgttgggttttccttgttgtcttactttacgtaaaaggttgtccacgtgtgaggttacaacgtgggtaggagacgtagggacggaggcgtaggactccgaggtccggtcggggggtccctggacggtaccttccgtccgtggtagtccgacgtccgttcgttgggttacaggtctacgtacgtacggtaaaccgtactactacggtcgtacccggtccgggaccccgtacgaccggtacgtaccgggaacgggggacgggtccggtagggtacggttcgggtactcgttaaggttacgtaacggaactaggtagtacggactacgtaactatttagttacgtcgtacgtaacgtcggtacgggtaccggtcccgttacctacctcgaccgtaagctaacctaccttaccgaaacacgttntcgttaacgtacttctacgactagtccgacaaacccttgtacggtagacgtaccgggtaaccaccggtaacgtacccgttactaaaccgttatttcgggccgtaggccggtaacctntacgtaccgtaaccctacgtactaccgttaaggcccggggtacgacccgggtaggaacccgg

SEQ ID NO: 155051 - DNA, 763 bp, Homo sapiens
  misc_feature: GYAE6OF02IL5SY.10.38.D05.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacngtcagtcacatctcctgcacgtggaaccngcagtgtactttgtgtacttataactatgtcttcctaggtaccacgcctaaccccgaccgaaggaccaaaaccgacccccctaaaacttcccgttttgtttttacggacggttacctaaggtaacggtcccggtccccgttacggtaggggttttaccgtaggttccgtccttccgttcctcgtccctacgtaacggtcctacgggacaacccggaccggtccctaccgtacgtaacctaacgttccgttccgggtacggtcccgttaccgacgggtccgtacgggaaccggtaacgggtacgttacgtaacggtaacttaacgtttaccgtaggtacgtacgtaccttaacgtaacttacgttaggtaagtacgttcgggtacgtttccgttacgttttacggttacgggtttacgggacgggtaacggaccgtaggtaccgttaccggtaccgtaccgtaacggtaccgtaacgtacccgaacggtccgtacccgtcccggtaccggtacttacccgttccgttaccccgg

SEQ ID NO: 155052 - DNA, 603 bp, Homo sapiens
  misc_feature: GYAE6OF02G5D5L.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggcgtggatccgaggccgttcggggggtccctggacgactcctcctgtcgcacgtcctctgggttcagctactcaagtaaacgactaacatcgaccgtcgggcccggccaggctccgaaggggacggggctgggaggtgggtctgagttagttagaaacagatggcaactacagttaattacttctacgtactcggtaggaacgggtcccgttcgaccctcgtaccgagacgaactccgtaccaaacgaactattcctgttacttcttacacatcgacactatctagagcgtccgaacgaccacggccttaacctagttacttgtacgcgacctagtactacgcctaagtcccgttactacgtacggtacgggtaccagggtaacccg

SEQ ID NO: 155053 - DNA, 708 bp, Homo sapiens
  misc_feature: GYAE6OF02GGDUO.10.38.D05.1.454.CMB.1.raw
  modified_base (284)..(284): a, c, t, g, unknown or other
  misc_feature (284)..(284): n is a, c, g, or t
tcagcatagtagtgcacgaccggtgctcgatttagtatctgatagttgggtttgcggggagaggagcccagcactgggattccgaggtgtttccattcgatgatcagcactgaacacagaggactcaccatggagttttggctgagctgggttttcattgttgttatttcaaaaggtgtccactgtgaggttcaactggtggagacgtgggaggaggcgtggatcccgaggccggtggggggtccctggacgacgttctcctgtcgcagtcctcgtggttcagnatcaagtaacactacatcgaccgtcggcccgccgaggcctaccggaaggggaacgggcgtaggagtcggggtctcgtagttattacgaaacgagagtacgacaacgtaatacgtttattaacttcgtacgtaaccgttccggtaagggtaacccggggtccggttaccctaccccgtaccgtacctaaggaaaccgtaacctaccttaaccaaacctaaaccgtacttaacttagttaaccttcgtacctaaacgtctaacgtacctaaaccgtaattccgtaacggagtaaccgggttaccggaaccgaaaccggtaacccggtaaccccttaacctttagtttaacgttcggttacgccggttaaccacgtacgtacgtaaccgtaccgtacttacgtaacggttacggtccggggaaccgg

SEQ ID NO: 155054 - DNA, 787 bp, Homo sapiens
  misc_feature: GYAE6OF02GEHKY.10.38.D05.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (722)..(722): a, c, t, g, unknown or other
  misc_feature (722)..(722): n is a, c, g, or t
  modified_base (740)..(740): a, c, t, g, unknown or other
  misc_feature (740)..(740): n is a, c, g, or t
  modified_base (743)..(743): a, c, t, g, unknown or other
  misc_feature (743)..(743): n is a, c, g, or t
  modified_base (756)..(756): a, c, t, g, unknown or other
  misc_feature (756)..(756): n is a, c, g, or t
  modified_base (759)..(759): a, c, t, g, unknown or other
  misc_feature (759)..(759): n is a, c, g, or t
  modified_base (783)..(783): a, c, t, g, unknown or other
  misc_feature (783)..(783): n is a, c, g, or t
tcagcatagtagtgcacgaccggtgctcgatttagtatctgatagttggggtttgggggctttgcctgggtctcctggacagtcagtcaccatctcctgcactggaaccagcagtgacttttgtgcttaataactatgtctcctggtaccagaccacccaccaaggccaaaacgccccccaaaactcctttgttttagaggttacaagtaacggcggccctanaggaccgtccctgacgttccggttntcctcgacccttacaaacgtcgtacggaccaaaccgtaccggtacccctacccgtcgtacccgtacttcgtcgggtcctaccgaggctaggtaaggagtcggaggtacgtaggtaaccttagtacccgtgacgcgaccgtacgtacttaacgtccaaccggaacccctaaagggtacggggtttcggttacggggaccgggtaacggggtaaaccgttaaacgggccggttaacccgttccgggtaacggttaccggaaacccggaacccggtaaaaccgggtccccgttaacccgggcccccccccgtttaggggtaaccccttaacccgtttcccgttaccccgggtttaccccccgtcccccgtttaacccctaccccttaaaccgttaaccgttaaccggtacgtacccggttacggtaaccgggtcgggtacggttaaccgggacgaacgggttaccgacgagtacgancgtgactcagacgcgatnganacacacagtacgngtnagacgtagtacgtcgagtagacanagag

SEQ ID NO: 155055 - DNA, 707 bp, Homo sapiens
  misc_feature: GYAE6OF02JT0HK.10.38.D05.1.454.CMB.1.raw
  modified_base (179)..(179): a, c, t, g, unknown or other
  misc_feature (179)..(179): n is a, c, g, or t
  modified_base (229)..(229): a, c, t, g, unknown or other
  misc_feature (229)..(229): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctcgcgtccgggtctcctggacagtcagtcacatctcctgcactggaaccngctagtgtactttgtgtcttataactatctctccgtggtaccagccaccnccaggaccaaacgccccaactcttgtttgagttcagtacgccggcctgacggtactcctgattccggttctcgtcgcctacgagtctggacctaacgccgtccctccgtacgaccgtctcgtcggcctcgaggctaggacgtagtcggacggtctacgttattccgtaacgtcgacgacgcgtactaagtccgttaccgaccggtaccccgaacggtacggggtcgttcgggaccgggtacgggtaacgttagggttacccgaccggtttcccgggtaaggtaccccgacggtacccggtaggtaccccgttacccgggtcccccgttaccggttacccgtacccgttacccgtttaccccgttcccccgtccccgtttaccccgttaccttaaccgtccttaacggttccgacggtaccggtaccgggtacccggtcgtacgggacccgttaggacccggataaccggttgaccgtc

SEQ ID NO: 155056 - DNA, 776 bp, Homo sapiens
  misc_feature: GYAE6OF02HOL0S.10.38.D05.1.454.CMB.1.raw
  modified_base (241)..(241): a, c, t, g, unknown or other
  misc_feature (241)..(241): n is a, c, g, or t
tcagcatagtagtgcacgaccggtgctcgatttagtatctgatagttgggtttgggggggtctcaggaggcagcgctctcaggacgtcaccaccatggcctgggctctgctcctcctcaccctcctcactcgagggcacgagggtcctgggcccagtctcgccctgacctcacgtccctcccctccgcggtccgggtcctccgtggacagtcagtccaccactctcctgcacgtggaaccngtctagtcgtactttgtctacttataactatgtctccgtaggtaccagccaccaccacggaccaaccgaccccctaacttcctttggttttagacggtactaggtgacggccgcccgtcgacggacgtccctgacgttcggttctaccgtcacccgtacgagtaccgtcgtaccaaacgtacccgtcccttcccggtacgtcccgtacgtccgttcgggaccctccggtagggtccgtaggtacggacgtacgggacggtcgtaaggttacttaacgttacgtgccgaacggcctaaccttattaccgttaccgaacccgaaccccgggtaagtacggggtttcgggttacgggtccggggtaacggtaaacccgggttaaggggttcccggaacccgggttccgggttacgggtaaaccccggtccggtaccccccggaagggttacccccggttccccggtccccccggtttacgaaccccgtttaccccggttttcccgtaccccgggtttaccccccccttaacccccggg

SEQ ID NO: 155057 - DNA, 669 bp, Homo sapiens
  misc_feature: GYAE6OF02G1B56.10.38.D05.1.454.CMB.1.raw
  modified_base (275)..(275): a, c, t, g, unknown or other
  misc_feature (275)..(275): n is a, c, g, or t
  modified_base (615)..(615): a, c, t, g, unknown or other
  misc_feature (615)..(615): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttcaaaaggtgtccactgtgaggttacaacgtggtggagacgtggaggaggcgtgggactccgacggccggttcggggggtcccgtggacgtactcctcctgtgcncgcctcgtcggttcagctatcaacgtaacgactacagtcgaccgtcgggcccgccgaggcctaccggaggggaggggcgtgggacgggtgggtctagtagttagtagaaacgagagtcgacaactaataattactttacgttcttcgtaccgttcggtagggtaccggggtcccgttcccgtaccctcgtacccgtagacgtaacctaccttaacccaaactaacctatttcttagttaccttcttaccactagtccgaaactactaaactcggtaaggtacgtacggtaccgaaccggaacctaccggtaccttaactatttacgtgtacgcggtaacncgtacgtactacgtcgtacctaggttaccgttcggccgggtacgcggtacccgg

SEQ ID NO: 155058 - DNA, 837 bp, Homo sapiens
  misc_feature: GYAE6OF02FYULB.10.38.D05.1.454.CMB.1.raw
tcagcatagtagtgcacgaccggtgctcgatttagtatctgatagttggggtttgggggggggtctcaggaggcagcgctctcaggacgtcaccaccatggcctgggctctgctcctcctcaccctcctcactcgagggcaacgacgggtcctcgggcccagtctcgccctgactcacgccctcccgtccggccggtccgggtctccgtggacacgtcagtccaacctactcctcctggacctacgtacggaaaccaggcctagttcgttacttttggttacgtactttaagtaacttacgtcgttccttaccgtacggttaaccgaacgtccaaaccccgaccgtacggaaaccgtaaaccccgtaacccccgtaaacttttcccgttttaggttttacggacggttaccgtaaggtaaccggcccggtccttacggacggtacccgttcccgtaggtacgttccgtccttccgtcgtacccgttaccgtaacgtcggttaccgaacgtaccgtcccggtaccctcccgtaccgtaccggtcgtacggtcggtcctaccgaggtccgtaggtaacggtacgaggtccgtacgttacgttaacgttaccgtacgtcggcgtaccggacgtacgtaactttccgtaccggaaccgtacccggtaaggttcggggttacggttacgggaccggggtaaccggttaacggtacggggtaccggttaccggtccgggttacggtaaccggtacgttaacccggacggtacccgttcccgggtacccgttccggtacctaaccgtttcccggttaaccccttcccccgtaccttaaccccgg

SEQ ID NO: 155059 - DNA, 754 bp, Homo sapiens
  misc_feature: GYAE6OF02G7XU4.10.38.D05.1.454.CMB.1.raw
  modified_base (625)..(625): a, c, t, g, unknown or other
  misc_feature (625)..(625): n is a, c, g, or t
  modified_base (697)..(697): a, c, t, g, unknown or other
  misc_feature (697)..(697): n is a, c, g, or t
  modified_base (707)..(707): a, c, t, g, unknown or other
  misc_feature (707)..(707): n is a, c, g, or t
  modified_base (745)..(745): a, c, t, g, unknown or other
  misc_feature (745)..(745): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgctatttacaaaggtgtccactgtggagttcaacgtgggtaggagactgggaggacggcgtggactccgacggtccgtcggggggtccctagacgtacctctccgtggtcgctacgtccttcgttacgggttccaaggtctaagtacctaacggtaaaccgacctaacctaagtcgggtaacccgttcggggacccccgtccggaacgggtccccgtaaccgggacggggggaaacgggggtccgtacggggtacgggttcggggttcttaccggttaaggtttaacgttacggtaaaaccgtaggtacggtggacctaacgtaactaatttacgttacttacgtcgtaaccgttccggagggtaaccgggttacccgttccctacccgttccgaccgtaacggaaacgtcccttaaccgtaaccctaacgtaaactcggtttcttaagtccttacgtacnctaagtccgtaactacgtatccgagtacggagtacccgtaagccgttaccacctaacttacgttagtcgtanccggaactancgtacgtacctagtccctagtacgttcggcggtaccgnggtaaccgg

SEQ ID NO: 155060 - DNA, 657 bp, Homo sapiens
  misc_feature: GYAE6OF02FQ0N5.10.38.D05.1.454.CMB.1.raw
  modified_base (453)..(453): a, c, t, g, unknown or other
  misc_feature (453)..(453): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaacccagcagtgactttgtgcttataactatgtctcctggtaccagcacccacccaggccaaacgcccccaaactccttgttttgagtcagtaacgcggccctcgagacgtccctagactcgttctctcgccctcaagtctggcaacacggcctccgtcgaccgtctcgtgggcctccgaggctggaaggatggaggtcctggtaacttacctacgttagccgagccnctaacgttacttaccgacggacccccctaaaggacggggtttcggtttgggaccgggtacgggtaacgttaaacggggtcgtaaccccggttccgttacgggtaccgaaccggtaccccgtaaacgggtcccttacccggtcccccgttaccggttaccctaaccgttcccgttacccggtttcccccgcccccgttacccccg

SEQ ID NO: 155061 - DNA, 894 bp, Homo sapiens
  misc_feature: GYAE6OF02FLSS8.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccagtggtagtttttggctggagcgtttgggttttccttgttgcttatttacaaaaggtcgtccacgtggtagtaggttacaaacgttgggtaggagacgtaggaggacggcgtggactaccgacgtccggttcggggggtccccgtagacggtctcctccgtacggtgcgacgccttcgttgggttacagtcagtacgtaacgtaaacgactacagtacgaccggtccgggaccccgtccggacggccgtaccgggtaaggggaacgggcgtagggtaggtcgggttctacgttaggttaattaacgaacgagtacgtacggaactaaaccgtactaacgtttaagtttacgttcgttaacgtaacccggtttaccggggtaacggttaaaccgggtttcccggttacccgtaccccttttcgtaaccgaaacggtaaccgtaccctaaaccgtttaaaccggaaaaccctacgttaaccttacgtttaacgtttaaccgttccttaaccctaaaggttaacctacgggttaaaccgtaaacttttaaacccggtcgggttaaacggtaaccggtttaacccggggaaacccggttaaaccgaaccggttaaccccggtaccttaaaacgtttaccgttttaaggtcgggtaacccgttaaccgggaaccggtaaccggttaagttaaacccgtaccgtaaccggtacgtttacccggtaaccggttttaccggggacgggtacccgggtaccggggtaaaccccg

SEQ ID NO: 155062 - DNA, 735 bp, Homo sapiens
  misc_feature: GYAE6OF02HB10P.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcgttgggttttccttgttgctatttacaaaggtgtccactgtgaggttcaacgtgggtggagacgtgggagggaggcgtggatccgagtccggtcggggggtccctgacgacctctcctgtcgcacgcctcgtggttcagcatcgagtaacgactacagtcgaccgtcgggcccgccgacggcctaccggaggggaacgggtcgtgggtacggtcgggtactcgtagtttagttagaaacgaggacgtcggactaactacgtaatttattacttcgtacgtaccgtacggtacggaaccgggtccgttaccgtacccgttcgtaccgagactacctaaccttaccaaactactacttccttagttaaccttctaacacgtacgtcgaaacctactaaacgttccgtaaggtacggtaaccgtaccggaaaaccggtcccgtaacccgggtaccctttaaccgtttagttttaaccggtcggtaccgggtacccggtacgaaccggttcttaaaccgggtaccttaccgtaacccgtttaaccggtaacggttccgggggtaccgggggacccgtaccggggtaacccgg

SEQ ID NO: 155063 - DNA, 830 bp, Homo sapiens
  misc_feature: GYAE6OF02I0NB7.10.38.D05.1.454.CMB.1.raw
tcagcatagtagtgcacgaccggtgctcgatttagtatctgatagttggggtttgggggggggtctcaggaggcagcgctctcaggacgtcaccaccatggcctgggctctgctccctcctcaccctcctcactcgagggcacgacgggtcctgggcccagtctcgccctgacctcacgtccctcccctccgccggtcccgggtctccgtggactagtcacgtccacctactcctcctgccacgtacggaaccacgtacaggttcgtacgttttgtgtacttaactactctgttcctctcggtaccacgaccaccccacccgaggaccaaacccgaccccctaaactttccgtttaggttttacggacggtacctaaggtaaccggcccggtccctcggaacggtcccgttcctacggtacgttccggttacctccgtccgtcccgtaccgtacgttccggtacgacccgtaaccgtcccggtacccttccccgtacggtaacccgttccgtcccggttcgggtacccctaccggtacggtccggtaacgggtaacggtggttacgggcggtaaccggttacgtttaaccgttaaccgttacggttacggtaccgacgggttcctacgttaaccttttaacccggtaccggaccccggttaacccgtaacggggtttccggggtttacgggtttaccgggggacccgggttaacggtaccggttaagggtcccggtaccgttccgggtacgtacgaccggtaaccgacggtccgttacccggcccgtttacgaccgttaccgtcccgtttacccgtacccctcctacccg

SEQ ID NO: 155064 - DNA, 753 bp, Homo sapiens
  misc_feature: GYAE6OF02JK7O5.10.38.D05.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagcatagtagtgcacgaccggtgctcgatttagtatctgatagttgggtttggggggggtctcaggaggcagcgctctcaggacgtcaccaccatggcctgggctcgtgctcctcctcaccctcctcactcgagggcacagggtcctgggcccagtctgccctgactcagcctccctcgcgtccggtctccgtggacngtcagtcaccatctcctgcactcggaaccngctagtgactttgtgcttaagaacttatgtcttccgtcggtaccagtacctaccaccgaggaccaaaccgccccctaaaacgtttccttacggttttttacggacggttaccgtaacggtaaacggtcccgggtccccgtacgtaacgggtacgttaccccgttggaacgtttccggtctttccgtcgtccccgtacgtaacgttccgtacggaccgtaaacgtccggtcctccccgttacggacccgttcgtccgtcgggtaacctccggtaacgtcgtaggtacgggacgtggtacggtgttacgggtaactttaccgtaccgttgacccgacgggtcctagtaacgtcgtttaccgaccgtaccccgtaaaggtcggggtttagttcccggggacgggtaccggtaaacggttacgtccgggttacccgtcggtcggtaaccggcccgtacggtacggttccgacccgtccccggttagtacccgtcgttcccggttccgtaccccgtcccgttaccccg

SEQ ID NO: 155065 - DNA, 720 bp, Homo sapiens
  misc_feature: GYAE6OF02IXBM4.10.38.D05.1.454.CMB.1.raw
  modified_base (250)..(250): a, c, t, g, unknown or other
  misc_feature (250)..(250): n is a, c, g, or t
  modified_base (390)..(390): a, c, t, g, unknown or other
  misc_feature (390)..(390): n is a, c, g, or t
  modified_base (517)..(517): a, c, t, g, unknown or other
  misc_feature (517)..(517): n is a, c, g, or t
  modified_base (542)..(542): a, c, t, g, unknown or other
  misc_feature (542)..(542): n is a, c, g, or t
tcagcatagtagtgcacgaccggtgctcgatttagtatctgatagttgggtttgcggggagaggagcccagcactgggattccgagtgtttccattcggtgatcagcactgaacacagaggactcaccatggtagttttggctgagcttgggtttttccttgttgctatttacaaaaggtgtccactgtgaggttcaacgtggtggagactggaggaggactggactcaggtccgtgggggtccctcganacctcctccgtgtcgacacgcctcgtcggttcacgcacttacgaacgaaccgatacaagtcgaaccgtccgggacccgccgagccgtacggagggaagggcgtacggagggtcggtctacgtagttaattagaaaaccgngtacgtcggacgtaactaactaatacgttttactacgtagtaccggttacgtagggtaaccgggtcccgtttaccacccgttacctacccgaaagaaccgtaccgtaaccctaaccaaacgaaactnttacgttagttaacttcccgttaanactaacgtgaacctacgtaacttacggtacgtaacgtaccggtaacgaccgtaaccgacccgtaaccggtaccttaaggtttacgtaccgtcggttaccgaaccggtaactaccgttacgaaccgtttacccgtacttaccggaaacgtttcccgggtacggggacccgtaaccgggg

SEQ ID NO: 155066 - DNA, 730 bp, Homo sapiens
  misc_feature: GYAE6OF02HEX0P.10.38.D05.1.454.CMB.1.raw
  modified_base (207)..(207): a, c, t, g, unknown or other
  misc_feature (207)..(207): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcgagggcacgacgggtcctgggcccagtctcgccctgactcacgcctccctccgcgtccggctcctgacagtcngtcaccactcctctcgcctacgtacggaacctagctagtcgttactttgttagtacttaataacttntcgtccgtccgtacggtaccncgaccacccgaccacgtaaccgaaaccacccctaaacgtttcctttggttttacgacggttaccgaacgtacggcccggtcctacgacggtacgtccctaggttacttccggttctccgtcgtacctacgtacgttcgtacgaacaccgaccgtcctcccgtacggcctaccgtcgtcgtacctccggacgtcgtagggacgtagtcgacgtacgtacggttaactacgttacacggtacccgtcgacgtacttacgtacttacccggacccggtaccggacggtttacggggttcggtttacgggcgggttacggtaacggttaacgtcggtacccggtacggtcccggcgtaaccgggccctaaccggttcccacccgggttacccttccggcccgttaccgttccggttaccctccccggtacccctaccgg

SEQ ID NO: 155067 - DNA, 671 bp, Homo sapiens
  misc_feature: GYAE6OF02G0V5W.10.38.D05.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcacgtggaaccngcagtgtactttgtncttataactntgtctctggtaccagcaccaccagacaacgccccaactcctttgtttgngtacagtagcgccnagacgtccgntactcggttctcgtcgcctacagtctagcaaccgaccggtcctacccgtcgtacccgtctccggtggtccctccgaggtctagggacgtagtacgggacggtctagttaacttacctacgttacgcgtacgtcgtaacgtactttaccgttaccgaccggtaacccccgtaaaggttacgggggttcggtttacggggaccgggttaccggggtaaacgttaaacggggtccggttacccggttaccgggttcggtaaccgacccggtaaccggtaccgggtaccgtcccgtaccccgtcggttccctaccgttcccgtacccgttccccacccgttaccccg

SEQ ID NO: 155068 - DNA, 827 bp, Homo sapiens
  misc_feature: GYAE6OF02JGIJC.10.38.D05.1.454.CMB.1.raw
  modified_base (203)..(203): a, c, t, g, unknown or other
  misc_feature (203)..(203): n is a, c, g, or t
  modified_base (555)..(555): a, c, t, g, unknown or other
  misc_feature (555)..(555): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgccctgactcagccctccctccgcgtccggtctccgtggacngtcagtccaccatcctcctgcctacgtacggaaccagtcgagttacgtacctttttggtacgtactttaattaaccgttattcgttccgtccgttacgggtacccacgcctaccccgacccgaaggacccaaaccgacccccctaaacttccgttttaggttttacggacggttacaaggttaaccggccggtcccttacggacgggtaccttccccgttaggtacgttccggtttcctccgttaccgtaccccgttactaaccggttccgtcgggacctaaaccggtacccggtcccccgttacccgtaccggtacccgttccggttacgtccgggtacccttacccgggnggtccgaggtacggtagtcggtaaggtcgtacgttaacttccttaacgtcggacgacggtaccgtactaagtaccgtacggtaacccggcccgtaacgggttacgggtttacggttaccgggggaccggtttaaccgggtacgttaaccgggttacccgtaccggttacggtaccgggtaccgaccggtacccggtaacggtcccgtacccggttcccctaaggttcccgttacccgttcctttaccccggttaccccgtccccttaacccg

SEQ ID NO: 155069 - DNA, 666 bp, Homo sapiens
  misc_feature: GYAE6OF02HSDF3.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagacgtgggaggaggcgtgggactccgacgccgtcggggggtccctggagactctcctgtgcacgcctgtggttcagcatcaagtaacgactacatcgaccgtcgggaccccgccgacggcctccggaaggggaagggcgtggaggttcgggtctacgtagttagttagaaacgagagtcggactaactactattactttatcgttcgacgttcgtaggaccggttccgttacccgacccttcgccctaaaggacctaaccaacctttaccgaaaacctaacgtactttacgttacgttaacttcttttaaccgactactacgtacctaacttaactacgtaggaacgtcgtaaccggacgaaccgtacccggtacctaactttacgttattcggccgtacgaccgtaactagccgtaacgttccacgttacaccggtttcggaccgggaccgaggtaccccgg

SEQ ID NO: 155070 - DNA, 871 bp, Homo sapiens
  misc_feature: GYAE6OF02FY1S4.10.38.D05.1.454.CMB.1.raw
tcagcatagtagtgcacgaccggtgctcgatttagtatctgatagttgggttgggggagaggagcccagcactgggattccgaggtgtttccattcggtgatcagcactgaacacagaggactcacatggagttttggctgagctgggttttccttgttgctatttcaaaggtgtccactgtgaggttcaactggtggagtacgtaggaggaggcgtggactccgagtcccgtagggggggtcccctggacgaccttcctccgttggtcgccacggtccttcgtgggtttcaggctatcgtaagtacacgtacagtcgtaacccgtcgggcccgtccgaggccttccgaggggtaaggggctaggggtagtcggggtcctagtaacggtttattacggtaaacgagtacgttcgggacgtacgtaaactaacggtttaatttaccgtttacgttacgtaaccggtttacccggttacggggtaacggggggtttaccccggttaaccgtaccccggtttaccgttaacccgggaaagtaccggggtaacccttaacccttttaaccccgggaaaaaccttaaaccggtactttaacccggggttttaccttaacggtttccgtttaaacccgtacgtaaacgtttccgggacctaaacgggttacccttaacctttggggaaaccgtcggttaaccggaaccgttaaccgaacccgggtaccccttaaaccgggtttattttaccctttacggggggaacctaccggggggtaccttaacggtaccgtaaacggttaccccgttaaggttccctaaacgggtttaaccggttcgggtttaaccgggggacccgacgggtttaaccccgggg

SEQ ID NO: 155071 - DNA, 619 bp, Homo sapiens
  misc_feature: GYAE6OF02IZR04.10.38.D05.1.454.CMB.1.raw
  modified_base (568)..(568): a, c, t, g, unknown or other
  misc_feature (568)..(568): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagcttgggttttccttgttgcttatttacaaaaggtgtccactgtgaggttcaacgtggtggagacgtgggaggaggctggactccaggccgtcgggggtccctgacgtactcctcgtgtcgcacgcctcgtgggttcagcactacaacgtaacacctaacatcgaccgtcgggccccgccgacggcctccggagggacggggcgtgggaggtcgggtctcgtagttactagaaacgagacggtggactacgtaactattaactttattcgtagtaccgtccgggttagggaaccgggttccgtcccgtaccctccgtacccgagtaacgtactaccgttaccaaactaactctacttggttacttccttacactagtccataacatcagagtcgtacgacgtacgacccgtacctacttattntggcgcgacgtacagtccgactcgcttactacgtcggtacggcgtaacggg

SEQ ID NO: 155072 - DNA, 840 bp, Homo sapiens
  misc_feature: GYAE6OF02H6ENZ.10.38.D05.1.454.CMB.1.raw
  modified_base (133)..(133): a, c, t, g, unknown or other
  misc_feature (133)..(133): n is a, c, g, or t
  modified_base (143)..(143): a, c, t, g, unknown or other
  misc_feature (143)..(143): n is a, c, g, or t
  modified_base (161)..(161): a, c, t, g, unknown or other
  misc_feature (161)..(161): n is a, c, g, or t
tcagcatagtagtgcacgaccggtgctcgatttagtatctgataggttggggtttgggggggggtctcaggaggcagcgctctcaggacgtcaccaccatggcctgggctctgctcctcctcaccctctcacncagggcacgngggtcctgggcccagtcngccctgactcacgcctccctccgcggtccgggtctccgtggacagtcacgtacacctacgtcctcccgtggacacgttaccggaacagacgtaggtcgttacttttggtacgtacttaattaactgttacttcctaccgttacggaccaacgacccaaccccgtaaccgaacggaccaaaccccgtaaacccccttaacgtttcccgttttaggtttttacgaacgggttacgtaacggttaaccggtaccccggtaccttaacggtaccgggttaccgttacccgttggtaaccggtttccggtttcctacgttcccggtacccgttaccgtaaaggttccgtaacgggactaaaccccgtacccggttcccccgtaccgttaccggtacccttacggttaccggtccgggtaacctcccggtaacgggtacggtagggtaacggtacgtagggtaaccgttcgtaaccgttacgttaaccgttacgtacggtaacgtacgtacctacgtacgttaccgttaccgaaccggtacccgtacggtaacggggttcgggttaccgggtacgggtacggtaaacggtaacgggtccggtaccggttacggtacggccgtacgaccgtacgtccgtaccgtacccgtcgtccgtccttcccggtaccgttcccccacttaccc

SEQ ID NO: 155073 - DNA, 722 bp, Homo sapiens
  misc_feature: GYAE6OF02H6S1V.10.38.D05.1.454.CMB.1.raw
  modified_base (221)..(221): a, c, t, g, unknown or other
  misc_feature (221)..(221): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctcgcctgactcagccctccctcgcgtccgggtctccgtggactagtcagtcactactctccncgctacgtacggaaccaggcctaggtacgtacttttaggtcgactttaataacttagttgttaccttccgtacgtaccgacgtaccaccaaccgacggacctaaaaccgaccccctaaacttccgttttgttttacggaggtacgagtaacggccgtcctagacgcgtcctagtacttcggttctacgtcgaccctaacgacgtcgcggtaacaaaccgtcggtacccgttccgtacccggtaccgttccgtcggttcgggtacctacccggaagtcgtaacgcgtaaggtcgtaacggtcgttaagtaccttaactaccggtggaacacggtaccgtaacacgtttaacgtacccgaccgaaacccggtaggtacgggttggttacgggccgggtaacgggttaacctaagggtccgtaccgtcggttagaccggtaaccgcggaaccgtccgtaccgacccgttcgtaccacttcccgttccggttccccgtcctaccc

SEQ ID NO: 155074 - DNA, 718 bp, Homo sapiens
  misc_feature: GYAE6OF02FQ7GG.10.38.D05.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (562)..(562): a, c, t, g, unknown or other
  misc_feature (562)..(562): n is a, c, g, or t
  modified_base (567)..(567): a, c, t, g, unknown or other
  misc_feature (567)..(567): n is a, c, g, or t
tcagcatagtagtgcacgaccggtgctcgatttagtatctgatagttggggtttgggggggggtctcaggaggcagcgctctcaggacgtcaccaccatggcctgggctctgctcctcctcaccctcctcactcagggcacgagggtcctgggcccagtctcgccctgactcacgccctccctccgccgtccgggtctccgnggacagtcagtcacatctcctgcacgtggaaccngcagtgtacttttggtcncttaataacttatcgtacctccgttacggtaaccagtacccaacccctaacccgacgggtaaccaaaaaccccgaccccccctaaaactttccccgtttttagggtttttacggaacggttaccaaaggttaaaccggccccgggtacccctccggaagggtacccttcccgtaggtaccgttcgggtttacctcgtccgccccttacgtacgttccgtaggccaaaccggtccgcccttcccgtcgtaccgtcctcggtcgggcctacgacggatcgggaagacgtggacggtctgtaacttacgtntcganacggctactatactacgaccggtacctaaggtcggttagtcgggacgtacggacgtacggcgtacccgtcggtaggtacctcggaccgtacggacctccgtacccccgtggtacccctcggttcccgttcccggtcccccgtccctacccg

SEQ ID NO: 155075 - DNA, 724 bp, Homo sapiens
  misc_feature: GYAE6OF02FQGG7.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggtagtttttgctgagcgttcgggttttccttgttgtcttatttacaaaaggttcgtccacgtgtgtaggttcaacgtggtggagacgtgggaggaggcgtaggactccgaggtcccggtcgggggtccctaggacgtactcctccgtgtcgcacgtccgttcgttcgggttcagctacgtacgaacgtaaccgacctacgtacgtcggtacccggtccgggccccgccggacggccgtaccgggaaggggacggggtcgtagggtcggttcgggtcttgtaagtttatacggaaagagtacgtacgactactacgtaatttacttagttctacgtaccgtacggtacgggtaccggttcccggtttaccctacccgtctaaccgacggtaaaccctacctaacccttaacccaaacgtaacttactttcgttactaccgttcctaacgactaccgtagtacctataacttcgagtacgtaccgaagacccgaaccgtacccgtacctacgttagttacgtcgcggtacaaccgtagacgttacccgaattccgacttacgtaccggttcggacgggaccgtacgggtacccg

SEQ ID NO: 155076 - DNA, 711 bp, Homo sapiens
  misc_feature: GYAE6OF02JISZH.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttccttgttgcttatttacaaaggtcgtccactgtgtacggttacaacgtcggtggagacgtggaggaggctggactccgacgtccggtcgggggtccctgacgactctccgtgtgcagtcctcgttgggtcagcatcaacgtaacgactactatcggtaccgtcgggccccgtacgacggtccgtaccggagggggaacgggtccgtagggtacggtacgggttctcgttagttacgttagaaacgtataacgtgaactactaatatttattctacgtacgtacgtcgtacggtacggtccgtacctacctcgtaccgagaccgtacctacctaaccaacgtactacttaccggttcttaacgttaccttacgacgtactaccggtactaacggtacttacggtacggaacggttccgggtaaaccctaccggacccgtaaacccgggtcctttaacggttactttacggaccgtcgaaccgtaccgtaaactacgtcgtaacccgttaattccccgaagttaacccgggttggacccgggtgaacccggggtacc

SEQ ID NO: 155077 - DNA, 685 bp, Homo sapiens
  misc_feature: GYAE6OF02H32R4.10.38.D05.1.454.CMB.1.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
  modified_base (623)..(623): a, c, t, g, unknown or other
  misc_feature (623)..(623): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggccacgagggtccctgggcccagtctcgccctgactcacgcctccctcgcgtccggtctcctggacagtcacgtcacatctcngcacgtcggacngcatgtacttttgtntaccttataactntnttcctcgtacgtaccagtaccaaccccaccgtaggaccaaacccgacccccttaaaactttcccgttttagttttacggacgttacgaggtaaccgtccggcccttcggaacgttacgtccctggtacgttcggttcctgtcaccctagaacgtcgtcgacaacggtccgtccttaccgacgtacccggttcgtacgtccgggtacctcgaacggtcgaggtaggaagtcggtaacgtcgtgtaaccttaaccgnggtacgtacggacncctaagtacttacggtccgaaccgttacccggaacgtggggttacggtcgggacgggtaacgtacggtaacgtcgggtaacctcggtcggaacncggtaccggagtcccggctaccccgtacgtcctaccgttccgttcccgtacccgcgttaccc

SEQ ID NO: 155078 - DNA, 781 bp, Homo sapiens
  misc_feature: GYAE6OF02HLP39.10.38.D05.1.454.CMB.1.raw
  modified_base (103)..(103): a, c, t, g, unknown or other
  misc_feature (103)..(103): n is a, c, g, or t
tcagcatagtagtgcacgaccggtgctcgatttagtatctgatagttgggttttggggggagaggagcccagcactgggattccgaggtgtttccattcggtnagtcagcactgaacacagaggactcaccatggtagttttggctgagtcgttgggttttccttgttgcttatttacaaaggtgtccactggtgaggttcaacgtggtggagacgtgggaggaggctggactccgacggtccggtcggggggtccctggacgtacctccgttccgtggtacgcctacgcctcggttacgggttacaagccacgttaagtaaccgtaaacgtactaacgacgtaccggaaccccgtcggggaccccccgacgtaccggaccgtaccgggtaaggggggacggggtcgtacggggtacgggtttacggttccgtaacgttacgtttaacggttaaacgaaaacggtaagtacggttaggacctaacttaaacgtaatttacgtttaacttcgtaccgtaacgttccggtacgggtaaccggttacccgtcctaacccgttcgtaaccaagtaccgaaccctacttaacccaaacgtaactcttacttagtccttactactacattaccgactaaccgtaagtccgtaaggtaccgtaacggccgtaaaccggaacccgtcccggtaaacccttagtttaaccgtttagtaccggtacgtaccggactacgtaacgtacgtacaacgttcaacgttacgttccgggacggtaccgaggaccgg

SEQ ID NO: 155079 - DNA, 635 bp, Homo sapiens
  misc_feature: GYAE6OF02GQF25.10.38.D05.1.454.CMB.1.raw
  modified_base (295)..(295): a, c, t, g, unknown or other
  misc_feature (295)..(295): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
  modified_base (617)..(617): a, c, t, g, unknown or other
  misc_feature (617)..(617): n is a, c, g, or t
  modified_base (629)..(630): a, c, t, g, unknown or other
  misc_feature (629)..(630): n is a, c, g, or t
  modified_base (632)..(633): a, c, t, g, unknown or other
  misc_feature (632)..(633): n is a, c, g, or t
tcagcatagtagtgcacgaccggtgctcgatttagtatctgatagttggggtttggggctttgctgggtctcctggacagtcagtcaccatctcctgcactggaaccagcagtgactttgttgcttataactatgtctcctggtaccagcaccaccaggcaaacgcccccaattccttgttttgagtcaagtagccgcctcaggacgtccctgactcggttctctcgcctaccaagtctggacaccgacggcccttccgcgaccgttctcgttcgggcctccgaggtcgtgaggntcggaggcttgatttaactactggcacgcgactattacgtaccgaacccgggcccgtaaacggtaggggtttcggtttacgggggccggacggggtaacgttaaacgggtcggtacccggtcgttagggacctaccggaccaagggtcgtaccccgtcccccgttacgggtcctacccgtttacgttcccgttacccctacccctcccgtacccgtaccttactacgttccgacgtaccggacggccgggtcggtacggaaccgtacggcggaactacggtagatcgctagngncnctcgcngacngtatgcgagagtacgngacgtcgcgcanncnntc

SEQ ID NO: 155080 - DNA, 656 bp, Homo sapiens
  misc_feature: GYAE6OF02JWRJO.10.38.D05.1.454.CMB.1.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (595)..(595): a, c, t, g, unknown or other
  misc_feature (595)..(595): n is a, c, g, or t
  modified_base (648)..(648): a, c, t, g, unknown or other
  misc_feature (648)..(648): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcaggcacgacgggtcctcgggcccagttctcgcccctgacctcgacgccctcccctccggccggtcccgggtcctcccgtaggaccagtcacgtccaaccatcctctcgctacgtacggaaccngctagtgtactttgtnacttatactntcgtctccgtagtaccacgaccaccaccgacgaccaaaccgtacccctaaccttcgtttgttgtacgtccgtacgtacgccggtcctacgacggtactcccgtagtcgttcgttctcctgcctcgtactcgtcggaaccacgtaccgtccctaccgtctacccgttcgtccgtcggtacctcccggaggtctacggcggtagtcggtaggtactacgtaacttccgtagtcgtacgacgtcactattaccgaccgtaccggaccgtacgtgggttcggtcggcggacgtacgtacgtcgaccgtcgaggtaccncggaccgtacgtccgtccgacccgtcggtacctccggttctccccggtccccncgtacccg

SEQ ID NO: 155081 - DNA, 688 bp, Homo sapiens
  misc_feature: GYAE6OF02IQP4L.10.38.D05.1.454.CMB.1.raw
  modified_base (570)..(570): a, c, t, g, unknown or other
  misc_feature (570)..(570): n is a, c, g, or t
  modified_base (631)..(631): a, c, t, g, unknown or other
  misc_feature (631)..(631): n is a, c, g, or t
  modified_base (648)..(648): a, c, t, g, unknown or other
  misc_feature (648)..(648): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagcttgggttttcctttgttgctatttacaaaaggtgtccactgtgaggttcaactggtggagactgggaggaggcgtggactccgacgccggtccggggggtccctagagacctcctccgtgtcgcctacgtccctcgttcggggttaccacgtccaatccgaaggtaaaccgtacttaactagtacgacccggtaccgggccccgaccgtacggtccgtaccggaagggggaccgggtcggtgggtaggtccggtcgtacgtagttacgtaacgtaacgaggtagtacggactaactactaatttacgttattacgtcgtacctcggtacggtaacggtccccgtacctaccctccgtaccgaagacgtacctacctaaccaactactagtctttacgtacttcgacactatcgaacacgtacncttacggagtgtaccgagaacccgtacgcctaaccttgttattcggacgtacggtcctaanagttccgaaccgtaccncttaccgttaattccggggaccggaccgtccggaacccgg

SEQ ID NO: 155082 - DNA, 681 bp, Homo sapiens
  misc_feature: GYAE6OF02G5PML.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaacacagaggactcaccatggagttttggctgagctgggttttccttgttgctatttacaaaaggtgtccactgtgaggttcaacgtggtggagacgtgggaggaggctggtactccgacgtccggtcgggggtcctggacgtaccgtctccgtgtacgcacgtccgtacgttgggttacagtaccatacgaacgtaacgactacgaacttcgaaccgtccgggcccgaccgacggccgtaccggagggtacgggcgtagggaggtacggtctacgttagttagttacgaaacgtagagtacgacgtactaacgtattaagttacttcgtagtaccttacggacgggtaccggttccgttacctacccgctaccggaagaccgtactaaccgttaaccaaactaaccgtatttaccgtacgttaattccttaagtactctacgaacctagtaactcgtagtactggtaacccagtaaccgaccgtacctaagtttaacttcgtggtaccacgtctaacgtcaacggttacaccgtcttaacgagttccgggaggtacggacgtaacccg

SEQ ID NO: 155083 - DNA, 752 bp, Homo sapiens
  misc_feature: GYAE6OF02H1MQE.10.38.D05.1.454.CMB.1.raw
tcagcatagtagtgcacgaccggtgctcgatttagtatctgatagttgggtttgcggggagaggagcccagcactgggattccgaggtgtttccattcggtgatcagcactgaacacagaggactcaccatggagttttgctgagctgggttttccttgttgctatttacaaaggtgtccactgtgaggttcaactggtggagactggaggaggctggatccaggtccggtcggggggtccctggacgtacctcctccgtagtcgacacgtccttcgttcgggtttacaggctagtacgaacggttaaccgactacagttcggtaacctccggggccccaccgacgggtcccgtaccgggaaggggtaacggggccgttaggggtacggttcggggtaccttacggtaaggtttaacttaacggaaaaccgtaggtacgttcggacctacgtaacttaagttaattacttcgtagtaacccgttccggaaggtaaccggggtcccgttaccaccctccgtaccgaagaccgacctaccttacaaaccaacgtcttaccttagtaccgtttcttacctaactacgtacgaccgtaactaacgttcgtacgaaggtaccgtacgaaccgtaccgaacccggtccctaaaccgttgttacgttcggaccggtaacgacccggtaacttacgtaccgtaaccgtacccgtcttaaacccgtaggtttacccgggaccggggttacgaaacccgggg

SEQ ID NO: 155084 - DNA, 935 bp, Homo sapiens
  misc_feature: GYAE6OF02FR04X.10.38.D05.1.454.CMB.1.raw
tcagcatagtagtgcacgaccggtgctcgatttagtatctgatagttgggttttggggggagaggagcccagcactgggattccgaggtgtttccattcggtgatcagcactgaacacagaggactcaccaatggtagttttggctgacgtcgttgggttttccttgtttgttagttttagaaggtgtccaatgtggacggagcagcgtgggtggtagtcggtgggggacggtccgtgggtcccgacggggtcccggggggtccctaggacgtacctcctccgtggtagggacgccggtcccggtagttcgtacgtttaggacttactttagttggtatggacggtcggtccggggtacccgaccggtaaggtccctaccgggaagggggtacgggggtcgtcggggtagggttcgggggtacggtacccgaaccgaaaggttaaaacgggtaacgtaggttaagggggtaaaggttacggttaaaaccggggttaaccgtttaacgggtttttccgggtttacggggttccgtttacgggttacgggttacggggtaaccggggtaccccgttaaccgtttaacccgaacccttaaccggttacccggttaaccggaacgggttaaacccgaaaccccggtaaacccggtaccggaaaacgggttaccgtttcccaaaccggttcgttaccgtccgtacggtaaacttaaacggtaggaaaccgttagtgggtaaggaaacgggtcgggtaaccgggaacgggtaccgtaccggggtacttttgggtaattttcccggtttgcgggttcggggaccggggttagggcccgggttaccgttggtttagggtaccccggggttcgttaccccggtggggttacccggggaacccgttaaccgggggacccctttccgggttaccccgtccgttacg

SEQ ID NO: 155085 - DNA, 1018 bp, Homo sapiens
  misc_feature: GYAE6OF02IB6PT.10.38.D05.1.454.CMB.1.raw
tcagcatagtagtgcacgaccggtgctcgatttagtatctgatagttggggtttggggggagaggagcccagcactgggattccgaggtgtttccattcggtgatcagcactgaacacagaggactcaccagtggtagttttggctgagcgttcggggtttttccttgttgtcttatttacgaaaaaggtcgtccacgtgttggaggtttacaacgtgggtggtagacgtgggaaggagggcgtggaatccgaggcccggttcgggggggtcccctaggtacggaccttcctcccgttggtcgacgtacggcccgtttacgttcgggggtttacgaacggtactaacgttacgaaacgttaaaccggtaaactaacctaagttaccgggaccccgttcggggaccccccgtacccgtaacgggacccgtaaccggaacggggggtaaacggggtccgttacgggggtaggggttccggggtttaaccgttaacggttaacgggttttaaacgttaaaggggtaaaaaaccgaagggtactaacgggggtaaccaaaaggttaaccgtaaattttaaacctttagttttaacgaaccggttaacgttaacccggtttaacgggggtaacggggttcccccgggttttaaccctacccccggttaccttaaccccggaagggttaaaccccgtaaccgttaaacccgttaacccaaaacccgtaaaccttaacgggtttaccttttacggttaaccggttacctttaacccaaactaccggttaactaactaaaccgtaaacttaccgtacgtaaccgggtaacgttcccggaaaacccgttaacccgaaccccggggtaaaccttaaccccgttaaagtttaacccgttacggttacggtaaccggaaccccgggttaatttaaccgggtaccgttaaaccgttaccccgggttaattaaaccccgggttaagttttccggggtaaccccggggccgggtaaaccggggtaaccccggg

SEQ ID NO: 155086 - DNA, 795 bp, Homo sapiens
  misc_feature: GYAE6OF02IBAJ1.10.38.D05.1.454.CMB.1.raw
  modified_base (66)..(66): a, c, t, g, unknown or other
  misc_feature (66)..(66): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (717)..(717): a, c, t, g, unknown or other
  misc_feature (717)..(717): n is a, c, g, or t
tcagcatagtagtgcacgaccggtgctcgatttagtatctgatagttgggtttggggggagaggancccagcactgggattccgaggtgtttccattcggtgatcagcactgaacacagaggactcaccatggtagttttggctgagcgttgggttttccttgttgtctaattttacaaaaggtctccactgtgtaggttcaactggtggagacgtgggaggnggcgtggngtccagtccggtccgggggtccctaggacgtactcctcccgtgtcgcgtacgtccgttacgttacgggggttacncggtaacctaacggtacgtaaaccggtaaaccggtaacctaaccgttaacgtcggttaccccggttacccggggccccggacccggtaaccgggcctttaacccggggaagggggttaacgggggaccggttaggggtaccgggttcggggttcctacgttaacgtttaaagttacggaaaacgtaacgtaagtacggaaccgtaacgttaacctaagtttaattttaacttcgtaccgtacgttcgtacgggtaaaccgggtcccgtttaccgtacccctcctaccgtacggaacgtaaccaacttaccaaacctaactaacttcgttaacgtaccgttctcctactatccgacactactacgtgaacggtagacgtaccgaccgttaccgaccttaacctatttaacgngttcgacgtaccgaccgtataccgtaccttaaccgtacttaaccgttacgtttcgggacggtaccggtaggaacccgg

SEQ ID NO: 155087 - DNA, 685 bp, Homo sapiens
  misc_feature: GYAE6OF02GIDBH.10.38.D05.1.454.CMB.1.raw
  modified_base (262)..(262): a, c, t, g, unknown or other
  misc_feature (262)..(262): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccgagccgtgggggtccctgacgactctcctgtgcagcctntgggttcagcatcagtaacgactacatgacctgggcccacgaggcctccgaggggagggctggagtcgggtctctagttactagaaacagagtggacactaacgaattagttaacttcgtacgtacttccggtaggtaacgggtcccggtttaccaccccgtcgtacccgaggttaacgacctaaccttaacccgaaactaaaccgtagttcctttaaggttaactacccttaccaagtacgttcaaccgtaataaacgttccgtaggtaacgacgtccgaaacgtaccgaacccggtaccctaaccgtttaagtttaccgttaggtccggtaaccggaccgtaaccgtaacgttacggtaacccgttaaccggttaccgtacgttaaaccggtttccggtaccggggggtacccaaccgggg

SEQ ID NO: 155088 - DNA, 625 bp, Homo sapiens
  misc_feature: GYAE6OF02FQIEE.10.38.D05.1.454.CMB.1.raw
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (442)..(442): a, c, t, g, unknown or other
  misc_feature (442)..(442): n is a, c, g, or t
  modified_base (532)..(532): a, c, t, g, unknown or other
  misc_feature (532)..(532): n is a, c, g, or t
  modified_base (583)..(583): a, c, t, g, unknown or other
  misc_feature (583)..(583): n is a, c, g, or t
  modified_base (586)..(586): a, c, t, g, unknown or other
  misc_feature (586)..(586): n is a, c, g, or t
  modified_base (590)..(595): a, c, t, g, unknown or other
  misc_feature (590)..(595): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (615)..(617): a, c, t, g, unknown or other
  misc_feature (615)..(617): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
tcagcatagtagtgcacgaccggtgctcgatttagtatctgataggttggggtttgggggctttgcctgggtctcctggacagtcagtcaccatctcctgcactggaaccagcagtgactttgttgctttaataactatgtctcctggtaccagcaccacccaggcaaacgcccccaacttcctttgttttgagtcagtaagcgccctnaggctcccngacttcggttctcgtcnccctacgagtcgngacaacnccggccctccngcccttcncgtggacctccaggctggaagacnggacggcttacggtacttacttacgngtaccagggttccaacttaacgtacttaccggacccggacccctaagggtacggggttcggtttaccggacgggggtaacgggtactaacgggttcgacccgggtcgtggggtaaccncggaaccccggtaaggtccctcccggggtaaccccctgggtaccctaccgtttcgttaccgttccccgccctcccaccgtacttacgtancgtcgtggaaccggtcgggctcggacgacggccgtatacgtagctagactnagngacnnnnnntcncngcnncntacncncgnnngacngncg

SEQ ID NO: 155089 - DNA, 771 bp, Homo sapiens
  misc_feature: GYAE6OF02HT9FY.10.38.D05.1.454.CMB.1.raw
tcagcatagtagtgcacgaccggtgctcgatttagtatctgatagttgggtttgcggggagaggagcccagcactgggattccgaggtgtttccattcggtgatcagctactgaacacgagaggactcaccatggagtttggcctagagcgttcgggtttccttgttcgctatttacaaaaggtcgtcctactgtgagttacaacgtggtcggagacgtagggaagggacggtacgttggactccgaacggtccggttcggggggtccctggaacgaccttcgtcctggtcgaccgtacgcccgttcggttcgggttacacgacctagtacctaagttaaaccgacttaaccgtatacggacccggtcgggaccccaccgacgggtccgtacccggaagggggacgggtcggtacgggacgggttacgttcctaggtaacgtttataacggaaacgtacgacgtgtacctaaactcgtaattacgttatccgttacgtaccggttcctacgggtaacgggtcccgtaccctacccgtactcccggaaagaccccgacttacccgtaaaccaaacgtactacgttacttacgttacctttataccggacttgaaccgacctaactaaacgtcggtacgtaacgtacggtcccgaacgtaaccgaaccggttacctacgtttagtaacttcggacggtaccgtaacctagtacggtaacctacggtttaccacgtaacccgtttaagtccgggtacgggacccgtaaccgggg

SEQ ID NO: 155090 - DNA, 784 bp, Homo sapiens
  misc_feature: GYAE6OF02IV01O.10.38.D05.1.454.CMB.1.raw
tcagcatagtagtgcacgaccggtgctcgatttagtatctgatagttgggtttggggggagaggagcccagcactgggattcccgaggtgtttccacttcggtgatcagcactgaacacagaggactcacctagtggtaggttttggtctgaggcgttcgggtttttccgtttgttgtcttagtttacgtaaaaggtggtaccctacgtggtggtaacggttcgtaacgtgggtggagacggtgggtagggacggtcgtacggacgtccgacggtccgggttccggggggttcccctggaccggtacctccgttccgtggtaggccacgtccgttcggttcgggttcgacgctacgtccgtaagtaaacgactactacgtcggaccgtcgggccccgaccggaggccgtaaccgggacggggacgggtcgagggtacgggtcgggttactaccgttagttacggtaacgaaacgaacgtgtcgtacgtaacctataacgttattactcgtaacgtaccgtacggtacggtacggtccgtaccgtacccctacgtccgtaacgaacctacgtacccttaaccgaactactaacgttgtacgttaactctacgtactaacgcgtaacctattaacgcttaacgggaagttccggaacggaccgtaaccggtaccgtaacccttaaacgttacgttacggttccgagtcccggaacggttaacgagtcccgtaacgtcccttaacggtacgttaccggtaccggtcggacccgggtaccggtacccg

SEQ ID NO: 155091 - DNA, 712 bp, Homo sapiens
  misc_feature: GYAE6OF02HWLO0.10.38.D05.1.454.CMB.1.raw
  modified_base (279)..(279): a, c, t, g, unknown or other
  misc_feature (279)..(279): n is a, c, g, or t
  modified_base (328)..(328): a, c, t, g, unknown or other
  misc_feature (328)..(328): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctgggctagtcagtcaccatcctcctgcactggaaccagcagtgattggttggtaggttatgtacttttgtcgtcctacggtaccaagngtcagccgaggaccgaaccgaccccctaaattcagttagtaattttagngtatcgtacgagtcgccggtccgggtccccggttccgggggtcccctaggtaccgtccgttcctttctccgtcggtacctaccgtaaggtcgtacggaccaaaccggtacccgtccctacccgtagaccctgttccgtacgtccggccctaccgacgttcccgtaggtaccggtagtggacggtacttacggttaattacgttaccgtttggttacgtaccttacaacgttacgacggtaccgacgggttcccggttaccgttagggtttacgggttcgggttaccggggacgggtaaccgggtaccgaacggttcggtaccggttacccgtaccggttaggacccggtaccgacccggtaacgtcccgtaccccggtccccgg

SEQ ID NO: 155092 - DNA, 835 bp, Homo sapiens
  misc_feature: GYAE6OF02IRTL3.10.38.D05.1.454.CMB.1.raw
tcagcatagtagtgcacgaccggtgctcgatttagtatctgatagttgggtttggggggggtctcaggaggcagcgctctcaggacgtcaccaccatggcctgggctcgtgcctcctcctccaccctcctcactcgaggcacgacgggtcctcgggcccagtcctcgccctgacctcacgtccctcccgtccggtccggtcccgggttcctccgtggacgtagtccagtccaccgtacttcctccgtcgctacggtacggacctagctagtcgttacgttttgtagtactttaaactaactacgttcgttccttaccgtacggttaccgaacgacccaaccccgaaccgaacggaaccgtaaacccgaccccccttaaaaccgttttccgttttacggtttttacggcggttaaccgtaacggtaccgtccggtccccgtaggaccggtaacgttccgttagtaccggtttcgttccgtcgccgtaccctacgtaacggtcgtacgaaccgtaccgtaccgcccttcccgtaccgtaccgtccgtacggtcggtcctaccgtgtactcggagtagtcggtaggccttacgtacttaaccgtggttaccacgtcggaacctcgtaacttcccgtacggaccccggtaaccgtgggttaacccggggttgggtccgggtaaccggggtacggttaaccggtaaacggggttcctacccgggttaccgggtcgtaaccgggacccgtacccgtacggttaccccgggcccccggtaccgttacccgtaccggttaccccgttcccggttaccccgttcccctaccccggttaccccgg

SEQ ID NO: 155093 - DNA, 605 bp, Homo sapiens
  misc_feature: GYAE6OF02GZZSU.10.38.D05.1.454.CMB.1.raw
  modified_base (320)..(320): a, c, t, g, unknown or other
  misc_feature (320)..(320): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagcctgccctcgtgtctgggtcctccgtggactaggtccggtcaccattcctcctcgctacgtcggacccagccacgtgaagtggtggctattactaccttgtctcgtgtacacacacgcacaacaaccgcccatactcttagtattagngtaacgtacaggtacgcggtcctacggtagggtttactgtcctcttctctcgcctacgtagtcagacacgtccgcctccagactactcgcgtcggtcctcgcgcgtagaccgtacggagtctaagtaacttctagtgacacgtctagtagtagtacgtagtacgtaggttctacgttacgtttacggtacgggtttcgggacgggtaacggtaccggtaacgtccggtacgtaccggtaccgtaacgacgtacccgaccggttaacggcctcccgtcccgtaccg

SEQ ID NO: 155094 - DNA, 401 bp, Homo sapiens
  misc_feature: GYAE6OF02GXILC.10.38.D05.1.454.CMB.1.raw
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (340)..(401): a, c, t, g, unknown or other
  misc_feature (340)..(401): n is a, c, g, or t
tcagcatagtagtgcacgaccggtgctcgatttagtatctgatagttgggtttgggaacctatgaacattctgtaggggccactgtcttctccacggtgctcccttcatgcgtgacctggcaacacggcctccctgaccgtctctgggctccaggctgaggatgaggctgattactactgcagcgcatattcaggccccagagggtgtttggcgggcgggactaaggtcgaccgtcctggggtcagcccaaggcctcgcccctgcactctcgtcccacctccncactcctatgctgaggccgggctgggacgaacggccgtacagtacgncngcanctgnnnnnnnnnnnnnnnnnnnnnnnnnnnnnnnnnnnnnnnnnnnnnnnnnnnnnnnnnnnnnn

SEQ ID NO: 155095 - DNA, 887 bp, Homo sapiens
  misc_feature: GYAE6OF02G7PQ1.10.38.D05.1.454.CMB.1.raw
tcagcatagtagtgcacgaccggtgctcgatttagtatctgataggttggggtttgggggggggtctcaggaggcagcgctctcaggacgtcaccaccatggcctgggctctgctcctcctcaccctcctcactcgaggcacgagggtcctgggccctagtctcgccctgactcacgcctcctcgcgtccggtctcgtgacagtcacgtacacctactccttcctcgacgacgtaccggaaccacgcgtagttcgttacgttttaggttcttacgttaacttaaactagttacgttccgttacccgttaggtaacccaccgaccaaccccaaccccgaaacgtaaacccgtaaaaccccggtaacccccctaaacccgtttacccgttttttacgggtttttacgggtaaccggttaaccgtaaaggttaaacccggaccgggttacccctaccgggtaaacgggtacccggttcccgttacggttaacccggtttccggtttacctccgttacggtacccctaaccgtacggtcgttaccggaccgaaccgtacccgggtccccttacccgtccgtaacccggggttcctccggttaccgggtcctaccgggtacggtcgtacgggtaaggtacggtcggtacgggcttaacgttacttaccgtaggtctaccgtagccggttaactacgtcgttaccgaaccggtacccggtagggttacgggtttcgggtcgggtacggggtacggtaccgtaagggtaccgtacccgttgggtaccggtaccggaccgaaccgggttacccgggtcctacccccggttcccgttccggtaccctttacccggttcccggtttccccgttaccccgggtccccctttaacccgg

SEQ ID NO: 155096 - DNA, 858 bp, Homo sapiens
  misc_feature: GYAE6OF02F6LAZ.10.38.D05.1.454.CMB.1.raw
  modified_base (550)..(550): a, c, t, g, unknown or other
  misc_feature (550)..(550): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaaccatggtagttttggctgagcgttgggttttccttgttgtctatttacaaaaggtgtccactgtagaggttcaacgtggtggacgacgtggaggaggtcgtaggactccaggccgtacggggggttccctggacggtaccttaccgtccgtgtacgcgacggtcccgttcgtcgggttacacggctaactaccgaacgtaaaccggtaccttaaccgactcggtacccggtcggggcccccggccgtacgggccctaaccggagggggaacgggtcgttacggggtacgttacggggtcttacggtaaggtttacttacggaaacgtcggaacggttcggtacctaacgttaaactaatttaagtttaacgtttcgtacgttaaccgttccgggtaagggtaaccgggtccggtttaacccncccgtttaacgtccgtaacggaccgttacccttaacccgttaaccaaaaccgtaactacgttaccgtttaagtaccttcgttaacacctagtccgtaccaacgttacgttacgtacggtaagtacggtaaccgtaaccgtaaccgtaaccccggtaacccttaaccggtttaaattttaccggttaccgttaccggggtaaccctaacccggtaaataccccgtttaacgaacccggtttttaaccgaccctttttaaccccggtaaaggtttccccgggggtaccggggaacccgttaacccggggg

SEQ ID NO: 155097 - DNA, 607 bp, Homo sapiens
  misc_feature: GYAE6OF02IS80R.10.38.D05.1.454.CMB.1.raw
  modified_base (255)..(255): a, c, t, g, unknown or other
  misc_feature (255)..(255): n is a, c, g, or t
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (389)..(389): a, c, t, g, unknown or other
  misc_feature (389)..(389): n is a, c, g, or t
  modified_base (565)..(565): a, c, t, g, unknown or other
  misc_feature (565)..(565): n is a, c, g, or t
  modified_base (571)..(571): a, c, t, g, unknown or other
  misc_feature (571)..(571): n is a, c, g, or t
  modified_base (580)..(580): a, c, t, g, unknown or other
  misc_feature (580)..(580): n is a, c, g, or t
  modified_base (589)..(589): a, c, t, g, unknown or other
  misc_feature (589)..(589): n is a, c, g, or t
  modified_base (604)..(605): a, c, t, g, unknown or other
  misc_feature (604)..(605): n is a, c, g, or t
tcagcatagtagtgcacgaccggtgctcgatttagtatctgatagttggggtttgggggctttgcctgggtctcctggacagtcagtcaccatctcctgcactggaaccagcactgatgttgggcattataaccttgtctcctggtatcaaccaacgcccagacaaacgcccccacactcttgtatttatgaagtcagtaagcggccctcgtaggggtttctagtccgcttctctgcctccaagtctggacaacnccggcctccctgacatctcgtcgggcctccgaggctacgtacgacgtaggctaggaattattacgngcagtcctatatatacgtagngtcggtctaccttctttcggtaacggtttcggacgggacggtaccgnggtcgtcgtaccgttacgtaacgtccacggacccgtaacggccgtcccgacccccggtcgtacctaccttccgttcccgttaccccgccctttaccgcccgtaaccttacgttacgcgtcggtacgacggtccgggtatccgggaagaccgggcacgtagtggactcgacgtctancgtagncctgatcgngtcccgagngactcgctagcgacnncg

SEQ ID NO: 155098 - DNA, 750 bp, Homo sapiens
  misc_feature: GYAE6OF02IFSVS.10.38.D05.1.454.CMB.1.raw
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (513)..(513): a, c, t, g, unknown or other
  misc_feature (513)..(513): n is a, c, g, or t
tcagcatagtagtgcacgaccggtgctcgatttagtatctgatagttggggtttgggggggtctcaggaggcagcgctctcaggacgtcaccaccatggcctgggctctgctcctcctcaccctctcactcgagggcacagggtcctgggcccagtctgccctgacctcagccctcccgccgcggtccggtctccgtggactagtccagtccacctatcctcctgactacgtaggaaccnggctagtcgtacttttggtnctttaagtaacttntcgttctaccgttacggaccacgccctaaccgacccgaacggaaccaaaaccgaccccccttaaaacgttccctttttacggtttttaggacggttacaaggtacgacccgtccgtcaggtacgtccctagtacttcggttctctccgtaccttcgaagttcgacggtaaccaccgacccggtccccttaccgtcgggtaccctctcggtcgtaaccttcggacgtctagggagtacgngtaaccgtgtacgttacttacgtacgtacgacgacgtaacctcgtaacgttaccgttacccgaacccggtaccggtaaggttcgggttacgggttcggggaaccgggtaaccgggttaacgtcgggttaaccggcccggtttaccggtacggtacccgaaccggtcccggtacggtccccgttcccgtacccccggtgtacccgtccttcccgggttacctccccccgtcctacccg

SEQ ID NO: 155099 - DNA, 811 bp, Homo sapiens
  misc_feature: GYAE6OF02IXQ2C.10.38.D05.1.454.CMB.1.raw
  modified_base (260)..(260): a, c, t, g, unknown or other
  misc_feature (260)..(260): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaacgtggtggagacgtggaggagcgtggatccagccgtgggggtcctgacgactctctgtcgcacncctgtggtcagcatacgagtaacgactactagtcgaccgtcggccccgccgaggtccgtaccgggaagggggacggggtcgtgggacggttacgggtctacgtagttttaacgtagtaaacgagtacgttacgggaactacttaaccgtaatttaaacttttacgtttaccgttacggtaacccgttaccggttaacgggttaaaaccgggggttccccgtttacccgtaccccctttaccgtaccccggtaaacggtaaccgtacccgttaaaccccgttaaccctaaaaaccctaaaccttaacgttttacccgttttaacggttaacctttaccttttacccaaacgttcgttaacgtaacctaaccttaacgttaccttaagggaccgttaacggtaccggtaaccgaaccccgtaaaccgggtacccctttaaaccgtaacgttttacgttacggttacgtaccggacggtaaccgtacgtaaccgaccgttaaccggtaccttacgtaacggttcggtaccgggggtacgtaccggggtaacccg

SEQ ID NO: 155100 - DNA, 543 bp, Homo sapiens
  misc_feature: GYAE6OF02JDLE3.10.38.D05.1.454.CMB.1.raw
  modified_base (372)..(372): a, c, t, g, unknown or other
  misc_feature (372)..(372): n is a, c, g, or t
  modified_base (497)..(497): a, c, t, g, unknown or other
  misc_feature (497)..(497): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (525)..(527): a, c, t, g, unknown or other
  misc_feature (525)..(527): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
  modified_base (542)..(543): a, c, t, g, unknown or other
  misc_feature (542)..(543): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttttgaggtcagtaagcggccctcaggagtccctgactcggttctctgcctaccaagtctggacaacaccggcctccctagaccgtctctggctccaggctgacggatgagctagattactactgtcacgcgccatattcacggaccccaagagggtgtttggcgggcggacgtaaggtgaccgtcgnggtacacgccaaggctacgccccgtgtacacctcgtcgttcccacccgtcctaccgaacctaccgttatcgtacgtcgacggaccgggtcgacggtacgaaggtccgacgtacgtaaggcgcgancganancncacgacncacgcncacgngnnngcnactncacnacann

SEQ ID NO: 155101 - DNA, 771 bp, Homo sapiens
  misc_feature: GYAE6OF02IEV04.10.38.D05.1.454.CMB.1.raw
  modified_base (167)..(167): a, c, t, g, unknown or other
  misc_feature (167)..(167): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (533)..(533): a, c, t, g, unknown or other
  misc_feature (533)..(533): n is a, c, g, or t
  modified_base (561)..(561): a, c, t, g, unknown or other
  misc_feature (561)..(561): n is a, c, g, or t
  modified_base (702)..(702): a, c, t, g, unknown or other
  misc_feature (702)..(702): n is a, c, g, or t
tcagcatagtagtgcacgaccggtgctcgatttagtatctgatagttggggtttggggggggtctcaggaggcagcgctctcaggacgtcaccacatggcctggctctgcctcctcctcacctcctcatcaggcacagggtcctggcccagtctcgccctgacctcncgcccttccgccgccggttccggtcctaccgtgacagtcagtccacnctctcngcacgtcgaaccngcgacttacttgtcgaccttaataccgtntgtcctctcgtcacgacaccctaccgacggacaaaccggtacccccaacgtttcctttgggttttcgacggttacacggttaacggcccgtacctacgggaacggtcctaacccgttgtacgttcccggtttcttaccgtccgtacccgtaccgtaacgtttaccgaccggttaccgaaacccgttcccggtacccgttaacccgtaccgtcccgttacgtcggttaccgtccgtacccggtagtacgtacggtaagcggttacgacggtnttagtaaccgttttacgacgtcgtaacnccggtttacaccgttagttaccggaccgtacccggtaaccccgtagggttttagggttcggttaccgggttcgggaccgggtttaaacggttaacgggttccgtaacccgtttggggaaccgtttcgacccgggtaccggngttacccgtcccgtaccctcgggttaccctcgtttcccgtaccccggtttcccctaccgtccctaaccg

SEQ ID NO: 155102 - DNA, 648 bp, Homo sapiens
  misc_feature: GYAE6OF02ISXM9.10.38.D05.1.454.CMB.1.raw
  modified_base (179)..(179): a, c, t, g, unknown or other
  misc_feature (179)..(179): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcagccctcccnccggcgtccgggtctccgtggacngtcagtccaccatcctctgcacgtggaaccngctagtntacttttgtcgacttaataacttatcgtcctccgtacggtaccacgaccacccgacccgagtaccaaaccgaccccctaaacttcctttaggttttacgacggttacgagtaacggccggtaccctacgacggtacgtcctagtaccgttcggttctcgtcgtcctacgagttccaggaccaccgcgtccctccgtcgtaccgttcgtcgtcggcctccggagtccgtaggacgtgtacggcgtactagtacttacgtcgtcgtcgagtccatactctacgaccgtaccgtaggtaggttgttcggacggtacggtaactaggcgtaccgtgtcggaccgtaaccgaccgacgggtcctcccggacccgttcgtacctccgttcgtaccccgttaccctcccttacc

SEQ ID NO: 155103 - DNA, 837 bp, Homo sapiens
  misc_feature: GYAE6OF02GVB5M.10.38.D05.1.454.CMB.1.raw
tcagcatagtagtgcacgaccggtgctcgatttagtatctgatagttggggtttgggggggggtctcgaggaggcagcgctctcaggacgtcaccaccatggcctgggctctgcctcctcctcaccctcctcactcgagggcacgacgggtcctcgggccctaggtctcgcccgtgacctcacgtcccctcccgtcccggtccggtcccgggtcctccggtcggacgtcgtaccgacgtcccaacctcgttcccttcccgtcgaccgtaccgttacgggaaaccctacggaccgttaggttaccggtttaacgtttttcggttccgtaaccttttaaacgttaacctttacgttcggtttcccttaccggtaccggtaacccacggtaccccaaaccccgacccggtaaacggaaccccgtaaaccccgtaacccccctttaacctttcggtttttacggtttacggtaaccggttcggtaacggtaccggtacccggtccgtacggtaccggttacccgtccgtaacgttcgttacccgttcgtccgtccgtccgtaccgtacgttcggccgtaaccgaaccgtcccgccgttacccgtccggtcccgtacgttccgggtccgccgtacgcggtcgtacggtaacgtggtacgacgtcggttactacttacgtcgtcggacctaggtacctagttacgtccgtaccgaccgtaccggttaagttcgggtggtcgggacggtcggtacgacgggtccggtacgtccggttagccggcgtaccggtcgcccgtccgtaccgtccggaccttcgtccgtacccgtccctcccgtacccg

SEQ ID NO: 155104 - DNA, 634 bp, Homo sapiens
  misc_feature: GYAE6OF02JBBEL.10.38.D05.1.454.CMB.1.raw
  modified_base (160)..(160): a, c, t, g, unknown or other
  misc_feature (160)..(160): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
  modified_base (625)..(625): a, c, t, g, unknown or other
  misc_feature (625)..(625): n is a, c, g, or t
tcagcatagtagtgcacgaccggtgctcgatttagtatctgatagttgggtttggggggggtctcaggaggcagcgctctcaggacgtcaccaccatggcctgggctctgctcctctcaccctctcactgagggtcacgacgggtcctgggcccagtctnccctgactcacgcctcctccgcgtccggtctaccnggacngtcagtcaccntcctctgctacgngaacctagcgagttctacttttggtntaccttaataatctcgttcctccgtaggtaccacgcctaccacccgaggtaccaaacccgcccctaattcccgtttagtttcgacggttcaagtacgccggcctagacggctaccgngtacgtctcncgtcncctacgacggtctagaccacggtactcctcctacgaccgttcgtacgtcgggactccgagtcgagacngngtagactntatcgttcagaccngacgctaacttgtccgacggtaccctaggtgggttacgacggggcctaagggtaccgttagggaccttaccggcggttaccaacggtccggaccggttacgtcccgtacccggtaaccgtcgtaaccgttccgccgttaccccgttacccncccgttacc

SEQ ID NO: 155105 - DNA, 782 bp, Homo sapiens
  misc_feature: GYAE6OF02IY6GN.10.38.D05.1.454.CMB.1.raw
  modified_base (166)..(166): a, c, t, g, unknown or other
  misc_feature (166)..(166): n is a, c, g, or t
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagcatagtagtgcacgaccggtgctcgatttagtatctgataggttggggtttgggggggggtctcaggaggcagcgctctcaggacgtcaccaccagtcggcctgggctctgctcctcctcaccctcctcactcgaggacacgagggtcctcgggcccagtcncgccctgactcacgccctccctccggccgtccggtctctaggacagtcacgtcacnctctcgngcacgtcgaaccngcgtagtctacgttttcgtatactttaataacttgttccgtcctaccgtacggtaaccgactaccaacccgtaccgaaggaaaccaaaccgtacccccttaaacgtttcgttttaggttttacggaacggtacgaaaggtccgaccgtccgtacgacggacgttccaaggttcgttcgtctcgtacgacctagtacgtcgtacgaacctacgaccggttccaccggtacgtcctacggtcgtccggtaccgtccgtaggtacgcgaacggtagtaccgggtagttcgttaaccgtacgttaacgtcggtacgtacgtacgtaccgttactaacgttacgtacccggtaacccgacccggtttaagggtccggggttaggttaccggggggaaacggtcccgggtaaacggttaaccggggttaccggttacccgttacggggtaacgggaccggtaaccggtaaccggccggtacccggttcccggtacccggttacgttccgtacccgttccggtacccttaccccctccgtttaaccc

SEQ ID NO: 155106 - DNA, 786 bp, Homo sapiens
  misc_feature: GYAE6OF02H9GGN.10.38.D05.1.454.CMB.1.raw
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
tcagcatagtagtgcacgaccggtgctcgatttagtatctgatagttggggtttgggggggagaggagcccagcactgggattccgaggtgtttccattcggtgatcagcactgaacacagaggactcaccatggtagtttggctgagcgtgggtttttccttgttgtactatttacaaaaggttgtcctactggtaggtaggtttacaacgtgggtggagacgtgggagggaggcgtaggactcacggtccggtcggggggtaccctaggagtaccttcgtccgtcggtgccgacgtccttcggtggttacgngtacattcaacgtaacgactacagtacgaccgtaccggcccnccgtacgcctacggaaggggacgggtcgtcggtaggtcgggtctacgtagttaacgtacgtaaacgagtacgtaggtaactaaattaacgtatttaactttaacgttacgtacgtaccgttaccggtaacgggtaaccgggtcccgtttacccgtaccccgttactaccgaacgtaaccgtaaccgtaacccttacaaaaccaacttacgttaccgtttagttaacgttaccctttacaaactcgttaaccacgtaaaccttaacgtaccggtagtaacgtaacggtacccgtaaaccggtaaccgacccggttaaaccctaacccgtttaatttacccgttaggtccggaccggtaacggtacctacgttacggaacccttaggtacctaccgtaaacgttcccgggtacggacggaccggtacccggg

SEQ ID NO: 155107 - DNA, 752 bp, Homo sapiens
  misc_feature: GYAE6OF02HH55Z.10.38.D05.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
tcagcatagtagtgcacgaccggtgctcgatttagtatctgatagttggggtttggggggggtctaagggaggcagcgctctcaggacgtcaccaccatggcctgggctctgctcctcctcaccctctcactcaggcacagggtcctgggcccagtctgccctgactcagcctccctcgcgtccggtctccgtggaccagtcagtcaccatcctcctgcactcggaaccngcagtgactttgtncttaataactntgtcctctggtaccagcaccacgagacaaccgaccccaattccttgttttgagtcagtacgccgtcctcaggtactccctgtacgttccggttctacctcgtccctacgaagttcgtacggacaaccgaccggtccttcccgtacgtaccctcgtccgtcgggcccttaccgacggtaccgtaggaacgtcgtacggtaacggttcgtaacggttaacttaccgttacggtcgtaccgtacggtccgtaccttaacgtttacctaccggacccggttaaacccccgtaagggtttacggggttttcggtttaccggggaccgggtaaccggttaaccggttaaacgggtcccggttaacccgggtccgttacggggttaccaacccgggtaaccccggtaacgggttcccgtaccccggtaccccccggttaggttacccttacccgttcccggttaccccgtttacccccgtaccccgtttaccccggttaacccc

SEQ ID NO: 155108 - DNA, 615 bp, Homo sapiens
  misc_feature: GYAE6OF02GXL9X.10.38.D05.1.454.CMB.1.raw
  modified_base (570)..(570): a, c, t, g, unknown or other
  misc_feature (570)..(570): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(590): a, c, t, g, unknown or other
  misc_feature (587)..(590): n is a, c, g, or t
  modified_base (592)..(592): a, c, t, g, unknown or other
  misc_feature (592)..(592): n is a, c, g, or t
  modified_base (594)..(596): a, c, t, g, unknown or other
  misc_feature (594)..(596): n is a, c, g, or t
  modified_base (598)..(615): a, c, t, g, unknown or other
  misc_feature (598)..(615): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgtgcttataactatgtctcctggtaccagccaccacccaggcaaacgcccccaaactcctttgttttgaggtcagtaagccggccctcaggacgtccctgacgttccggttctctcgccctaccgaagtctcggcctaaccgaccggtccctaccctcggacccgttcctcgtcgggcctacccgaggcctaggaggactggaggtctaggtacttactagtgcaggccgcgtatactccgaccggacccaacggtgggttggtttacggcgggtacgggtaactaaaggtccgtaccggttccgtggtaccgacggtacccgaacggccgttccccgcccccggttacggtacctacccgtttccgtttccgtcccccgtcccctcccgttacccctacctacgttacgtcgcggttacggaccgggtccgtcgtcggaccgtacggngacccagtcggntgngnnnncncnnncnnnnnnnnnnnnnnnnnn

SEQ ID NO: 155109 - DNA, 732 bp, Homo sapiens
  misc_feature: GYAE6OF02IUT5B.10.38.D05.1.454.CMB.1.raw
  modified_base (243)..(243): a, c, t, g, unknown or other
  misc_feature (243)..(243): n is a, c, g, or t
  modified_base (654)..(654): a, c, t, g, unknown or other
  misc_feature (654)..(654): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcacagggtcctgggccagttctgccctgactcagcctcccgtccgcgtccgggtctcctaggacagtcagtccaaccatcctccgtgcacgtcggaaccagcagtntactttgtgcttaataactatctcttccgtagtaccgagacccacccaaccgacggaccaaaccgtaccccctaaacttacccgtttagtttttacggaacggttacgtaacggtaaccggtccggacccttacgacggaccgttacccgttgaccgtttccggtttacctccgttcgaccccgttaccgtaacgggttccgtacgggacctaaaaccggtacccgtccccgttaccccgtacggtcccgttaccgttcggttacgggtccctacccggtaggtacccgtagggtacgtacgtggaacggggtactacgttaacttaacgtcgttagcccgagtcgactagtagtccgaccggtaaccctaggtcggttagggtcgggccgggtaggtacgtaacgggtcnccggttacgtggtccgacgtaccgaacgtcccgtaccgccccgttagacccttacgccctacccttcccgacccctcg

SEQ ID NO: 155110 - DNA, 548 bp, Homo sapiens
  misc_feature: GYAE6OF02HEKDA.10.38.D05.1.454.CMB.1.raw
  modified_base (253)..(253): a, c, t, g, unknown or other
  misc_feature (253)..(253): n is a, c, g, or t
  modified_base (335)..(335): a, c, t, g, unknown or other
  misc_feature (335)..(335): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
  modified_base (525)..(548): a, c, t, g, unknown or other
  misc_feature (525)..(548): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaacgcccccaaactccttgtttttgaggtcagtaagcggccctcaggagtccctgacttcggttctctcgcctccaagtctggcaaccncggccctccctgaccgtctcgtgggctccgaggctgaggatgaggctgattactactgcagcgcatattcacggccccaagngggtgttggcggcgggactaaggtcgaccgttccgtggtccgaacgcccgaggtcccgtccgccccccgttgggccctaacgtccgttacccgttcccccgtccccttcccgtacccctaaccgtttaacctacgttcgccgtaggaccgggcgggtaccgttcgggcgaacggcgactagtcgncnngnnnnnnnnnnnnnnnnnnnnnnnn

SEQ ID NO: 155111 - DNA, 766 bp, Homo sapiens
  misc_feature: GYAE6OF02FM8A7.10.38.D05.1.454.CMB.1.raw
  modified_base (390)..(390): a, c, t, g, unknown or other
  misc_feature (390)..(390): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcacgccctccctccgcgtccgggtctccgtggacagtcagtccacctatcctcctgccactcggaaccagcagtcgtacttttgtagtcttaataacttatgtcctctcggtaccagccacccacccaggaccaaaccgcccccctaaacttccctttaggtttttcgacggtacgaaggtaacgccggtaccctcgaggactcccgtgtacgtcgttacnctcgcctacaagtcgaggaccaacgtccgtacctcccgtagtacccgtctcgtacgggtccgtccgggtctacggagtacgtagggcgtaccgttaggtaacctttacgtacgtcgacgacgtccgtacttagttacctaccggaacccggtaaccccgtaagggttacggggtttacggtttcccggggaaccgggggttaccggggtaaaccgttaaacggggaccgttacccccggttgggttacggtaccgaacccccgggtaaccggtaacggggccccttcccccgggtacccccgtttacggtaccccgttaccgttccccggtttaccccgttaacccccccgttcccgttacccccgttaacccccg

SEQ ID NO: 155112 - DNA, 746 bp, Homo sapiens
  misc_feature: GYAE6OF02IA5V6.10.38.D05.1.454.CMB.1.raw
  modified_base (706)..(706): a, c, t, g, unknown or other
  misc_feature (706)..(706): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggttttccttgttgtctatttacaaaaggtgtccactgtgaggttacaacgtggtggagacgtgggaggaggcgtggactccgacggtcccggtcggggggttccctaggacgtacctccgtccgtggtcgcgacgtccgttcgttcggggtttaccagctagtacaacgtaaccgtaactaacactacggtacccggtcgggcccccgacccgacggtccgtacccggagggggaacggggtcgtaggggacggttcgggtcgtacgtaagtttaacgtagaaaacgagtagtcgactaactacgtaatttactttacttacgtacgtaccttcggtacgggacggttacccggtttcccgtacccgttcgacccgacgtaacgaccttaccctaaccaaacaactaccttacgtttagttaccttaccttctaacgtacgtctaacgaaattaccgttgtacggacgtaagcccggaaccgtaaccgacccggtactaacccgtttatttcgtacggtcgacgaccgtactaggtaccgttaaccctacggtnttaccctaggttccggtacgggacccgttagggaaccccg

SEQ ID NO: 155113 - DNA, 779 bp, Homo sapiens
  misc_feature: GYAE6OF02FSXEZ.10.38.D05.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
tcagcatagtagtgcacgaccggtgctcgatttagtatctgatagttggggtttggggggggtctcaggaggcagcgctctcaggacgtcaccaccatggcctgggctctgctcctcctcaccctcctcactcagggcacgagggtcctgggcccagtctgccctgactcagcctccctcgcgtccgggtctcctggacagtcagtcaccatctcctgcacgtgaaccngcagtgtactttgtncttatactatntctcgngtacagcaccaccaggacaaccgcccctaacttcgttgttttgagtcagtacgccgcctgacggctccgtgacgttcggtctcgtcgcctcagtcgtggacaacgtccgtaccctccgtcgtacccggttctcggtacggtcctccggtacggcgttacggaacgggtgtacgggtacgtccgttaggtaacctttaccgtacgttcggacctacgggtaccgtaacttacgttaccgtaccggtaacccgggtaaccccgttaaacgggttcgggggtttaccggggtttaccggggaccggggggttaaccgggtaaaccggtttaaacgggggttaccccggaccccggggttttacccgggtacgggggttaaccccggaacccggggtaacccccggttaaccgggggttccccgttaccccgggtccccccccggttttaagggtaccccctttaaccggtttacccccggttaccccggttttcccccccccgaacgttttaacccccccg

SEQ ID NO: 155114 - DNA, 667 bp, Homo sapiens
  misc_feature: GYAE6OF02F7Z2P.10.38.D05.1.454.CMB.1.raw
  modified_base (482)..(482): a, c, t, g, unknown or other
  misc_feature (482)..(482): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcttgggttttccttgttgcttatttcaaaaggtgtccactgtgaggttcaactggtggagactgggaggaggctggatccgagccgtgggggtccctgacgactcctcctgtgcacgtccgtcgtcggggttccagcattacgtaacgtaaaccgacctacacgtacgacccgtcgggcccccgccggacggcctaccggagggggtaacggggtcgtgggtaggtggggtctacgtagtttaatagaaacagatggactactacatattatctgtactcgtcggaacggtcccgtcaccctcaaccgagacctactaccttaccaaactaactnttcgttagtacttcgtcaactntcgactaanaccgtntacggacgtagtaccgtaacgacccggtacgaacccttaacgttatttaacggttcgtcggaaccggtccggaattaaccggtacgaccccgttacgtaccttacggttaaccgttccgggtacggggaacccgttacgggggacccc

SEQ ID NO: 155115 - DNA, 773 bp, Homo sapiens
  misc_feature: GYAE6OF02G4S8K.10.38.D05.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctctcactcagggcacgagggtcctgggcccagtctgccctgactcagccctccctcgcgtccggtcnccgtggacagtcngtcacattccnctgctacgtacggaccagctagtgtacttttgtcgactttaataaccttagtnttcctaccgtggtaaccngtacccaacccgaccgaggaacccaaaaccgacccccctaaaacctttccgtttaggttttcggaacgtaccgtaagtaacggcccggtcccttacgacggtaaccgtccgtagtacgttccgttcgtccgtcacccgttacgaacgttcgtaacgacgaaaccgccggttaccctcccgtacgtacccggttctccgtcgggtacctccggaacggtcgtaacggtacgggtaaagttcggtaacgaccgttaacggttctttaaacccgtgtaacgcgtaaccggtccacttaacgtacgttcaaccgggtaccctaaggttcggggttacggttacgggaccgggtaaccgggtaacttaaggggtcccggtaccgtttacggtacggtacccggaacggtacccggaaccggtccgttacccccgggtccgtaaccggtacctcccgttaccggtttccccggtcccccgttaccctacccggg

SEQ ID NO: 155116 - DNA, 793 bp, Homo sapiens
  misc_feature: GYAE6OF02GZZMY.10.38.D05.1.454.CMB.1.raw
  modified_base (235)..(235): a, c, t, g, unknown or other
  misc_feature (235)..(235): n is a, c, g, or t
  modified_base (320)..(320): a, c, t, g, unknown or other
  misc_feature (320)..(320): n is a, c, g, or t
  modified_base (447)..(447): a, c, t, g, unknown or other
  misc_feature (447)..(447): n is a, c, g, or t
  modified_base (536)..(536): a, c, t, g, unknown or other
  misc_feature (536)..(536): n is a, c, g, or t
tcagcatagtagtgcacgaccggtgctcgatttagtatctgatagttgggtttggggggggtctcaggaggcagcgctctcaggacgtcaccaccatggcctgggctctgctccctcctcaccctcctcactcgagggcacgagggtcctcgggcccagtctcgccctgacctcacgccctcccgtccgccggtccgggtcctccgtggacacgtcagtccaccgtactcctccncgactacgtacgaaccagcgtaggttcgttcgttttggtacgtacttaataacgttcgttcgttacctccgttacggtaccaacncccgaacccctaaccggacggtaaaccaaaccccgtaccccgttaactttcggtttttggtttaacggacgtaacctaagggtaccgcccggtcctaggaacggtccgtcctaggtcgttccgttcncgtcgtacctagtacgtccgtacggaacctaaccggtcccgtccgttacgtacggtaccgttcgtacgggtacgtccgtacgcggtagnggttaggacgttacggacgttctagttaccgttacacggttgacgtacgccttagtaccttacgtacccgaacccggtaccggtagggtccgggtttacggtacgggaccggggtttaacgacgttaacccggggtcgtccccgggtttgaaccggtacccggtaaccggtacccggtaccggttcccgtaccccgggttacccgttacgggcccctttaccgtcccggtttccccgtacccccgttacctccccgg

SEQ ID NO: 155117 - DNA, 894 bp, Homo sapiens
  misc_feature: GYAE6OF02GLLC2.10.38.D05.1.454.CMB.1.raw
tcagcatagtagtgcacgaccggtgctcgatttagtatctgataggttgggtttggggggggtctcaggaggcagcgctctcaggacgtcaccaccatggcctgggctctgctcctcctcaccctctcactcagggcacgagggtcctgggcccagtctgccctgactcagcctcctccgcgttccgggtctccgtggacagtcagtcaccatctcctgcacgtacggaaccagcagtgtacttttggttgactttaataacttattcgtccttccgttcggtaaccaacgccaccccgaacccgaaggtaaccaaacccgacccccctaaaacgtttcccgttttaggtttttacggaacggttaccgaacggttaacggtccccgggtaccctacgggaacgggtacccgttacccggttaggtaaccgtttccggggtttaccttccgttaccggtaccctacccgttaacggttccgtacgggtaacccgtaaacccgtacccgggttccccttaccccggttaccgttaacccggttccgttacccgggttacccgggtaccctacccgggtaacgggtcccgttagggaacggggttacgtacgggtaaccggtcggttaaacgttaccgtttaaccgtacgtccgtacgacggttacctacgtaacgttaccgttccgaaccgggaccccttaagggtcggggtttacgggttcgggaccggggtaaccgggttaaacggttaaccgggtacggttacccggttaccgggtacgggttaacccggaaccgggttaacccggaccggggttccctaccccgggttccccggttaccgttaaccggtccccgttacgttcccccggttcccctaacccccgttccccgg

SEQ ID NO: 155118 - DNA, 788 bp, Homo sapiens
  misc_feature: GYAE6OF02JT996.10.38.D05.1.454.CMB.1.raw
  modified_base (115)..(115): a, c, t, g, unknown or other
  misc_feature (115)..(115): n is a, c, g, or t
tcagcatagtagtgcacgaccggtgctcgatttagtatctgatagttgggtttgggggggtctcaggaggcagcgctctcaggacgtcaccaccatggcctgggctctgcttccncctcaccctctcactcaggcacaggtcctagggcccagtctgccctgactcacgcctccctccgcgtccgggtctccgtggacagtcacgtcacctatcctcctgaccactacggaaccacggtacacggtgtaaccttttggttcgtctttaataaccttattcgttccttcgtcggtaccagaccaccctacccgaacggacaaaccgtaccccctaaacgttcccttttaggttttacggacgttactaacggttaaacgccggtccctcggtacgtacgttccctaggattcggacttccgtacttcgcccttacacgtcgtctaaccgagtaccgtcccgttccgacggttaccctcggtccggtcgtaccgtaccgcggttactcggggtaaacgttcgacggttacggactttcggtaaaccttcgggtaccttaccgggacaaccgggtctaaccggtaaaactttcccggttacggtaaccccgtaccgtaaaccgggttcggtttaacgggggttccggggaccgggtacgggttaaacgggttccgtacccggggttacccgttttcggaggaccccggttacgtaacccggtcgttacccggtaccccgtccgggtttacccggtgttaccccgtttcttcccccgggtccccttaacccg

SEQ ID NO: 155119 - DNA, 754 bp, Homo sapiens
  misc_feature: GYAE6OF02IE0MB.10.38.D05.1.454.CMB.1.raw
tcagcatagtagtgcacgaccggtgctcgatttagtatctgatagttgggtttgggggagaggagcccagcactgggattccgaggtgtttccattcggtgatcagcactgaacacagaggactcacagtggtagttttgctgagtctgggttttccttgttgtactatttacgaaaaggtcgtccactgtgtagttcaacgtggtggagacgtagggaggaggctggactcgacgtccggttcggggggtcctcggacgtaccttcctccgttgtcgtccacgtcccgttcggtcggttacacggtctaacgtacgaacggtaaaaccgactaactacgttaccggaccggttccgggccccgtacgtaaccggccgtaacgggaggggtacgggtcgtgggtacggtcggtctacgtaagttagtagaatagagtcgtacactaacgtataacgtttactacgttcgtaccgttcggtaacgggtccggtaccggtttccctaccgttcgtcgaaacgtaccgtaacctaacccgtttaaaccaaacgtactcgttacttacgttaacttcctaacatataccgactaacctagtacgtgaacgtacgaaccggtaccgaacgtaccctacctaaacgtttagttcggttacggtaccgaccgtaaccgtaagtctacccggttaacaacccgtttcgtaaccggtttaaccgggtcccgggttaaccgggacccggtaaccggtacccggg

SEQ ID NO: 155120 - DNA, 784 bp, Homo sapiens
  misc_feature: GYAE6OF02GS808.10.38.D05.1.454.CMB.1.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (735)..(735): a, c, t, g, unknown or other
  misc_feature (735)..(735): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctggttttccttgttgctatttcaaaggtgtccactgtgtaggttcaagtggtaggagacgtgggaggaggcgtggactccgacgtccgggtcgggggtccctaggacgtacctcctccgtgtcgcacgtccgtcggttcggttcngcagtacaacgtaacgactaanactacgtaccggccggcccgaccgacggccgtaccggaagggggtaacggcggtagggtacggttcgggtcctagttaagtttactaacggaaacgtaggtacgtacggacctaaacgtaactttaagtttaactttacgtttaccggtacgtaacccggtaccggttacggggtaaacccgggttcccggtttacccctaacccggtttacccacggtaacgaacctacccgtaaccttaacccgaaactacgtacctttacgtagttacctttaccgtaccgtaacttacggtacaccgtaaacctttagtccggtaggtaaccgtaaccgggtaccggtaaacccggacgtacccggtaaccttaacgttaagtttcgtcggcgtaaccgacgtaacgttcggtaccaaacccgttnaaccgttaacttaccggttcggggacccgggtacgacgggtaaccccgg

SEQ ID NO: 155121 - DNA, 745 bp, Homo sapiens
  misc_feature: GYAE6OF02G6QNO.10.38.D05.1.454.CMB.1.raw
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
tcagcatagtagtgcacgaccggtgctcgatttagtatctgatagttgggtttggggggggtctcaggaggcagcgctctcaggacgtcaccaccatggcctgggctctgctctcctcaccctcctcactcagggcacaggtcctgggcccagtctgccctgactcagcctccctccgccggtccgggtctcctggacacgtcagtccacatctcctgctacgtggaccagcagtntacttttgtgacttaataacttatcgttctccgtacgtaccngaccaaccacccacggacaaaccgacccctaaaccttcctttagttttacgaggtactaagtaacgtccggtcctcgagtacgtcctacgtagttcggttactctcgtacctacgtaagtcgtacggtacaaccgtcggtaccctcccgtacgtaccgttcgtccgtcgggtcctaccgacggtacgtaggtacggtagtcggacggtccgttaacgtaacttacgtacgtacgtaccgtagaccgacgttaactacgttacccgaacccgggtaaccccgtaacgggtacggggtttaggggttcggggtacccggggtaacggggttaaaccgtaaacggggtccggtaaccggttcggtaccgggtaccggaaccggtacccggtaacggtcccgtacccggtcccccggtacccggttaccgtacccgttcccggttcccgtttcccccgccccgttaccccg

SEQ ID NO: 155122 - DNA, 997 bp, Homo sapiens
  misc_feature: GYAE6OF02F1LJD.10.38.D05.1.454.CMB.1.raw
  modified_base (182)..(182): a, c, t, g, unknown or other
  misc_feature (182)..(182): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagcgttgggttttcctgttagcgtatttacaaaggtntcctactgtgtaggttcaagtggtgagtacgtggaggacggtcttagggactccagtccgggtcgggggttcccaggacgtacctcctccgtggtcgcacggtccttcggttcgggttacacggtactacnccggtaaagtaaccgtaacgtaacgnttccggtacccggtccccgggaacccgacccggaggttccccgtaaccgggggaacgggggaacgggggtttccgtaacggggtaggggttacgggtttcccgtatttaaacccggggttttacgaaaacccgtaaaacggaccgttcggttaaccggacctacctttaaacaattttacccggtttaaggttttcaaccgggttccctttaccggggggacgggtttaaacccgggggtcccccgttttaaacccgtccccctttaaccgtacccggtaaaccgggttaaccgtaacccgtaaccccgtttaacccaaaacccgggtttaaacgttaaacccttttccgttaaccgtttaacctttacccttacttaacccttaaatttcccggggtaaagttaccccgttaaaaacggttcgtaaaggggtttacccgtaaacgggtaaccccggtaaaaccggtaccccggggtaaaccgttaaccccccggtttttattaaacgtttttaccgggttaccggtttaaccggggtaaacccccgttcgggaaaaccctcgttacccggtaaaaccgtttcccgtaactttacccggtttaaaccggcccggggtttttaacccgggggaaaccgtccgggtttaaccccccgggg

SEQ ID NO: 155123 - DNA, 749 bp, Homo sapiens
  misc_feature: GYAE6OF02HMYK6.10.38.D05.1.454.CMB.1.raw
tcagcatagtagtgcacgaccggtgctcgatttagtatctgatagttgggtttggggggagaggagcccagcactgggattccgaggtgtttccattcggtgatcagcactgaaacacagaggactcaccatggagttttggctgagctgggttttccttgttgctatttcaaaaggtgtccactgtgaggttcaactggtggagacgtggaggaggctgggactccgagccggtcggggggtccctggaacgtacctcgtcctggtcgacacgtccgttcgttcgggggttaccacggtactacttaccgaacgttaaaaccgtaaccgtaaccaacgtccggtaacccgtcggggacccccgtccgaacggtcccgtaccggaaggggggtaacggggtcggtggggtaacgggttcgggtccgttacgtagggtttaacgttaacggaaaacgtagacgtcgggaacctaacgtaactaagttactttaacttcgtacgttaccgttacgggtaacgggtaacgggggtaccccgtttccctacccgtctaccccggtaagaacctaacccgtacttaacccgaaactaacccgtattttcgtacgtaacttcgttaccaagtctacgccaagtactccggtagacggtaccgtacaccggacaccggtaccctagttacttgttacgcgacgactagagtactaaccgtagtcctacggacgtttcgggcggacggaggtacccg

SEQ ID NO: 155124 - DNA, 715 bp, Homo sapiens
  misc_feature: GYAE6OF02I98Y2.10.38.D05.1.454.CMB.1.raw
  modified_base (163)..(163): a, c, t, g, unknown or other
  misc_feature (163)..(163): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (708)..(708): a, c, t, g, unknown or other
  misc_feature (708)..(708): n is a, c, g, or t
  modified_base (712)..(713): a, c, t, g, unknown or other
  misc_feature (712)..(713): n is a, c, g, or t
tcagcatagtagtgcacgaccggtgctcgatttagtatctgatagttgggtccctgagactctcctgtgcagcctctgggttcagcatcagtaacgactacatgacctcgggcccgccaggcctcgagggaagggctggagtgggtctcagttatgaaacagntgacactacattattatctgacttccggtaggaacggggtccgttaccaccctctaccgagacgactaccttccaaacacgtattccttagtactcttacagtaagtcgacaacaatcgtagagacgtacgaacgacgtacgcctacgttattcgtgcncgcganacgtcgactacgctactagttccgtgggaccgtaggaccaccgacggtaccacccgttacctccccgagtaccccgacctaccggaaacggtcccctaggttccccgtcccgttccccgtacgggcccgtcccgtccggtaccgtaccgaaccgggtacgtacccgtaacccggttaccggaacggaccgtacccgaccggtaaccgggcccggttaccccggtcggggttacccgtcggtcccggttacggtaaccgtaacccgggttaacctttacccgttacccgttaacccgttaaccgttaacggtccggttacgttaccggacggtccgggtaccgtacggtaccggacggtaccacgtacgtagccgtgccgngacnngc

SEQ ID NO: 155125 - DNA, 728 bp, Homo sapiens
  misc_feature: GYAE6OF02GWM8U.10.38.D05.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (718)..(718): a, c, t, g, unknown or other
  misc_feature (718)..(718): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacgacgggtcctcgggcccagtctcgccctgactcacgccctccctccgccgtccgggtcctccgtggaacngtcagtcacctatcctccngcacgtcggaaccagcgtagtcgtactttgtcgtacttataactatcgtctcgtgtaccagccaccaccaggacaaccgacccctaacttccgtttagttttcggacgtacaacgtaacgccgtaccctgacggtacgtcccgtagtaccgttcgttccgtcgtccgtacccgtacgtaacgttcgacgggtaccaaacccgtaccggtcccccttacccgttaccggtcccgttcggttccgtcggggtacccctccgtaacgggcggttacgggaggtacgttacggggacggtctaacggttaacttaacccgttagtcgacccgagtccgacttaagttacgtaccggaccccgtaacgaacggttcggggttggttaccggcgggaacccggtagtacgggtaccgccgttacggtacggtacgtaccggaccggtaggtcccgtaccccggtccgtcgtaccacccgttcgtacccgttccccnccgttacccg

SEQ ID NO: 155126 - DNA, 546 bp, Homo sapiens
  misc_feature: GYAE6OF02FF59P.10.38.D05.1.454.CMB.1.raw
  modified_base (218)..(218): a, c, t, g, unknown or other
  misc_feature (218)..(218): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (541)..(546): a, c, t, g, unknown or other
  misc_feature (541)..(546): n is a, c, g, or t
tcagcatagtagtgcacgaccggtgctcgatttagtatctgatagttgggtttgggggtccctgagactctcctgtgcagcctctgggttcagcatcagtaacgactacatgacctgggcccgccaggctccaggggaaggggctggagtgggtctcagttattgaaacagatggcactacatattattctgactccgtgaagggccggttcaccctntccagagacacttccaaacaacatcttgtatcttcacatgcacaatctgagagtcgacgacacggccacctattattgtgcgcgacatgacctacgctcaattcgtcggggccaggggacncccgaggtccaccgtccnccccagccctcaccgaacgggcccagtccggtcctccccgtggccgccctcgcctccgagacgccacccgtccgagacgcaacacggccggcccgtgggcctcggcccgtgggtaccaaacggtaccttaccttaccaaccttacacttgccttagcggcgggctcggcaacggcacgagtgcnnnnnn

SEQ ID NO: 155127 - DNA, 626 bp, Homo sapiens
  misc_feature: GYAE6OF02FSRXT.10.38.D05.1.454.CMB.1.raw
  modified_base (226)..(226): a, c, t, g, unknown or other
  misc_feature (226)..(226): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
tcagcatagtagtgcacgaccggtgctcgatttagtatctgatagttgggtttggggggggtctcaggaggcagcgctctcaggacgtcaccaccatggcctggctctgctcctcctcaccctcctcactcagggcacagggtcctgggcccagtctgccctgactcagcctccctccgcgtccggtctcctggacagtcagtcaccatctcctgcactggaaccngcagtgacttttgtgcttaataactatgtctcgtcggtaccagccaaccacccaggacaaacgcccccaaaacttccttgttttgagtcagtaagcgcctnaggngtccctgactcgttctcngcctccgaagtcngcaacnccggcctcccgtgacccttcgtcgtggtcctcgaggtctggagatggagtctgtaacttacgtacgtcgcgagccgactacttacgttcgaaccggtaccccgaaacgtaggggttaggttcgggacggtaccgggtaacgtaagggtcgtacccggttcgtacgggtaccaaccgggacccgtaagggccctacccggtccccccgttacggtccctaccgttcccgttcccgttacccccgtaccccttacccccg

SEQ ID NO: 155128 - DNA, 779 bp, Homo sapiens
  misc_feature: GYAE6OF02I2JDI.10.38.D05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtatctgatagttgggtttgggggggggtctcaggaggcagcgctctcaggacgtcaccaccatggcctgggctctgcctcctcctcaccctcctcactcaggcatagggtcctcgggcccagtctgccctgactcagcctccctccgtcgtccggtctccgtggacngtcagtcacctatcctccgtgcctacgcggaaccaggtccagtagtaccttttgttacgtactttaactaacttactcgttccttccgtacggtaccacggaccaaccctaacccggaagacccgaaaccaaccccctaattacctttggttttacgacggttaccgaagtaacgccgtacccgtagaacgggtactacccgtgtacgttcgttccgtcgaccgtaccctacggtaacgcgttacgaccgaaaaccgtcccgggtcctacccgttacggtacccgttccgtccggggttacgcccgtttaccggaccgggttagtaaccggggaagggttttacgaagggtaccggtaacgttaaggttacttaaaccccggttagttaacgccggaacggtacctaagtaccttaaaggttccccgaaacccggtaaccctaagggtacggggttacgttcgggaccggttacgggtaacgtaacgtcggtaccgtccgtacggtaccgaacgtcccgaaggtcccgtaccgtccctccggattaccggtcccgtttaacctccccgcccttaccg

SEQ ID NO: 155129 - DNA, 698 bp, Homo sapiens
  misc_feature: GYAE6OF02G26IX.10.38.D05.1.454.CMB.1.raw
  modified_base (574)..(574): a, c, t, g, unknown or other
  misc_feature (574)..(574): n is a, c, g, or t
  modified_base (587)..(587): a, c, t, g, unknown or other
  misc_feature (587)..(587): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctcgccctgactcacgccctccctccgcggtccgggtctcctgacagtcataccaccagtcctctgtacacgtacggaaccagacgtagttagtaccgttttgttacgtactttaataacttagttcgttctccgtaggtaacccacgtaccaacccgaacccgaaggaccctaaaacccgacccccctaaacgttttcccttttaggttttacgacggttacaacggtaacggtccccgtaccgtaggaacggtaccgtacctacggtacgttaccggtttctaccgtctcccgtaactacggtcgtacgacccaaacgtcccggtccctacccgtacgtaccccgtcgtacgtccgggtacctacgggtacgacgtaggaaggtacgtaggtacgtcttacgtaactactacgtcngacgctctatacnccgacgacctaggtgttgtcggacggtagacgtacggtctaccggtcgtacgcgacggtacgtacggcctaccgccgttacgctaccgttccgaccgttcccctactaccc

SEQ ID NO: 155130 - DNA, 602 bp, Homo sapiens
  misc_feature: GYAE6OF02F1MNC.10.38.D05.1.454.CMB.1.raw
  modified_base (501)..(501): a, c, t, g, unknown or other
  misc_feature (501)..(501): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtgggggtccctgagactctcctgtgcagcctctgggttcagcatcagtaaccgactacatcgacctcgggcccgccacggctccgaggggacggggctgggagtgggtcctgtagttattaggaaaccaggatcgggcaacgtacattaacgtttaattcgtacgacttccgtacgggaacgggtcccgtttacgaccctccgtaccagacgaaccaacgttaccaaaccaactactcttaggtacttcgttacactatcgtcaacgaactncgaagtagtcgacgacacggtaccctactattacttgtgacggtcgaactagtacgacgtaccgacgttacacgtttcggcggggtaccgaggtaacccgg

SEQ ID NO: 155131 - DNA, 686 bp, Homo sapiens
  misc_feature: GYAE6OF02IVBS4.10.38.D05.1.454.CMB.1.raw
  modified_base (155)..(155): a, c, t, g, unknown or other
  misc_feature (155)..(155): n is a, c, g, or t
  modified_base (166)..(166): a, c, t, g, unknown or other
  misc_feature (166)..(166): n is a, c, g, or t
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (490)..(490): a, c, t, g, unknown or other
  misc_feature (490)..(490): n is a, c, g, or t
  modified_base (637)..(637): a, c, t, g, unknown or other
  misc_feature (637)..(637): n is a, c, g, or t
  modified_base (648)..(649): a, c, t, g, unknown or other
  misc_feature (648)..(649): n is a, c, g, or t
  modified_base (652)..(652): a, c, t, g, unknown or other
  misc_feature (652)..(652): n is a, c, g, or t
  modified_base (660)..(660): a, c, t, g, unknown or other
  misc_feature (660)..(660): n is a, c, g, or t
  modified_base (665)..(665): a, c, t, g, unknown or other
  misc_feature (665)..(665): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
tcagcatagtagtgcacgaccggtgctcgatttagtatctgatagttggggtttgggggctttgcctgggtctcctggacagtcagtcaccatctcctgcactggaaccagcagtgactttgttgcttataactatgtctcctgtaccagcaccnccaggcaaacncccccaaactccttgttttcgaggtcagtaagccggccctnaacggacgtcccngacttcggttcnctgccttcgaacgtctggacctaaccacggtccctaccgtgtaccccgttctccggtcgggtacctacccggaggtcctaggtacggacgtcgggtaaggccgttaagactttaaccgtaacgtcggacctacggtcgcctaataaccgttccgaaccggttacccgaaacggtaggggttccggtttgggacccgggtaccgggtaagtaacgggtcggttaacccgggtcccgtgggtaaccacccggggaacccngtaccccgcccgtccccggtcggttacctcccgttctttcccgtaccccgacccttcccgtaccaccgttaactacgttcgtaccgacggtaccggtacgggtacttcgggacgaccggtccggtaacgacgttagcagtacgccancgtcaacgtcnngcngagcgcgnacacntacgcgacacgcgncngngtc

SEQ ID NO: 155132 - DNA, 770 bp, Homo sapiens
  misc_feature: GYAE6OF02HA92J.10.38.D05.1.454.CMB.1.raw
  modified_base (242)..(242): a, c, t, g, unknown or other
  misc_feature (242)..(242): n is a, c, g, or t
  modified_base (434)..(434): a, c, t, g, unknown or other
  misc_feature (434)..(434): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggtagttttggctgagtcttcgggttttccttgttgcctattttacgaaaaggtgtcctactgtgtaggttcaacgtggtggagaccgtagggaggaggctggactccgngacccggtggggggtcccctggacgtacctccttccgtagtcgactacgtccttcggttagggttccgagactacgtaccgtaagtaaccgtaccttaacgacgtaccgtacccgttcgggccccgcggacggtcctacggaggggaacgggcgtgggaggttcggtcgtacgtagtttaagttacgaaacnggtacgttcgggacctacgtaacttagttagtttcctttcgtacgtacgttccggtacggtaaccggggtccctttacccgtacccgtccgtaccgtaacggtaagtacccctaaccgtacccaaaccgtactactttacttacggtacttcgttactacgagttacgacaagtacgttacgagacgtacgtaccggaccgaaccggcccttaaacctagtttaagtttaccggttcggtacgtacccggtaccgtaaccttacggtaaccctacccggtaccttaccggtttaactcggtttacccgggtacgggttccggaaaccgggccccgg

SEQ ID NO: 155133 - DNA, 181 bp, Homo sapiens
  misc_feature: GYAE6OF02GY8HO.10.38.D05.1.454.CMB.1.raw
  modified_base (168)..(181): a, c, t, g, unknown or other
  misc_feature (168)..(181): n is a, c, g, or t
tcagcatagtagtgcacgaccggtgctcgatttagtatctgatagttgggtttggggggtgtggtggtctccactcccgccttgacggggctgctatatgccccctcggtcactctgttccaccctcctccactactatcgctgagcgggtctggcaaggcgcatagnnnnnnnnnnnnnn

SEQ ID NO: 155134 - DNA, 652 bp, Homo sapiens
  misc_feature: GYAE6OF02H9614.10.38.D05.1.454.CMB.1.raw
  modified_base (428)..(428): a, c, t, g, unknown or other
  misc_feature (428)..(428): n is a, c, g, or t
  modified_base (491)..(491): a, c, t, g, unknown or other
  misc_feature (491)..(491): n is a, c, g, or t
  modified_base (518)..(518): a, c, t, g, unknown or other
  misc_feature (518)..(518): n is a, c, g, or t
  modified_base (536)..(536): a, c, t, g, unknown or other
  misc_feature (536)..(536): n is a, c, g, or t
  modified_base (558)..(558): a, c, t, g, unknown or other
  misc_feature (558)..(558): n is a, c, g, or t
  modified_base (643)..(643): a, c, t, g, unknown or other
  misc_feature (643)..(643): n is a, c, g, or t
tcagcatagtagtgcacgaccggtgctcgatttagtatctgatagttgggtttggggggagaggagcccagcactgggattccgaggtgtttccattcggtgatcagcactgaacacagaggactcaccatggtagttttggctgagcttgggttttccttgttgctattcaaaaggtgtccactgtgaggttacaacgtggtggagacgtgggaggaggcgtggactccgacggccggttcgggggggtcccctggacgtacctcctccgtggtcgccgacgccttcgtgggttacagctaacgtcaagtaaccgactacgtatacggacccgtgggcccccgtacgacggtccgtacccggaagggggaacggggtccgtagggtacggttcggggtcctacgtaaggttttacgtaggaaaaacnggtaagtcggactaacgaacgtatttaattactcgtgtaccgtcgtaggacggtccgttaccncctacgccgagacactaacgtaccaanactatctagtactcttanacatcactacacgttcgagtanacgtcgaacgaccgacgacctactattagttcgacgtacgcagtactcggtaactacctcgtactacgttccgggtcggacccgnggtacccgg

SEQ ID NO: 155135 - DNA, 673 bp, Homo sapiens
  misc_feature: GYAE6OF02I501S.10.38.D05.1.454.CMB.1.raw
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
tcagcatagtagtgcacgaccggtgctcgatttagtatctgatagttgggtttgggggggagaggagcccagcactgggattccgaggtgtttccattcggtgatcagcactgaacacagaggactcaccatggagttttggctgagctgggttttccttgttgctattacaaaaggtgtccatgtgtaggttcaactggtaggagacgtggaggaggcgtggatcagtccggtcgggggtcctagacgactccgtctgtgaccncgcctcggtcggttacngtcctatccaagtaacgactaactgtacgtaccgtcgggccccgtacacggtaccgtccggaaggggtaacggcgtagggtacgggtcggtctacgtagtttagtaagaaacgagtaagcgtaaccacgtanaattattaactcgtacgtacgttcgtacgggtacggtccctacgtacccgtcgtaccgaaggtactaccgtaacctaccaaacgtactagttccttacgtacttacgtacctaagtctaagtaccgtataactcgtaacgacgtacgacgtaaccggacgaaccgtactaaccgttatcgttacgtagccgtaccgtaacgacgttcgtaaaccgtcggtacttacggtacgtaccgggtcggaccgacgggtaacccg

SEQ ID NO: 155136 - DNA, 856 bp, Homo sapiens
  misc_feature: GYAE6OF02HSKQZ.10.38.D05.1.454.CMB.1.raw
  modified_base (175)..(175): a, c, t, g, unknown or other
  misc_feature (175)..(175): n is a, c, g, or t
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
tcagcatagtagtgcacgaccggtgctcgatttagtatctgatagttggggtttggggggggtctcaggaggcagcgctctcaggacgtcaccaccatggcctgggctctgctccctcctcaccctcctcactcagggcacgagggtccgtgggcccagttctcgccctgactcngccctcccgtccgcggtccggtctccgtggacngtcacgtcaccgtattcctcctgacctaccggtaggaaacccngcctaacggttgttaacctttttgggtctacttttaaactaaccttacttnttcccgtacgttaacgggttaacccncggtaccccaacccgaaccccgaacggggaacctaaaaccccggaaccccccttaaaacctttcggtttttcggtttttaggacggtttacgaaacggttaccgtccccggtccgtacgtacggtacgtttaccccgtgtaaaccggtttcggttttccctctaccggtcccgttaaacccgagttcgacgtacaaacccgcggtccccttacggtccgtaaccgtccgtcggtcgggcccgttacggccggtaccgttggtaacgggactacggtcgggtacttacgtacgtttaacctggtcggccgtaaggcctaccttacgttaccggtacgttaacccggaccccggttaacggtaaggggttcggggttacgggtcgggtaccgggtaaacgggtcgttaccgggtaaccccggttcggttacgggaccggtacccgtacccggagggtcccgttccggtacccccgttcgggtacccttacccggttcccggtttcccccgtccccgttccccgttccccg

SEQ ID NO: 155137 - DNA, 858 bp, Homo sapiens
  misc_feature: GYAE6OF02GA0SJ.10.38.D05.1.454.CMB.1.raw
  modified_base (847)..(847): a, c, t, g, unknown or other
  misc_feature (847)..(847): n is a, c, g, or t
tcagcatagtagtgcacgaccggtgctcgatttagtatctgatagttgggtttgggggctctgctcctcctcaccctcctcactcagggcacagggtcctgggcccagtctgccctgactcagcctccctccgcgtccgggtctcctggacagtcagtcaccatctcctgcactggaaccagctagtgtactttgtgtcttaataactatgtcctcctcggtaccagccaacccacccgaaggaccaaacgtacccccctaaacttccgtttagtttttacgacggtctaaggttaaacgccggtcccctacgtaacgggtaaccgttcccctggtaacgtttccgggttcctacgttacggtaccccttaccgtaacggttccgtacgggtacctaaaccggacccggtaccctcccgtacggtacccggttcgttccggtacgggtccctaccggacggttccgtaggtacggtacgtacgggtacggtaccgttagttaaccgtttaacgtaaccgttcggtaaccgtacggtaccgaacttagttacccgttaaccggacccggtaaccccgtaaacgggttaaccggggtttcgggttccggggtaaccggggacggggttaaaccgtaacggggttcccggtaacccggttccggtaccgggtaccctaacccgggtacccgtaaccgggtcccgttccccggtaacccccgttcggtacccttaacgtttccccgttaacccgttacccccttcccggttaaccctacccgtaaccgttacgttaggtcccgtcggttacggacgggtcgtaaccggcggtaccgaacggccgtaaccgngtacggctacg

SEQ ID NO: 155138 - DNA, 725 bp, Homo sapiens
  misc_feature: GYAE6OF02JPA94.10.38.D05.1.454.CMB.1.raw
  modified_base (241)..(241): a, c, t, g, unknown or other
  misc_feature (241)..(241): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
tcagcatagtagtgcacgaccggtgctcgatttagtatctgatagttgggtttgggggctctgctcctcctcaccctcctcactcgagggcacagggtccgtcgggcccagtctgccctgactcacgcctccctccgcgtccgggtctccgtggacacgtcagtccaccatcctacctgcacgtggaaccagcagtcgtacgtttgttcgtacttaataactatcgttcctcgtcgtaccncgaccaccaccgaggaccaaaccgtaccccctaactttccgtttggttttacggacgtacaaggtaccgtccggccctaggacgccgtcctgcgttccggtctctcgacctacacgtcgtacgaccacgtccgtcctccgtcgccttcgtcggtcggcctcggagtctaggagtacncgggtacngtacggtacttactacgcgtacggcctacacgttagtaccgttaccgacccgggacccgtagggttacgggttacggttcggggaccgggtacgggttaacgtacgggccggtaccgggttaccgacgggacgtaccgtaccggacgtccccggttccgtccccggttaccgtcgtttacccgtccgtttacccgtcccctaaacccgttccgacccgttaataccgttacgcggttaccgggtcggaccgggtccgggtacgtacgggacctacggggacacccgttagggtcacgtg

SEQ ID NO: 155139 - DNA, 606 bp, Homo sapiens
  misc_feature: GYAE6OF02IOD74.10.38.D05.1.454.CMB.1.raw
  modified_base (189)..(189): a, c, t, g, unknown or other
  misc_feature (189)..(189): n is a, c, g, or t
  modified_base (340)..(340): a, c, t, g, unknown or other
  misc_feature (340)..(340): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (592)..(592): a, c, t, g, unknown or other
  misc_feature (592)..(592): n is a, c, g, or t
tcagcatagtagtgcacgaccggtgctcgatttagtatctgataggttggggtttgggggctttgcctgggtctcctggacagtcagtcaccatctcctgcactggaaccagcagtgactttgttgcttataactatgtctcctggtaccagcaccaccaggcaaagcccccaaacttcttgttttagngttcagtaagcggcctcaggagtcctgagtcggttctctgcctacgagtcgtcggacaacgacggccctccgtcgaccgttctcggttggactccgaggtcttaggaacgagtgaacggcttggtaactttacgaacgttgacaggcgtanactacgttacgacgaccccgaagtgggttcttcgggcggacggtataacggtgaccgttgtacggtcgaacgtaccgaaggtctaccgccccgttaggtaccacgtttcgtaccgttcccgtcctacctaccactactacgtacgacggtacgacgggtacggtcgtacgtacgaacggtcgtactaacgtagacngacgnaccgatcgngngagcngacnctacgtagtgtctcgacgtcgtacgtctagngacgtacgtctatg

SEQ ID NO: 155140 - DNA, 867 bp, Homo sapiens
  misc_feature: GYAE6OF02H915B.10.38.D05.1.454.CMB.1.raw
  modified_base (182)..(182): a, c, t, g, unknown or other
  misc_feature (182)..(182): n is a, c, g, or t
  modified_base (243)..(243): a, c, t, g, unknown or other
  misc_feature (243)..(243): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcgagggcacagggtcctcgggcccagtctgccctgactcacgccctcccncgcgtccggtctcgtggacacgccagtccacctactccgtcctgcctacgtaccggaaccngacgtacgttcgttacttttggtacgtctttaactaacttattcgttccttccgtcggtaacctacgacccaccaccccggaggaaccaaacccgtaccccctaaaaccttccgtttttaggttttcggaacggttacgaacggttaacggcccggtccctacggacgggtaccgttccgttaggtactttccggtttacctccgttccgtaccctaccgttaacggtccggttacggaacctaaaccgtaccccgggtaccctcccgtccggtaacccggttccttccgggtacggtcccgtacgtacgggtccgtagggtacggaacggttaggtcgggtaccgttacgttaacctttacgttaccgtacgtaccggactaccggtacttaacggttaccgtacccggtacccggtaccccggtaaacgggtttacggggttcgggtttaccggggaccgggggtccgggttaaacggttaaccggggtccgggttaaccccgttccggggttaccggtacggtaaaccccgggcccgtaacgggtccccgttacccccgggtacccggtttacgcccctttacgttccccggtttcccgtaccccccttaccccgtacccg

SEQ ID NO: 155141 - DNA, 788 bp, Homo sapiens
  misc_feature: GYAE6OF02JOBQJ.10.38.D05.1.454.CMB.1.raw
  modified_base (169)..(169): a, c, t, g, unknown or other
  misc_feature (169)..(169): n is a, c, g, or t
  modified_base (199)..(199): a, c, t, g, unknown or other
  misc_feature (199)..(199): n is a, c, g, or t
tcagcatagtagtgcacgaccggtgctcgatttagtatctgatagttgggtttggggggggtctcaggaggcagcgctctcaggactcaccaccatggctgggctctgctcctcctcaccctctcactcagggcacgagggtcctgggcccagtctcgccctgactcgngccctccctcgcgtccgggtctcctggacngtcagtccaccatcctctgacactcggaacctagctagtcgtacgttttgtcgtactttaataacttacgtcgtccttcgttacggtaaccacggaccctacccgaaccgtaacggaccctaaaacccgacccccctaaaccgtttccgttttacgggtttttcggaacggttaccgtacgggtaaaccggtccccgtacccgtacgggtaccggtaccggttccctacggttaaccgttccggggtttccctacgttcccggtaccccgtaccggttaaacggttccgttaccgggaccctaaaccggtaccccgtcccgttaccccgttacgggtacccgtcgttccgtcggtaccctacgggtacgtcggtacgaggtaccgtaggacgtcgtaactactacctcgtacgcgacggtctagtacttacgtccgaccgtaccgacgtcggggttcgttacgggccgtacggaaacgttcgggtaccgtaccggtcggtcggtaccgaccggttccggtaacgtcccggttccccgtacggttccgtaccttaccgtttcccgtcccgtttcccgccccgttaaccgg

SEQ ID NO: 155142 - DNA, 702 bp, Homo sapiens
  misc_feature: GYAE6OF02HLFQE.10.38.D05.1.454.CMB.1.raw
  modified_base (406)..(406): a, c, t, g, unknown or other
  misc_feature (406)..(406): n is a, c, g, or t
tcagcatagtagtgcacgaccggtgctcgatttagtatctgatagttgggtttgcggggagaggagcccagcactgggattccgaggtgtttccattcggtgatcagcactgaacacagaggactcaccatggagttttggctgagctgggttttccttgttgctatttcaaaaggtgtccactggtgaggttcaacgtggtggagactggaggaggctggatccagccgtcgggggtcctgacgactctctgtgcacgcctcgtggttcagcatcaacgtaacgactacagtcggaccgtcgggccccgccgacggcctccggaaggggagggcgtagggaggtgggtctacgtagttagttacgaaactacgagtcggacaacgttaactattacgtttacttntacgtaccgttaccgggtacggtaaccggggttcccggttacctacccccgtacttaccgaacggtaccgtaaacccttaacccgttaacccgaaacgtaaccttacgtttaccgtttagtaccctttccgttaaccctaaccagttcaaccttacaacgttacgacggtaagtaccggtaaccggaccgaacccgttacccgaaccttacgtttacttacggttgtaccggccgacgtacacggttacacgtaccgttactaccgttaacgtccgggaccgggtaccggtacggg

SEQ ID NO: 155143 - DNA, 810 bp, Homo sapiens
  misc_feature: GYAE6OF02FO5B4.10.38.D05.1.454.CMB.1.raw
  modified_base (240)..(240): a, c, t, g, unknown or other
  misc_feature (240)..(240): n is a, c, g, or t
tcagcatagtagtgcacgaccggtgctcgatttagtatctgatagttgggtttggggggggtctcaggaggcagcgctctcgggacgtctccaccatggcctgggctctgctattcctcaccctcctcactcagggcacgagggtcctgggcccagtctcgccctgactcagcctgactccgtgtcgtgggtctctggacagtcgatcaccatcctctgcacgtcggaaccagctaggtntacgttttgtctacttaataactatcgttccttccgtacggtaccacgaccacccacccgaacggaccaaaacccgacccccctaaaacgtttcccgttttaggtttttacggacggttacctaagggtaaccggtcccgggtaccccttacggtaacgggtaccgtttccccgtagttaacgtttcccggtttcttaccgttccgtacccgttacgtaacgttccgtacggacctaaaccgacccggtcccctacccgttaccggtacccgttccgtccgtacgggcccttaccggaggtccgtaggaaggtatagggtacgtcgtacgttacttaacgttacgtacgaccgcggtaccgtactacgtttaacgttaccggaacccgggtaccctaaggggttcgggtttacgggttacggggtacgggtaaccgggtaaacgttaacgggttccggtacccgggttccggtacgggtaaccgaccgggacccgtaacggtcccgttcccggtaccccgttcggtacccgttacccgttcccggttacccgttaccccccgttaacccc

SEQ ID NO: 155144 - DNA, 671 bp, Homo sapiens
  misc_feature: GYAE6OF02JCSO4.10.38.D05.1.454.CMB.1.raw
  modified_base (360)..(360): a, c, t, g, unknown or other
  misc_feature (360)..(360): n is a, c, g, or t
  modified_base (547)..(547): a, c, t, g, unknown or other
  misc_feature (547)..(547): n is a, c, g, or t
  modified_base (597)..(597): a, c, t, g, unknown or other
  misc_feature (597)..(597): n is a, c, g, or t
  modified_base (612)..(612): a, c, t, g, unknown or other
  misc_feature (612)..(612): n is a, c, g, or t
  modified_base (618)..(618): a, c, t, g, unknown or other
  misc_feature (618)..(618): n is a, c, g, or t
  modified_base (633)..(633): a, c, t, g, unknown or other
  misc_feature (633)..(633): n is a, c, g, or t
  modified_base (640)..(640): a, c, t, g, unknown or other
  misc_feature (640)..(640): n is a, c, g, or t
tcagcatagtagtgcacgaccggtgctcgatttagtatctgataggttggggtttgggggggagaggagcccagcactgggattccgaggtgtttccattcggtgatcagcactgaacacagaggactcaccatggagttttggctgagctgggttttcttgttgctatttcaaaaggtgtccactgtgaggttcaactggtggagacgtggaggaggctggatcagccgtgggggtcctgagactctcctgtgcacgtcctcgtcgggtcacgacactactacgtaacgaactacactacgtccgtacgggacccgccgacggtaccgtaccggacggggaacggggtacggtacgggnggtacggtcgtcgtacgttagttaacgaacgaagtacggtagcgtaactactaaattagttaactttacgtacgtaccgtaccggttacggtaacgggtcccggttaccgtacctacctacccgagaacgaccacttacccaaacaacgtaattcttagtcttacttacacagtctacaaccgtaanattacggaacgacgttccgaacgtacaacccggactaacctttaacgttntttggacgacccggntaaccngttacgaactaaccnccgttanaccgttaggtaccgggagggacccggaacgg

SEQ ID NO: 155145 - DNA, 686 bp, Homo sapiens
  misc_feature: GYAE6OF02GU08F.10.38.D05.1.454.CMB.1.raw
  modified_base (182)..(182): a, c, t, g, unknown or other
  misc_feature (182)..(182): n is a, c, g, or t
  modified_base (205)..(205): a, c, t, g, unknown or other
  misc_feature (205)..(205): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagcatagtagtgcacgaccggtgctcgatttagtatctgatagttgggtttgggggggggtctcaggaggcagcgctctcaggacgtcaccaccatggcctgggctctgctccctcctcaccctcctcactcgagggcacgagggtccgtgggcccagtctgccctgactcagcctcccnccgcggtccggtctccgtggacngtcagtccaccatcctcgtcgcacgtggaaccagcagtgtactttgtgattataactatgtcctcgtcgtacacgaccaccaccgagacaaccacccctaacttccgtttgtttacgacgtacacggtaacgccgccgtcgacggtaccgtcngtacgtcgttctcncgtccacgtactcgtacgaccgaactcccgtccctccgtcgaccgttcgtccgtcggtccgtccggacggtcggtacgggtacggacgttcgggaggtacgttaacgttaaccttacgttacgtaccacggtaacggcctagttaacgtcgttacccgaccggtacccgagggttaggttcggttcgggacgggtacggtacggtaacgtccggtaccgttccgggtcggtaccgtccggtaccggaccgtccccgtcccggtacccgtccgtaccgtccgttccccgttccgtaccccctaccccgttacccg

SEQ ID NO: 155146 - DNA, 839 bp, Homo sapiens
  misc_feature: GYAE6OF02FTRMV.10.38.D05.1.454.CMB.1.raw
  modified_base (168)..(168): a, c, t, g, unknown or other
  misc_feature (168)..(168): n is a, c, g, or t
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (290)..(290): a, c, t, g, unknown or other
  misc_feature (290)..(290): n is a, c, g, or t
tcagcatagtagtgcacgaccggtgctcgatttagtatctgatagttgggtttgggggggggtctcaggaggcagcgctctcaggacgtcaccaccatggcctgggctctgctcctcctcaccctcctcactcagggcagaggtcctggcccagtctagccctgactnacgcctccctcgcgtccggtctccgtgacagtcagtccactatctcngcacgtagaaccngcacgtgtactttgtacgtacttaacgtaactagttcgtaccttccgtacggttaaccgaanacccgtaaccccaacccgaacggaaccaaaaccccggtaccccccaaaacgtttcccttttaggtttttaaccggaaggtttaccgaaaggttaaacggcccggttaacccctcggtaaaacgggtcccgtttaccccggttaggtaaccgtttccgggttaccgttccgtaccggtaccctacccggtttaaagttccgttaaccgggaacctaaaccggacccggttacccgttacccgtaacggtaccctcggttacggtccgggtcctaccgtaaggtccgtaacggaagtcggtaacggtacgtacgttcggtaacttaaccgttcgttaacgcgtaacgtcggaactttagtaaccgttaccggaaccgtacccggttaaacgtaggggttttacggttacggaccgggttaacggtaaccgttaaacgggtcgttaaccccggttagttccggaaccgtaacgtaacccggaacggttcccgtccgttaccccgtagggttaccctacggtaccgtacccgttaccccaccgtttaaccccg

SEQ ID NO: 155147 - DNA, 826 bp, Homo sapiens
  misc_feature: GYAE6OF02GRYF6.10.38.D05.1.454.CMB.1.raw
  modified_base (162)..(162): a, c, t, g, unknown or other
  misc_feature (162)..(162): n is a, c, g, or t
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
  modified_base (787)..(787): a, c, t, g, unknown or other
  misc_feature (787)..(787): n is a, c, g, or t
tcagcatagtagtgcacgaccggtgctcgatttagtatctgataggttgggtttcgggggggtctcaggaggtcagcgctctccaggacgtcaccaccatggcctggctctgctcctcctcaccctcgtcactcagggcacagggtcctgggcccagtctcnccctagactcagcctccctacggctccggtctccgtggaccagtccaagttccaaccgntcctacctggccacgttcggaaccaggctaaggtnacctttttgtagacctttaataacctagttcgtctccttgggttaccaggaccaaccaccccgtaggaccaaacgtaccccccaaaacttcccgtttagttttttaccgaggtttaccaacgttaaacggcccggtaccccttacggaacggaaccggttccccttagtaacgttcccggtttaatccgtttacggccctttaccgaaacggttccgttacgggtaccaaaaccctaacgggtcccctttaaccccgtgtaaccccggttctttaccgtaccggggtccgttacccgacggggtacctacggtaacgggtacgttacggaaacggtcccttaagggtactttaaacctttaccgtacggacgtaaccgcggactaacgttaacttcgaccggaccctaaacgtcgggttacggttttacgggacggaccgggtaacgttaagggtccgtaacccggtttcgtagggttaccgaacggtaccccgacggtaacccgttcggaccccccgttcggttaacccnccgtttaccctcccgggtttccccgacccctttacccgg

SEQ ID NO: 155148 - DNA, 850 bp, Homo sapiens
  misc_feature: GYAE6OF02JKQ15.10.38.D05.1.454.CMB.1.raw
  modified_base (248)..(248): a, c, t, g, unknown or other
  misc_feature (248)..(248): n is a, c, g, or t
  modified_base (625)..(625): a, c, t, g, unknown or other
  misc_feature (625)..(625): n is a, c, g, or t
tcagcatagtagtgcacgaccggtgctcgatttagtatctgatagttgggtttggggggggtctcaggaggcagcgctctcaggacgtcaccaccatggcctgggctctgctcctcctcaccctcctcactcgagggcacgacgggtcctgggccctagtctcgccctgactcacgcctccctccggcggtcccgggtctacctggaccagtcacgtccaccattcctccgtgccacgtacggaaccngacacgtgttacttttggtacgtacttataacctagtcgtacctccgtaggtaccacgcctacccgacccgaggaaccaacccgtaccccgttaactttcgtttacggttttacgacggtaactacggtaacggtcccggtacccgtacgtacgggtacccgtcccgttagggtacgtttacccggttccttacgttccggtccccgtaaccggtaacttccgggaacccgtcctaaaaccggtcccggttaccccgtcccgtaacgtacccgttcggttaccgggtccggggtaacccttccggaaccggtacggtacgggtacggtacgtacggtacggtccggtaacgtaacgttacccgttagtaccggtacnccgggtacctacgttaacttaccggtaccggtaacccggtaaccccggtaaaggggtttcggggtttacgggttacccggggtaccgggtaacggggtaacggttaaccggttaccgggttaccggttacccgggtaccggtccgtaaccggtaccggacgtcccggtacccgtcccggttacgtcctaccggttaccgtttcccggtacccctacccgttaccg

SEQ ID NO: 155149 - DNA, 153 bp, Homo sapiens
  misc_feature: GYAE6OF01C9UR0.12.30.C08.1.454.CMB.1.raw
  modified_base (153)..(153): a, c, t, g, unknown or other
  misc_feature (153)..(153): n is a, c, g, or t
tcagatacgacgtacacgaccggtgctcgatttagtctgacgtcaaagggaagggaccaaggtggaaatcagacgaactgtggctgcaccatctgtcttcatcttcccgccatctgatacgtcgtatctgagcgggctggcaaggcgcatagn

SEQ ID NO: 155150 - DNA, 155 bp, Homo sapiens
  misc_feature: GYAE6OF01DCOMA.12.30.C08.1.454.CMB.1.raw
  modified_base (155)..(155): a, c, t, g, unknown or other
  misc_feature (155)..(155): n is a, c, g, or t
tcagatacgacgtacacgaccggtgctcgatttagtctgacgtcaaagggaaagggaccgaaggtggaaatcagacgaactgtggctgcaccatctgtcttcatcttcccgccatctgatacgtcgtatctgagcgggctggcaaggcgcatagn

SEQ ID NO: 155151 - DNA, 214 bp, Homo sapiens
  misc_feature: GYAE6OF01A8E7C.12.30.C08.1.454.CMB.1.raw
  modified_base (151)..(214): a, c, t, g, unknown or other
  misc_feature (151)..(214): n is a, c, g, or t
tcagatacgacgtacacgaccggtgctcgatttagtctgacgtcaaagggaagggaccaaggtggaaatcagacgaactgtggctgcaccatctgtcttcatctcccgcatctgatacgtcgtatctgagcgggctggcaaggcgcatagnnnnnnnnnnnnnnnnnnnnnnnnnnnnnnnnnnnnnnnnnnnnnnnnnnnnnnnnnnnnnnnn

SEQ ID NO: 155152 - DNA, 154 bp, Homo sapiens
  misc_feature: GYAE6OF01CEBIM.12.30.C08.1.454.CMB.1.raw
  modified_base (154)..(154): a, c, t, g, unknown or other
  misc_feature (154)..(154): n is a, c, g, or t
tcagatacgacgtacacgaccggtgctcgatttagtctgacgtcaaagggaaagggaccaaggtggaaatcagacgaactgtggctgcaccatctgtcttcatcttcccgccatctgatacgtcgtatctgagcgggctggcaaggcgcatagn

SEQ ID NO: 155153 - DNA, 532 bp, Homo sapiens
  misc_feature: GYAE6OF01BR2FT.12.30.C08.1.454.CMB.1.raw
  modified_base (428)..(428): a, c, t, g, unknown or other
  misc_feature (428)..(428): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtgtgattattactggagttggatccgccagtccccaggaagtgcctggagtggattggggtacatctatcacaggtgggagcacctactacactcccgtccctgaagagtcgaattacgatgtacaagtaaacacgtctaaggaaccagttctccctgaagctgtaggtctgtgactgccgnagacgacggccgtctactactgtcgccagggtcggtcttgcgcctaggtggttcgagagagtgactcgctttcggagtttccgggtggggcccgaggggtaacg

SEQ ID NO: 155154 - DNA, 154 bp, Homo sapiens; identical to SEQ ID NO: 155152
  misc_feature: GYAE6OF01C1UN1.12.30.C08.1.454.CMB.1.raw
  modified_base (154)..(154): a, c, t, g, unknown or other
  misc_feature (154)..(154): n is a, c, g, or t

SEQ ID NO: 155155 - DNA, 193 bp, Homo sapiens
  misc_feature: GYAE6OF01BQ9DO.12.30.C08.1.454.CMB.1.raw
  modified_base (153)..(193): a, c, t, g, unknown or other
  misc_feature (153)..(193): n is a, c, g, or t
tcagatacgacgtacacgaccggtgctcgatttagtctgacgtcaaagggaaagggaccaaggtggaaatcagacgaactgtggctgcaccatctgtcttcatcctcccgcatctgactacgtcgtatctgagcggctggcaaggcgcatagnnnnnnnnnnnnnnnnnnnnnnnnnnnnnnnnnnnnnnnnn

SEQ ID NO: 155156 - DNA, 614 bp, Homo sapiens
  misc_feature: GYAE6OF01AQP99.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtgtgattattactggagttggactccgccagtccccgaggggaacggccgtgggaggtggagttcgggtacatctatcgacgaggtgggagcacctactacactccccgtcctagaacgagtacgaattacgaatcgtacgaagtaaacacgtacgtaacggaacctagttcctacccgtagaacgtctaggaacggttctaggtcgacgtcgcccgacgacgaccgacggtcccgtactaccgttaacgtgtacggtccgtagggttcggtacgtttcgccgtccgtaggttcggttaccgaaggtacgtagtcggtacttcggtactttacggtacgttcgggtacggggactaggggtacttcgg

SEQ ID NO: 155157 - DNA, 629 bp, Homo sapiens
  misc_feature: GYAE6OF01CFPCR.12.30.C08.1.454.CMB.1.raw
  modified_base (325)..(325): a, c, t, g, unknown or other
  misc_feature (325)..(325): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattactggagttggactccgccacgtccccgagggaacgggccgtggagtggagttgggtacatctatcanagtgggagcacctactacactcccgtcctagaacgtagtacgaattacgatgtacaagtaaacacgtacgtaacggaacctagttacctacccgtagaacgtcgtagacggttccgtgtcgactgcccgacgacgaccgaccgggtccttacgtaccgttacgtcggtcgccggtacgggttcgggtacgtttcggcccgtccggttaggttcgggttacgaacggtagtagttacggacttccggtacgtttacggtacggttttccggggaggggtacccgtaagggggttactttcccggg

SEQ ID NO: 155158 - DNA, 154 bp, Homo sapiens; identical to SEQ ID NO: 155152
  misc_feature: GYAE6OF01AL3CR.12.30.C08.1.454.CMB.1.raw
  modified_base (154)..(154): a, c, t, g, unknown or other
  misc_feature (154)..(154): n is a, c, g, or t

SEQ ID NO: 155159 - DNA, 574 bp, Homo sapiens
  misc_feature: GYAE6OF01AX1T0.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaaggcctgggagtggattgggtacatctatcacagtgggagcacctactacactcccgtccctagaacgagtcgaattacgatgtacaagtaaacacgtctaacggaaccagttctcctgaagtctgaggttctgtgacgtgccgcagacacggcccgtctactactcgtgaccgtagggtcggtctttcggccgtccgtaggttcggtcacggtagtagttggtacgttccgtcgtttacggtagtttccgggttacgggggccgtaagggggttaactttccggg

SEQ ID NO: 155160 - DNA, 587 bp, Homo sapiens
  misc_feature: GYAE6OF01ALM49.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattactggagttggatccgccagtccccgagggaagggcctggacgtggattgggtacatctatcacagtgggacgcacctactacactccccgtcctagaagagtacgaattacgatgtacaagtaaacacgtacgtaacggaacctagttcctacccgtgaacgctagagtctgtcgactcgccgcgagacgacggtccgtctacgtacgtgtcgccgtagggtcggtcctttggccgtaccgtaggttcggttacgaggtacgtagtaggtacgttccgtcgtttacgtacggtttccgggtacggggacccgtaggggtaactttccgg

SEQ ID NO: 155161 - DNA, 582 bp, Homo sapiens
  misc_feature: GYAE6OF01DUE50.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattacgtggagttggatccgccacgtccccgagggacgggccgtgggaggtggagttgggtacatctatcacaggtgggagccacctactacctactccccgtcctagaacgtagtacgtaattacgatcgtactaagtaaacacgtacgtacgaacctagttcctcctagaacgctgagtctgtcgactgccgacacgacgacggtccgtactacgtactcggtcgaccgtagggttcggtctttggccgtccgtaggttcgttacgaggagtagtcggtacttccgtcgttcgtagtttcgggaggggtcccgtagggtacttcgg

SEQ ID NO: 155162 - DNA, 577 bp, Homo sapiens
  misc_feature: GYAE6OF01EWS2Z.12.30.C08.1.454.CMB.1.raw
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattatactggagttggatccgcagtccccagggaacggcctggagtggattggggtacagtctatcacagtgggancacctactacactcccgtcccngaagagtcgaattacgatgtacaagtaaacacgtactaaggaacctagttccncctgaacgctgagtntgtgactgcccgacagtaccgaccggtcgtctactactggtcgccgtagggtcggtactttcggccgtccgtagttcgggttacctaggaggtagtaggtacgttccggtacgtttcggaacgttttcgggagggggcccgtaaaggggtatttcccggg

SEQ ID NO: 155163 - DNA, 523 bp, Homo sapiens
  misc_feature: GYAE6OF01EYD6Y.12.30.C08.1.454.CMB.1.raw
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
  modified_base (486)..(486): a, c, t, g, unknown or other
  misc_feature (486)..(486): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtgtgattattactggagttggatccgccacgtccccgagggtaacgggcctggacgtggtacgnttggggtacagtcctatcacagtggagcacctactacatcccgtcctgaanagtcgaattacgatgtcagtaaacacgtctaggaccagttctccctgaacgctgaggtctgtcgactgcccgcagaccacggccgtctactactgtgccaggtcggctttgcgtccgagtggtcngagatgatcgcttcggattcggtgggtcccagggtac

SEQ ID NO: 155164 - DNA, 154 bp, Homo sapiens
  misc_feature: GYAE6OF01DTUOQ.12.30.C08.1.454.CMB.1.raw
  modified_base (154)..(154): a, c, t, g, unknown or other
  misc_feature (154)..(154): n is a, c, g, or t
tcagatacgacgtacacgaccggtgctcgatttagtctgacgtcaaagggcaagggaccaaggtggaaatcagacgaactgtggctgcaccatctgtcttcatcttcccgccatctgatacgtcgtatctgagcgggctggcaaggcgcatagn

SEQ ID NO: 155165 - DNA, 540 bp, Homo sapiens
  misc_feature: GYAE6OF01B8QO4.12.30.C08.1.454.CMB.1.raw
  modified_base (334)..(334): a, c, t, g, unknown or other
  misc_feature (334)..(334): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccacggtccccgaggggaagggcctgggacgtggattgggtacatctatcacaggtggancacctactacatcccgtcctagaacgagtcgaattacgatgtacaagtaaacacgtactagaacctacgttctacccgtagaacgtctaggagtctgtgtactgtcgacagactacggcctactactatcgtcgccgaggtcgtcttgcnccgtagtcgtacaggntatgactcgnttacgtgttcgggagggctagggtattcgg

SEQ ID NO: 155166 - DNA, 619 bp, Homo sapiens
  misc_feature: GYAE6OF01EZUYZ.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattacgtggtagttggatccgccagtccccgagggaacgggcctggagtggagttgggtacatctatcacgaggtggagcacctactacactccccgtcctagaagacgtacgaattacgatgtacaagtaaactacgtactaacggtaacctagttcctacccgtagaacgtcgttagacggttcgtaggtgtacctcgcccgactacgacgaccggtccgtacgtacgtacgtcggtcgtccgagggttcgggtcgtttcgcggtaccgaggtttcggttacgaagggtacgtagtcggtacgttccggtacgtttacggtacggtttcggggtagggggtccctaaggggtacgtttccggg

SEQ ID NO: 155167 - DNA, 657 bp, Homo sapiens
  misc_feature: GYAE6OF01DK5MQ.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaacgccctcacacgaccctgtccctcacctgcaatgtctcgtggtcgctccatcagcgtaggtggtgtatttattacgtggtagttggactccgacctacggtccccggagggaacgggtccgtgggagtggtagttgggtactatactatacacgaggtgggacgtaccaacctactaccactccccgtacctagaacgtacgtacgtaaattacgattacgtacaaagtaaacgacgtacgtaacggtaacctacggtttccctacccgtagaacgtcgtaggtacggttcgtagtacgactcggcccgtacacggacccgtacggtcccgtacttacgtacgtcggtcgtaccgtaggggtcggttaccttcggccgtccgtaggttcggtaacagggtactagtcgacgttccggtacgttcggtacggttccgggaggggacctaaaggggttacttcggg

SEQ ID NO: 155168 - DNA, 594 bp, Homo sapiens
  misc_feature: GYAE6OF01DVD9T.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccatcacctgcaatgtctctggtgctccatcagcagtggtgattattactggtagttggatccgccagtccccgagggaacgggcctggagtggagttgggtacagtctatcacgagtggagcacctactacactcccgtccctagaacgagtacgaattacgatgtactaagtaaaccacgttactaacggtaacctagttcctacccgtagaacgtcgtaggtaacggtctgtcgactcgccgtacagaccgaccggtccgtctacctacgtgtcgccgtagggtcggtctttcgccgtcgtaggtcggttacgagtagtagttggacgttccggcgtttcggaacggtttccgggtacggggtccgtaaggggttaacccg

SEQ ID NO: 155169 - DNA, 687 bp, Homo sapiens
  misc_feature: GYAE6OF01C4BVF.12.30.C08.1.454.CMB.1.raw
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaacgcctcacacgaccctcgtccctcacctgacatcgtctcgtggngctcatcngcagtggtatattacttagtggtagttggacgtccgcctacggtccccggaggggaacggtccgtagggtaggtgggtagttcgggtaactattacgtatacgaacgtaggtagggacgacctaccctaactacctaccgttccccgtacgtacgtaagacgtaacgtaacgttacggattcggtaacaacgtaaacgtaccggtagtaacgtaaccgttcgttccctaccgtagtaacgtcgttaggtacggtcttacgtacgtaccgtcgccgacgacgtccgacggtcctactactacggtcgtcgaccggtgggtcggttccttacggccgtacgttaggtcggttacagggtacgtacgttacggttactccggttcggtttacggttacggtttaccgggggacgggtaacggttaacgggttacctttcccgggg

SEQ ID NO: 155170 - DNA, 661 bp, Homo sapiens
  misc_feature: GYAE6OF01E26BW.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctcgtggtgctccatcagcaggtggtagatttattacgtggtagttggactccgccacgtccccgaaggggaacgggtccgtgggaggtggtagttcgggtacatctagtcaacgtaggtgggacgcaaccgtactactacgtccccgtaccagaagtagtacgtaacttacgatcgtacaagtaactacgtacgtaacggtaacctagtttcctaccgtagaacgtcgtaggtacgttcgtgtacgtaccgtcgacccgacaacggaaccgtacccgggtccgttacctacgttacgtcggtcgaccgtagggttcggtcgtttcgccggtccgtaggttccggtacgaagtacggtattacggtacgttcgttaccgtttacgggtaacgtttcggggtaccggggtaccggtaaaggggtacgttttccggg

SEQ ID NO: 155171 - DNA, 156 bp, Homo sapiens
  misc_feature: GYAE6OF01ENY8V.12.30.C08.1.454.CMB.1.raw
  modified_base (156)..(156): a, c, t, g, unknown or other
  misc_feature (156)..(156): n is a, c, g, or t
tcagatacgacgtacacgaccggtgctcgatttagtctgacgtcaaagggcaagggaccaaggtggaaatcagacgaactgtggctgcaccatctgtcttcatcttcccgccatctgatacgtcgtatctggagcgggctgggcaaggcgcatagn

SEQ ID NO: 155172 - DNA, 752 bp, Homo sapiens
  misc_feature: GYAE6OF01C58KU.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcggcccaggacctggtagaacgccctcacacgaccctcgtccctccacgtgactaatcgtctgtcggtacgccttccatcagtcgtaggtggtatatttattacggtggtaggttggtacctcccgtaccgtacggtaccccgaagggggtaacggtcccgttagggagtcggtagtttcgggactactcgtacacgtacgtaggtgggactacctaacctacgtacctaacgtccccgtacgtagaagtacgtactaacgtacgtagtacgtacgtaaacgtaacaccgtagtaaccggtacttacgttcccaccgtaaggtacgtcgttaggtacggtacttcgggtacttacggccgtaccccgtacgaacggtacccgtaccggtccccgttaacgtttacccgtccggttaggtaccccgggtacggtacgggggttcccgttaccggttccggtacccgggtaccgttaagggttccggtaacaaggggttatacggtacgtaccggtttcccgaggttttacggtaccgggttcgggttaccggggacccgttagggtaaccgtttcccgg

SEQ ID NO: 155173 - DNA, 667 bp, Homo sapiens
  misc_feature: GYAE6OF01B0QIL.12.30.C08.1.454.CMB.1.raw
tcagatacgacgtacacgaccggtgctcgatttagtctgacgtcaaaagggaaagggtctgtgagggcttcaccagtcctggacctcctgtgcaagaacatgaaacacctgtggttcttcctcctgctggtggcagctcccagatgggtcctgtcccaggtgcagctgcaggagtccgggcccaggactggtgaagccctcacacgaccctcgtccctcacctgcaatcgtctcgtggtgcctccatcagcaggtggtgtattattacgtggtagttggactccgccacgtccccgagggaacgggcctaggaggtcggagttcggtacatctatcacgaggtggacgactacctactaactacgtcccgtacctaggaacgtacgtacgtaaattacgagtgtacgaacgtaaactacgtacgtaacggaacctacgttacctaccgtagtaagtcgtaggtacgtcgtacggtgtacgtcggccgtacgaacggaccgaccgggtaccgttacgttaaccgtacgttacggtccggtaccgggtacgggtcggttcgtttcggcggtacccgtagggttccgttacgaacgggtgtaagtcggtaacgtcgttcgttacggtcggtttaccggggtagggacccggtagggtaacgtttcccggg

SEQ ID NO: 155174 - DNA, 758 bp, Homo sapiens
  misc_feature: GYAE6OF01CGRZ3.12.30.C08.1.454.CMB.1.raw
  modified_base (205)..(205): a, c, t, g, unknown or other
  misc_feature (205)..(205): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctccagatgggtcctgtcccaggtgcagctgcaggacggtccgggcccaggacgtggtagaacgcccctnacacgaccctcgtccctcacctgactaatcgtctcgtggtgcctccatcgagcgtaggtgtgtatttattacgtggtagttggactccgcctacgtccccggaggggaacgggccgtgggaggtacggtagttcggggtaacctagtaccgttactacgaacgtaagggtcgggacgacctaacccgtaccgtaccaaccgttcccccgtaccgtagaaacgtacgtactaaagttacgagttacgtacgtaaacggtaaactaccggtaacttaacgggtaaacctcggtttacccttacccgtaacggtaacgtccgttagggtaacgttcgtacggttacgtaaccgtcggaccccgtacaccgggaacccgtccgggtaccgttaccgttccgtaacggttcgtacggtaccggtaggggttcggtttacgttacccgccggtacgtacggtttcgggtaacgtagggaaacgttgacgttccggtccgttaccgttttcggtaggttaccggggaggggtacccgttaaggggtacttttcccggggg

SEQ ID NO: 155175 - DNA, 759 bp, Homo sapiens
  misc_feature: GYAE6OF01DYL77.12.30.C08.1.454.CMB.1.raw
  modified_base (200)..(200): a, c, t, g, unknown or other
  misc_feature (200)..(200): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggacgtcgggcccaggactggtgaagccctnacagaccctgtccctcacctgacaatcgtctcgtggtgcctccatccagcaggtgtgtattatacgtggtagttggattcccgccgtacgtcccccgaaggggaacgggccgtagggtaggtagggtacgttaggggtacacgttactagttaccgaacgtaagggtggggaactaccggtaacccttaacttaaccgtaccttacccccggttaccccgtaaggtaaacgtaacgggtttaaccgaaaagttttaaccgaagtttacggtacgtaaaacggttaaaaccgtaaaccggttacgtaaaccggggtaaaccctacggttttcccttaccccggtaaggtacgtacgttacgggtaacggtcgtttacggtacggacgttccggacccgacgtaaccggaaccgtaccggtacccgttactacgttaaccgtggtccggaccgtacgggtggttccgttggacccgtcgtaggttgtaccagggtaacgttagtgtaacgtccgtacgtttgacgtttcggggtacgggtcccgaagggttccttaccggg

SEQ ID NO: 155176 - DNA, 769 bp, Homo sapiens
  misc_feature: GYAE6OF01BOE39.12.30.C08.1.454.CMB.1.raw
  modified_base (161)..(161): a, c, t, g, unknown or other
  misc_feature (161)..(161): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagagtggtcctgtcccaggtncagctgcgaggacggtccgggacccaggacgtggtagaaccgtccctacaacaccgtacccctcgtcccctacacctgactaatcgtctgtggtcgcctacatcgagtcgtaggttggttagtaagtttacgttacggtagggtaggttcggacctcccggaccgtaccggtaccccggaagggggtaaccggtccggtagggtaggtacggttaggttacggtactacgttacttacgaccgtaggtacggtacgggacgtacctaacctacgtacctaccgttcccgtaccgtaggaacgtacgtaacgtaacgtacgtacttacgtaactaacgtaaacgtacgtacgtaacgtaacctcgttacctaccgtagacgtcgtacgtggtctggtacgtacgtcgaccgacgacgtaccgacgttaccgttacgtaccgtacgtcgtacgtacgggttacggtcggttccgttacggcccggttacggtacggttaccgggtaacgaacggttacgtaacggttacggttaccggttcccgggttacgttacccgggtttacgggttccgggtaacggggtaccgtaacgggtttacgttccccggg

SEQ ID NO: 155177 - DNA, 734 bp, Homo sapiens
  misc_feature: GYAE6OF01EVQKG.12.30.C08.1.454.CMB.1.raw
  modified_base (364)..(364): a, c, t, g, unknown or other
  misc_feature (364)..(364): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcgaggagtcgggcccaggactggtgaagccctcacacgaccctcgtcccctcacctgcaatcgtctcgtggtggcctccatcagcgagtggtgattattacgtggtagttggactccgcccacggtaccccgagggacgggcccgtgggaggtgggtagttcggggtactagtacgtataccgacgaggtacggganacctaacctacctacgacctccccgtccgtagaacgtacgtacgtaacgttacgactagtacaacgtaaacgtacgtacgtaacggaacccgtcgttacctacccgtcggaaacgtccgtagggacggttcgtacggtactaccggtcgacccgacgaacggaaccgtcccgggtcccgttacctaaccgttaccgtcggtacggtacccggttaggggtccgggttacccgttacgggtcccgtaccggtagggtttaccggtacggtacggtaaccggttaggtaccggttacgttccggttcccgtttaacggtcgggtttaccggggtacggggtacccgggttaaggggtaccgttttacccggg

SEQ ID NO: 155178 - DNA, 764 bp, Homo sapiens
  misc_feature: GYAE6OF01BBB9T.12.30.C08.1.454.CMB.1.raw
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
tcagatacgacgtacacgaccggtgctcgatttagtctgacgtcaaagggaaagggtctgtgagggcttcaccagtcctggacctcctgtgcaagaacatgaaacactgtggttcttcctcctgctggtggcagctccagatgggtcctgtcccgaggtgcaggctgcaggcgtccgggcccaggactgggtagaacgccctcaacacgtaccctcgtccctcacctgacaagtntctctggtcgctaccatcagcgtagtgtatagttattacgnggtgttagctcccgctacggtcccggaagggtacggccgttaggacggtacggtattacggtactacgtactacgctaagtacggtagggacaacctaaccgttactaccgtacctaccccggttaccgaacggtaacgtacgttaacggtaaattacggtaagttacgtaaccctaaagtaaaccgtacggtttaacctaaccgggaaccgttacttacccgtaccgtaggtaaacgtgtaacggtaggtacgttaggttaccggacttcggccgtaacgaacgacgtacccggtaccttacctacgttacgtcgggtaacctccgggtaaggttccgggttcctttagggaccccggttgtaacgggttttccggaacgttaaggggacgttaggtaccggtaaccgtttccggttacgttaccggggttaccggtttaccgggggaaccgggttaacccgggtagggttaaaccgtttccccggg

SEQ ID NO: 155179 - DNA, 892 bp, Homo sapiens
  misc_feature: GYAE6OF01BVG53.12.30.C08.1.454.CMB.1.raw
tcagatacgacgtacacgaccggtgctcgattttagtctgacgtcaaaagggaaagggtctgtgagggcttcaccagtcctggacctcctgtgcaagaacatgaaacacctgtggttcttcctcctgctggtggcacgctcccgaagagtcgggtcctcgtacccgagggtcgacagtctcgacgagggacggtccgggacccagggtacgtagggtacgaaaccgtcccctacaacgaaccggtaccccttacgttccccgtacctaccgtacgtaaccgtaacgttcgttaccttcggtgggtaccgtaccttaccaacttcggaacggtccgtagggttacgggttaacttaatttaacggtttacggtagggtaggttttaccggaccgttacccggtaccgtaaccggtaccccgggaaggggtaaccgggtcgttaggggtaacggttagggttacggttacggtaactactttactacgaacgacggttagggaccgggtactaacccgtaacctacgtaaccgttacccgaccccgttacgaggtaaacgtacggtaaccgtaaagttacgtacttaacgtaacgtaaacgtaaccgtacgtacgtaacgtaaccgtctttaccgacgtaacgtacgttacgtacggtaacgttcgttacggtactaccggtacggaaccgacgtacggtaccggtacgtaacccgtacttaacggacgtttaccggaccgggttacggacgggtttccggtacgtaccggtaccgttacggttaggttacccggtaagtaccggtaaacgtgtaaccggttcggtccgttaacggttacggttaccggttaccgggggttacggtaaccggttaaagggtttcccgttacggg

SEQ ID NO: 155180 - DNA, 715 bp, Homo sapiens
  misc_feature: GYAE6OF01BM6HS.12.30.C08.1.454.CMB.1.raw
  modified_base (106)..(106): a, c, t, g, unknown or other
  misc_feature (106)..(106): n is a, c, g, or t
  modified_base (661)..(661): a, c, t, g, unknown or other
  misc_feature (661)..(661): n is a, c, g, or t
  modified_base (665)..(665): a, c, t, g, unknown or other
  misc_feature (665)..(665): n is a, c, g, or t
tcagatacgacgtacacgaccggtgctcgatttagtctgacgtcaaagggaaagggtctgtgagggcttcaccagtcctggacctcctgtgcaagaacatgaaacncctgtggttcttcctcctgctggtggcagctcccagatgggtcctgtcccaggtgcagctgacgaggagtccgggcccaggacgtggtagaacgcccctcacgacgtacccctcgtcccctacacctgacaagttcgtcctcgtggtcggtcctaccgtatcaaggtcctagggttcggtagtaatttacttacggtgggtaggttacgacctcccggaccgtaccggtaccccggaggggaacggtccgtagggaggttcggtaggttcgggtaactagtaccggtactaccgaacggtagggttacgggactaccgtacccttaacgtaccgaccgtttcccccggtaccgtaaggaacggtaacggttacgtaaacgtacgtagttactacgtaaacgtaaccgtacgtacgtaacggacctacgttcctaccgaggaccgtgtaggtacgtcgttggaccgtctcggccgtacacggtaccgccgtaccgtctaaccgttcgtcggaccgtcggtaggtcgttaccgtcgccgtacggtaggtctacgganggtntacggacgttcgtacttacggtggtccgggtacggagtgggttctccggg

SEQ ID NO: 155181 - DNA, 151 bp, Homo sapiens
  misc_feature: GYAE6OF02GQOM1.12.30.C08.1.454.CMB.1.raw
  modified_base (151)..(151): a, c, t, g, unknown or other
  misc_feature (151)..(151): n is a, c, g, or t
tcagatacgacgtacacgaccggtgctcgatttagtctgacgtcaagggaagggaccaaggtggaatcagacgaactgtggctgcaccatctgtcttcatcttcccgccatctgatacgtcgtatctgagcgggctggcaaggcgcatagn

SEQ ID NO: 155182 - DNA, 151 bp, Homo sapiens
  misc_feature: GYAE6OF02H361T.12.30.C08.1.454.CMB.1.raw
  modified_base (150)..(151): a, c, t, g, unknown or other
  misc_feature (150)..(151): n is a, c, g, or t
tcagatacgacgtacacgaccggtgctcgatttagtctgacgtcaaggaagggaccaaggtggaatcagacgaactgtggctgcaccatctgtcttcatcttcccgccatctgatacgtcgtatctgagcgggctggcaaggcgcatagnn

SEQ ID NO: 155183 - DNA, 517 bp, Homo sapiens
  misc_feature: GYAE6OF02ITF9N.12.30.C08.1.454.CMB.1.raw
  modified_base (379)..(379): a, c, t, g, unknown or other
  misc_feature (379)..(379): n is a, c, g, or t
  modified_base (503)..(503): a, c, t, g, unknown or other
  misc_feature (503)..(503): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccagggaagggcctggagtggattgggtacatctatcacagtgggagcacctactacactcccgtccctgaagagtcgaattacgatgtcagtaaacncgtactaggaaccagttctcctgaagctgacggtctgtgactgccgcacgacacggccgtctactacgtcgtgcctaggtcgggtcttgcgtcagtggttcgagtgatgatcgcttcgattcgngggccagggattcg

SEQ ID NO: 155184 - DNA, 522 bp, Homo sapiens
  misc_feature: GYAE6OF02G3DFK.12.30.C08.1.454.CMB.1.raw
  modified_base (431)..(431): a, c, t, g, unknown or other
  misc_feature (431)..(431): n is a, c, g, or t
  modified_base (503)..(503): a, c, t, g, unknown or other
  misc_feature (503)..(503): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggaccggtgaagccctcacagaccctgtccctcacctgcaatgtctctggtgctccatcagcagtggtgattattactggagttggatccgccagtcccccagggaagggcctgggagtggattggggtacagtctatcacagtgggagcacctactacactcccgtccctgaacgagtacgaattacgatgtcagtaaacacgtctaggaaccagttctccctgaagctgacggtctgtgactgccgnagacacggcctctactctgtcgcaggtcgggctttgccgccagtcgtcagagatgatcgcttcgagttcggngggccagggtattcgtcgg

SEQ ID NO: 155185 - DNA, 523 bp, Homo sapiens
  misc_feature: GYAE6OF02GPLK0.12.30.C08.1.454.CMB.1.raw
  modified_base (380)..(380): a, c, t, g, unknown or other
  misc_feature (380)..(380): n is a, c, g, or t
  modified_base (491)..(491): a, c, t, g, unknown or other
  misc_feature (491)..(491): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtccccaggggaaggcctggagtggattgggtacatctatcacagtgggagcacctactacactcccgtccctgaagagtcgaattacgatgtacagtaaacncgtactaggaacctagttctcctgaagctgaggtctgtgactgccgcagacacggccgtctactactgtcgccgaggtcggctttgcgtcagtggtcaggtagatgatcgngttcgagtttcggtggggcctagggtattcgg

SEQ ID NO: 155186 - DNA, 519 bp, Homo sapiens
  misc_feature: GYAE6OF02FJC8J.12.30.C08.1.454.CMB.1.raw
  modified_base (496)..(496): a, c, t, g, unknown or other
  misc_feature (496)..(496): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtggctccatcagcagtggtgattattactggagttggatccgccagtcccccaggggaaggcctggagtggattgggtacatctatcacagtgggagcacctactacatcccgtccctgaacgagtcgaattacgatgtcagtaaacacgtctaggaacctagtctccctgaagctgaggtctgtgactgccgcagacaccggccgtctactactgtcgccagggttggctttgcgccagtggtcaggagatgaatcgcttcgngttcggtgggcctagggattcgg

SEQ ID NO: 155187 - DNA, 154 bp, Homo sapiens
  misc_feature: GYAE6OF02H7GCY.12.30.C08.1.454.CMB.1.raw
  modified_base (153)..(154): a, c, t, g, unknown or other
  misc_feature (153)..(154): n is a, c, g, or t
tcagatacgacgtacacgaccggtgctcgatttagtctgacgtcaaagggcacgggaccaaggtggaaatcagacgaactgtggctgcaccatctgtattcatcttcccgccatcgatacgtcgtatctgagcgggctggcaaggcgcatagnn

SEQ ID NO: 155188 - DNA, 541 bp, Homo sapiens
  misc_feature: GYAE6OF02GTJ9B.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggccaggactggtgaagccctcacagaccctgtccctcacctgcaatgtctctggtggctccatcagcagtggtgattattactggagttggatccgccagtcccccagggaaggcctggagtggattgggtacatctatcacagtgggagcacctactacatcccgtccctgaacgagtacgaattacgatgtacaagtaaacacgtctaggaaccagttcctccctgaacgctgaggtctgtgactgccgcacgacaccggccgtctactactgtcgccgtaggtgggtctttggcgtccaggttcggttcaggagattgattcgtcgttcgacgtttccggtaggggcctaggggtattcgg

SEQ ID NO: 155189 - DNA, 692 bp, Homo sapiens
  misc_feature: GYAE6OF02GAXDP.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtccgggcccaggactggtgaacgccctcacacgaccctcgtccctcacctgcaatgtctcgtggtgctccatcagcagtggtgtattaattacgtggtagttaggtatcccgcctacgtacccccgaggggaacggccgtagggagtagggtagttcggggtaacacgttactatcgaacgagggtgggacgacctaacctactactaccgtcccgtaccctagaagtacgtacgtaaacttacgattgtacctaaaggtaaacctacgttacgtaacgggtaaaccctacggtttccctaccccgttaggaacgttcgtaggtacgggttctaggtcgtacttcggcccgtacgacgaaccgaccggtccgttactaactacgtgtaccgccgtagggttcggttcgttcggaccgtccgtaggttcggttaaccgaggtacggtaagttaggtaccgttacggttcgttacggtacggtttccgggtaccgggggaccgtaggggtactttcccggg

SEQ ID NO: 155190 - DNA, 665 bp, Homo sapiens
  misc_feature: GYAE6OF02J3EFT.12.30.C08.1.454.CMB.1.raw
  modified_base (254)..(254): a, c, t, g, unknown or other
  misc_feature (254)..(254): n is a, c, g, or t
  modified_base (338)..(338): a, c, t, g, unknown or other
  misc_feature (338)..(338): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcggcccaggactggtgaacgccctcacagaccctgtccctcacctgcaatgtctcgtggtcgctccatcagcagttggtntattattacgtggtagttggactccgccacgtccccgaagggaggccgtgggagtggattgggacatctatcacgaggtggganccaacctactacactccccgtcctaggaacgtacgtacgtaaacttacgattcgtactaacgtaaacgtcgtactaacgggaacctaggttccctacccgtagaacgccgttaggacggttctggtacgaccttcgacccggactaacggcctaccgggtcccgtacttaccgacgtcggtacgacccggtagggttccggtacgtttcggccggtaccgtagggtttcgtacgaggtaaccgtagtaacggtccgttccggacgttttaccgggtacgttaccgggggttacggggtaccccgttaaggggttacccttttccggg

SEQ ID NO: 155191 - DNA, 596 bp, Homo sapiens
  misc_feature: GYAE6OF02FLBVK.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattactggagttggatccgccagtccccgagggaacgggcctgggagtggagttgggtacatctatcacgaggtgggacgcaacctactacactccccgtcctgaagagtcgtaatacgatcgtacaagtaaacacgtacaaggacctagtcctcctagaagctgagtctgtcgactcgccgcacgacaccggtccgtactacctacgtcgtcgccgtagggttcgggtctttcggccgtacgtagggttcggttacaacgggaagtacgtaggtacttaccggtccgtttacggtacgtttccggggtacgggggtacccgtaaggggtacttttcccggg

SEQ ID NO: 155192 - DNA, 582 bp, Homo sapiens
  misc_feature: GYAE6OF02FSQ8V.12.30.C08.1.454.CMB.1.raw
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
  modified_base (377)..(377): a, c, t, g, unknown or other
  misc_feature (377)..(377): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtgtgattattactggagttgatccgcagtccccgagggaacggcctggagtggagttgggtacagtctatcacagtggancactacacactcccgtacctgaacgngtcgaattacgatgtacagtaaacncgtactacggaacctacgttctcccgtagaacgtctgacggtctagtcgacttcggccgtcgacgaccgaccgggtccttactaccgtacttggtaccgccgtaggggtggtcctttcggccgtccgtagttcggttcaggtacgtagtgacttcgtcgttacgtacggtttccgggtggggtcccgtaagggttatttcccggg

SEQ ID NO: 155193 - DNA, 660 bp, Homo sapiens
  misc_feature: GYAE6OF02GL2GJ.12.30.C08.1.454.CMB.1.raw
  modified_base (342)..(342): a, c, t, g, unknown or other
  misc_feature (342)..(342): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattactggtagttggactccgccacgtcccccgagggaacggccgtgggaggtggtagttgggtactactctatcgacgagtgggacncacctactacactcccgtaccctagaacgacgtacgaattacgatacgtacaagtaaacacgttacgtaacggtaacctacgttcctacccgtagtaacgcttacggaggttccttggtacgtacgttcggcccgtacgacggtaccgaccggtcccgttaccttaaccgtacgttcggtaccgtaccggtagggttcgggttacctttggcccgtaccgtaggttcggttaccgaaggtacggtaattacggtacgttccgttaccgtttcggtacgtttccggggtaccggggtacgtaggggttactttaccggg

SEQ ID NO: 155194 - DNA, 681 bp, Homo sapiens
  misc_feature: GYAE6OF02ILRJQ.12.30.C08.1.454.CMB.1.raw
  modified_base (201)..(201): a, c, t, g, unknown or other
  misc_feature (201)..(201): n is a, c, g, or t
  modified_base (425)..(425): a, c, t, g, unknown or other
  misc_feature (425)..(425): n is a, c, g, or t
tcagatacgacgtacacgaccggtgctcgatttagtctgacgtcaaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaacgccctnacagaccctgtccctcacctgcaatgtctcgtggtcggctccatcgagcgagtggtgtattattacgtggagttgactccgccacgtcccgagggacggccgtggaggtggtagttgggtacagtctactcacgaggtgggacgaccaccgtactacacgtccccgtaccgtagaaacggtacgtacgtaaacttacggtacttacgtacgtaaacgtaaaccncgtacgtaacggaacctacggttcctacccgtagaacgtcgttagacgggttctacggtagaaccgtcggtacccgacgtaacgtacccgacccggtcccgtttaccgtaaccgttacgtcgggtaccgccgggttaacgggttcgggttcctttcggcccgtaccggttaggttcggttaacgaggtaaggtcgtacggtaacgttccgtacgtttacgacggtttcgggaccggggactagggttacgttccgg

SEQ ID NO: 155195 - DNA, 212 bp, Homo sapiens
  misc_feature: GYAE6OF02FJ8Z9.12.30.C08.1.454.CMB.1.raw
  modified_base (153)..(212): a, c, t, g, unknown or other
  misc_feature (153)..(212): n is a, c, g, or t
tcagatacgacgtacacgaccggtgctcgatttagtctgacgtcaaagggaaagggaccaaggtggaaatcagacgaactgtggctgcaccatctgtcttcatctcccgccatctgatacgtcgtatctgagcgggctggcaaggcgcatagnnnnnnnnnnnnnnnnnnnnnnnnnnnnnnnnnnnnnnnnnnnnnnnnnnnnnnnnnnnn

SEQ ID NO: 155196 - DNA, 612 bp, Homo sapiens
  misc_feature: GYAE6OF02GKDC8.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgtattattacgtggtagttggactccgccacgtccccgagggacgggcctgggagtggagttgggtactatctatcacgagtgggacgcacctactacactccccgtccgtagaacgacgtacgtaattacgatcgtactaagtaaactcgtacgtaacggtaaccctagttaccctcccgtagaacgtcgtaggtacggttctaggtgaaccgtcggacccgacgacggaccaccgggtcctaccgtactacgtcgtacgtccgtagggtcgtcgtttcgccgtaccgtggttcgtacgaggcgtagtcgtacgttcgttcgttcgtaggtttccgggacgggtccgtagggtacttccgg

SEQ ID NO: 155197 - DNA, 663 bp, Homo sapiens
  misc_feature: GYAE6OF02JVKLZ.12.30.C08.1.454.CMB.1.raw
  modified_base (228)..(228): a, c, t, g, unknown or other
  misc_feature (228)..(228): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccatcacctgcaatgtcnctggtgctccatcagcagtggtgattatactggagttggactccgccacgtccccgagggacggcctggagtggattgggtacatntatcacagtgggancacctactacactcccgtcctagaagtacgtcgaacttacgatcgtacaagtaaacacgtactaacggaacctagtttccaccctaggaaacgtctaggacggtctggtagaccttcggaccgaccgtaacgaacccgaccgggtacccggttaccttaaccgttaccgtaggttaccggccggttaacgggggttcgggttcctttagggacccggtacccgtaggggtttccggtttacggaaacgggtacggttaagtcgggttaacgttccggttaccggttttacggaccggttttccggggtacggggacccggttaagggttaacccg

SEQ ID NO: 155198 - DNA, 699 bp, Homo sapiens
  misc_feature: GYAE6OF02FZAWI.12.30.C08.1.454.CMB.1.raw
  modified_base (260)..(260): a, c, t, g, unknown or other
  misc_feature (260)..(260): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggacgtcgggcccaggactggtgaacgccctcacacgaccctcgtccctcacctgactaatcgtctcgtggtcgctccatcagcagtggtntattattacgtggtagttggactccgaccacgtaccccggaggggaacgggccgtagggaggtgggtagtttacgggtactattactaatacgaacggtaggtagggacgtacctaacctaactaaccgtaccgtaccccgtcctaaggaacgtacggtacgtaaagttacgactagtactaacgtaaactacgtacgtaacggtaacctacgttcctaccgagtaacgtcgtacggtacggttactgtacgtacgtcggacccgacgtaccggacccgtaccggtacccgttactaacccgtacgtcggtacgacccggtagggttcggttcgttcggaccgtacggtaggtttcggtactaaggtagagttacggtacttcggttacgttacggtacggtttccggggtacgggtaaccgtaggggtactttccggg

SEQ ID NO: 155199 - DNA, 614 bp, Homo sapiens
  misc_feature: GYAE6OF02FVA3Y.12.30.C08.1.454.CMB.1.raw
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatcgtctctggtgctccatcagcagtgtgattattactggagttggatccgcagtccccagggaggcctaggacgtggattgggtacatcgtatcacagtgggacncactactacncgtcccgtcctagagtacgacgtaacgtacgatacgtactaagtaaacctacgtacgtaacggaacctagttccctaccgtagaacgtcgtacggtacgtcgtgtacgtacgtcgacccgacgaccggaccgtacccggcccgttaccttaaccgtaaccggttgtccgaccggtagggtcggttccgttgaccgccgttaggttcgtacgaggtgtagtacgtacgttccgtcgttacgtacgttcggggccgggtacgtacggttacttccggg

SEQ ID NO: 155200 - DNA, 576 bp, Homo sapiens
  misc_feature: GYAE6OF02IVGYC.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtgtgattattactggagttggatccgccacgtccccgagggaaggcctggagtggattgggtacatcgtatcacagtgggacgcacctactacactcccgtcctgaacgtagtcgaattacgatgtacaagtaaacacgtactaggaacctacgttctcccgtagacgctgacgtctgtgactgccgacacgaccgacggtccgtactacgtacgtgtcgccgtagggtcggtctttcggcgtccgtaggttcggttactaggacgtacgtcggtaattccggtactttaccggtagtttccgggcggggtaccgtaggggtacttccgg

SEQ ID NO: 155201 - DNA, 674 bp, Homo sapiens
  misc_feature: GYAE6OF02II4Z1.12.30.C08.1.454.CMB.1.raw
  modified_base (337)..(337): a, c, t, g, unknown or other
  misc_feature (337)..(337): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacacgaccctgtccctcacctgcaatcgtctcgtggtcgctccatcagcagtggtgattattacgtggagttggactccgcacgtccccgagggaacggcctggacgtggagttgggacagtctatcacgaggtgganctacgtactacactccccgtcctagaagcgtacgaagttacgattacgtacaagtaaaccacggttacctaacgggtaaaccctggtttaccctacccgttaggaaacgtccgttaggtacggttcttggtactaccgtcgtcccgacgaacgaccgaccggtccttactaccgttacgtcgtcgtaccggagggttcggttcgtttacggcccgttaccgtagggttccggttacgtaacgggacggttacgtagggtaaccgttccggttaccgtttacgggaaccgttttccggggacgggggtaacccgtagggggttaaccttttcccgggg

SEQ ID NO: 155202 - DNA, 613 bp, Homo sapiens
  misc_feature: GYAE6OF02FY7RN.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtcggctccatcagcagtggtgtattattacgtggtagttggatccgcacgtccccgagggacgggcctgggacgtggagttgggtacatctatcacgaggtgggagccgactactacactcccgtcctagacagtacgaattacgatgtacaacgtaacacgtacgtaaggacctagttccctcccgtagtaacgcgttggtacgtcgtagtcgtactcggccgtacacggtaccgacccggtccttaccgtacgtacgttcggtcgaccggtagggtcgtacgttcggaccgtccgtagttcggtacagggtatacgtagtaccgtcgttacgttacggtacggtttcgggacgggacccgtaaggggtactttccgggg

SEQ ID NO: 155203 - DNA, 690 bp, Homo sapiens
  misc_feature: GYAE6OF02H8B2F.12.30.C08.1.454.CMB.1.raw
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (384)..(384): a, c, t, g, unknown or other
  misc_feature (384)..(384): n is a, c, g, or t
tcagatacgacgtacacgaccggtgctcgatttagtctgacgtcaaaagggaaagggtctgtgagggcttcaccagtcctggacctcctgtgcaagaacatgaaacacctgtggttctttcctcctgctggtggcagctcccagatgggtcctgtcccaggtgcagctgcaggagtcgggcccaggactggtgaagccctcacacgaccctgtccctcacctgactaatgtctcgtggtcgctccatcagcaggtgtgattatacgtggtagttgactccgcacgtacccgagggaacggcgtggagtgtagttggtatatctatcagngtggacnctacctactacacgtccccgtacctagacgtacgtacgtaaattacgntagtaacaacgtaaactacgttacaaggtaacctagtttcctacccgtagaaagtcttaggtacggttctaggtagtaaccgttcggacccgtacgaaccggaaccgtaccgggacccttacgtttaaccgtaacggttcgaccggtaccggtaacggggttcgggttaccttttcgggacccgtacccgtagggttaccggtttaacggaacggtcggttaagttacgtaaccgtttcccgttacggtttaccggtacggtttccggggtaacgggtcccgtaaacggggttacgtttacccggg

SEQ ID NO: 155204 - DNA, 716 bp, Homo sapiens
  misc_feature: GYAE6OF02I50DM.12.30.C08.1.454.CMB.1.raw
  modified_base (249)..(249): a, c, t, g, unknown or other
  misc_feature (249)..(249): n is a, c, g, or t
  modified_base (329)..(329): a, c, t, g, unknown or other
  misc_feature (329)..(329): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtgngattatactggagttggatccgccagtccccagggaacggcctgggagtcggattgggtaacatctaatcacagtgggancacctactacactccccgtcctgaagagtacgaattacgatgtactaacgtaaacacgtactaacggaaccctacgtttacctccccgtaggaaacgtccgttaggaacggttacctggtacgtaaccgttcggtcccgacgtaaccgaacccgtaccgggtcccgttaccgttaaccttaaccgttacggtcggtacccgtaagggggttccggggttcccgtttttacggcccgggtacccgttaacggggttaccgggtttacgaaacgggtaacggttaacgttcgggtaaaccgtttccgggtaacccgttttaccgggtaacggtttttaccggggtccggggggttaacccgtaacggggggttaaactttttcccgggg

SEQ ID NO: 155205 - DNA, 668 bp, Homo sapiens
  misc_feature: GYAE6OF02HO6PJ.12.30.C08.1.454.CMB.1.raw
  modified_base (199)..(199): a, c, t, g, unknown or other
  misc_feature (199)..(199): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctnacagacctgtccctcacctgcaatgtctctggtgctccatcagcagtgtgattattactggagttgactccgccacgtccccgagggaacgggccgtgggagtggtagttgggtacatctatcgacgaggtgggacaccacctactacactcccgtacctagaagacgtcgaaattacgatgtacaagtaaactacgtacgtaaggtaacctacgtttactacccgtagaacgtcgttacggtaacggtcttacggtacgtaccgttcggtacccggacgaacggtaccgaaccgggtcccgttaaccgttaccgttaacgttccggtacggtaccgtaggggtcgggttcgtttcggaccgtcccgttaaggtcggtttaacgacggtaaggtactaggtacgttaccgtccgtttacgggttacgtttacggggtccggggtaaccggttacgggtagtttcccggg

SEQ ID NO: 155206 - DNA, 822 bp, Homo sapiens
  misc_feature: GYAE6OF02JAVAD.12.30.C08.1.454.CMB.1.raw
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacacgaccctgtccctcacctgacaatgtcctcgtggtcgcctccatcagcagtggtgtattattacgtggtagttggactccgctacgtccccggaagggacgggtcctagggcgtggagttcgggtacagtcctatcgacgaggtgggagacctaccgtaactacgtacgttccccgtacccgtaagtacgaacgttacgtaaacgttttaacggacgtttaccgttaaacggtaacggttaaaaccgtacccggtttaaccggtaaaccggggtaaacccttaaccggttttccccgttaccccgtaacggtaaacgtcccgttagggtaaccgttccgtacggtaccggtaccgtacccggtacccgaccggaacgaccccggtacgggtccccgtttaactaacccggtttaaccgtttcgggacccgtaccgggttaacgggggtttccgggttaccgttttaaccgggcccggttaccgggttaaccgggtttcgggttaacctaacggggaacttacggtaaccggtccgtttacccggttaccggtttagggttacccggtttacccggggtaggggtaaccccggttaaaggggggttcccttttaccggggg

SEQ ID NO: 155207 - DNA, 623 bp, Homo sapiens
  misc_feature: GYAE6OF02F5EF8.12.30.C08.1.454.CMB.1.raw
  modified_base (265)..(265): a, c, t, g, unknown or other
  misc_feature (265)..(265): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (385)..(385): a, c, t, g, unknown or other
  misc_feature (385)..(385): n is a, c, g, or t
tcagatacgacgtacacgaccggtgctcgatttagtctgacgtcaaagggaaagggtcgtgtgagggcttcaccagtcctggacctcctgtgacaagaacatgaaacacctgtggttcttcctcctgctggtggcagctcccagatgggtcctgtcccaggtgcagctgcaggagtcgggcccaggactggtgaacgccctgacacgaccctgtccctcacctgccaatgtctctggtgctccatcagcagtgtgattattacgnggtagttggactccgcacgtcccgaggggaacgcctggagtggatttggacntctatcagagtgggacncacctatacgctcccgtccgngaacgagtacgaattcgatgacagtaaacngtcaggacctagtctcctaggacgtctacgtagtctacgctacttacggccccagtaaccgaccggtacccgggaccctttataaaccgtccgttggtaccgtaccggtaggggtttcgggtcctttgggaccgacccgttagggttccgttaacgaggttaacgacggttagtacgtttccgtacgtttacggacgttttcccgggaggggtaccctaaggggttctttaaccgggg

SEQ ID NO: 155208 - DNA, 752 bp, Homo sapiens
  misc_feature: GYAE6OF02GIP7I.12.30.C08.1.454.CMB.1.raw
  modified_base (392)..(392): a, c, t, g, unknown or other
  misc_feature (392)..(392): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccgaggtgcagcgtgacgaggtcgtccgggacccgaggtacgtggtacggaacgccctacacgacgtaccctcgtccctactaccgtgacctaagttcgttccttcggtggtcggtcctaccactcgagtcgtaggtggtagttaattacgttagtgggtagttgacctccgccgacgtcccgaggggacggcgtagggtaggtggtagtacggtactagtctagtacacgtaagggnggacacctaactactacctaccgtccccggtacctaaggaacgtacgtacgttaaagttacgtagttacgtaaccgtaaacgaaaccggtctaacggtaaaccgtaaccgttacgtttacccgtacccggtaagtaacggtacgtacgggttaccggttcgtacgtaccggtcgtaccggcccgaactaccggtaccgtaccggtcccgttaacgttaacccgttacggttcggtaccgacggttacgggttacggttccgttcggaaccctcggtacggtttcgtacgaggtatacgttcgtaccggttcgtacgttaccgtagggttcccggtaggtaccggttaggttacgttccgg

SEQ ID NO: 155209 - DNA, 692 bp, Homo sapiens
  misc_feature: GYAE6OF02ISMOI.12.30.C08.1.454.CMB.1.raw
  modified_base (400)..(400): a, c, t, g, unknown or other
  misc_feature (400)..(400): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctcgtggtgctcatcagcagtggtagtattagttacgtggtagttcggatccgccacgtcccgagggacggcgtggagtggtagttggtactatctatcgacgtaggtggacgactacctacactacgtcccgtactagagacgtacgtaattacgatacgtacaagtaaaccncgttacgtacgtaaccctgttaccgtacctagtaacgtcgttacggaggttctagggtacgtaccgtccggtacccgacgaacggtaaccggacccgggtcccgttaaccgttaccgtaaccggtttcggaacgtcccggtaaggggttccgggttccgtttcggacccgccggttagggttccgggttaacggagggtaacgttaggttacggtaccgttacccggttcgtttaccgggtaacggttttccgggggccgggtaaccgttagggggttaaccgttttccggg

SEQ ID NO: 155210 - DNA, 793 bp, Homo sapiens
  misc_feature: GYAE6OF02GZLW7.12.30.C08.1.454.CMB.1.raw
  modified_base (728)..(728): a, c, t, g, unknown or other
  misc_feature (728)..(728): n is a, c, g, or t
tcagatacgacgtacacgaccggtgctcgattttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcagggagtcgggcccaggactggtagaacgcccctcacacgtaccccttgtcccctacacctgacaatcgttctacgtggtcggtcctccatcgagcgaggttcggtagtaactttaacgttacggtagggtagttacggtacctacccggtcccgtaccggtcccccggaagggggtaacggggtacccggttaggggtacggttggtaacggtttagggttaactaacgttaccgttaacgtaccgaaacgtacggggtgggtaaacggtccctaaaccgttaaccgtacctacccgttaccccggttacccgtaacgggtaacggtaaccggttaacggttaaacgttacggtaacgttaacgtaaccggttaaacgtaaaacccggtacgttaccgttaaaccggaccgtttaaccgttccctaacccggtagacgtcgtaaggtacggttctagttacgaccgtcggacccgacaaccggccgtaccggtaccttcgaaccttaccggtcggaccgcgggtacgggttcgtcgttacgccgtacgtggtttcganaggtaggtactagtacgtcgttcttaaccgggtcgttacgggccgggtactacggttcgttacgg

SEQ ID NO: 155211 - DNA, 853 bp, Homo sapiens
  misc_feature: GYAE6OF02HLE2F.12.30.C08.1.454.CMB.1.raw
  modified_base (205)..(205): a, c, t, g, unknown or other
  misc_feature (205)..(205): n is a, c, g, or t
tcagatacgacgtacacgaccggtgctcgatttagtctgacgtcaaagggaaagggtctgtgagggcttcaccagtcctggacctcctgtgcaagaacatgaaacacctgtgttcttcctcctgctggtggcagctccatagtgggtcctgtcccaggtgcagctgcgaggtagtccgggcccaggacttggtgaacgcccctanaaccacggtaccccctcgtccccaccgacctgactaattcgttctcgtcggacgtcctaccatacgacgcgtaggttcggtagtactttacgttaacgttagggtaacgtttacgggaccgtaccccggtaccgtacccggttaccccccgggaaagggggtaaccgggtccggtaggggtaacgggttcgggtacggtttacggggtaacctactttaccgttaacgtcccgtaacgtagggtaccgggaacgaccccgttaaaccgtaccgttaaccgtaacccgtttccccgtaccgtaacggtaacggtaacggtaacgtaaacgttaactaaggttacgtaaccgtaaacggttaaaccctaacggttaaccgtaaaccggtaaccttaacggtttacccccgtaacgttaaccggtacggtaaccgttacgggtaacggttcgtaggtaccgtaccggtaccgacgtacgtaccgtacggacccggtcccgtaacgtaccgttacgtaccgcggtccggtacggggttcggtcggttaccggtcgtaccgtttcggtacggttacgacggttagacggttcgacgttccgtccggttacggttacgggttccgggtacgggtacgtacggttaacgttccgg

SEQ ID NO: 155212 - DNA, 697 bp, Homo sapiens
  misc_feature: GYAE6OF02IHC55.12.30.C08.1.454.CMB.1.raw
  modified_base (562)..(562): a, c, t, g, unknown or other
  misc_feature (562)..(562): n is a, c, g, or t
  modified_base (574)..(574): a, c, t, g, unknown or other
  misc_feature (574)..(574): n is a, c, g, or t
  modified_base (612)..(612): a, c, t, g, unknown or other
  misc_feature (612)..(612): n is a, c, g, or t
  modified_base (624)..(624): a, c, t, g, unknown or other
  misc_feature (624)..(624): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcacgctcccagattcgggtcctcgtcccaggtgcagcgtcgcgtaggcggtccgggcccaggtaccgtgggtgaacgccctcacgaaccgaccccttgttccccacaccctgactatcgttcctcgtgggtcgcctaccgatcaacgcgtaggtcgtagttaacttacgttaccgtggtacgttcggcttcccggcccgtaccggtccccgtaaggggggaaccggtcccgtagggtaaggttggtaacggtttcggtaactccgtctaacgtacgacgtggtaacgggtacacctaaccgtaacgtactacccttccccggctaagaagtaacggtactaaggtcgtatcgaacgtaaacgtaacctcgggaacttacgaaccgtacgttccgtcggaacgacgttccggtagtcggttactcggtacnccgttcggaccngaacgccgtacgccgttactcgacgttcgcgtaccggngttccgtacgtnaccggtgtgtcgtagtgcgtctcgtgtaccgttcgttacggccggttagtccgggaacgtagttcttaccggg

SEQ ID NO: 155213 - DNA, 698 bp, Homo sapiens
  misc_feature: GYAE6OF02ICK0Q.12.30.C08.1.454.CMB.1.raw
  modified_base (257)..(257): a, c, t, g, unknown or other
  misc_feature (257)..(257): n is a, c, g, or t
tcagatacgacgtacacgaccggtgctcgatttagtctgacgtcaaagggaaagggtctgtgagggcttcaccagtcctggacctcctgtgcaagaacatgaaacacctgtggttcttcctcctgctggtggcagctcccagatgggtcctgtcccaggtgcagctgcaggatcgggcccaggactggtgaagcctcacagaccctgtccctcacctgacaatcgtctcgtaggtcgcctcatcgagctagtggtanattactacgtggtagttgactccgctacgtccgagggacggcctgggagtaggtaggttcgggactagtctaatcgtaacgacggtgggaacgctaaccgtaactacgtaccgttccccgtacctaggaacgtacgttacgtaagtaccgtagtcgtaacgtaacgtaaacgtacgttaccgtaaacggtaacctaccggtttcccgtaccctaaggtacgtacgtacggtgggtaccttgggtacgtaaccgttcgacccgtacgtacgacccggtaccggtaccgttacgttaaccgtcggttcggtaccgtcggtaacgggttcggttaccgttccggacggttacccgtagggtttccgtaacggacgtaagtactaacggttcgtaccgttcgttcgtacggtaccgggttgggtaccgtaacggtcgtttaccgg

SEQ ID NO: 155214 - DNA, 119 bp, Homo sapiens
  misc_feature: GYAE6OF01EFV3M.53.81.H04.1.454.CMB.1.raw
  modified_base (107)..(119): a, c, t, g, unknown or other
  misc_feature (107)..(119): n is a, c, g, or t
tcagcgcgtatacacacgaccggtgctcgatttagtagtgtagattcgcgggggataggcctccctcgagtctacagtgctctgagcgggctggcaaggcgcatagnnnnnnnnnnnnn

SEQ ID NO: 155215 - DNA, 118 bp, Homo sapiens
  misc_feature: GYAE6OF01DA16F.53.81.H04.1.454.CMB.1.raw
  modified_base (108)..(118): a, c, t, g, unknown or other
  misc_feature (108)..(118): n is a, c, g, or t
tcagcgcgtatacacacgaccggtgctcgatttagtagtgtagattcgcggggagtggcctccctcgagtcctacagtgctctgagcgggctggcaaggcgccatagnnnnnnnnnnn

SEQ ID NO: 155216 - DNA, 106 bp, Homo sapiens
  misc_feature: GYAE6OF01CW2BX.53.81.H04.1.454.CMB.1.raw
  modified_base (106)..(106): a, c, t, g, unknown or other
  misc_feature (106)..(106): n is a, c, g, or t
tcagcgcgtatacacacgaccggtgctcgatttagtagtgtagattcgcgggggatggcctccctcgagtctacagtgctctgagcgggctggcaaggcgcatagn

SEQ ID NO: 155217 - DNA, 105 bp, Homo sapiens
  misc_feature: GYAE6OF01DKEQR.53.81.H04.1.454.CMB.1.raw
tcagcgcgtatacacacgaccggtgctcgatttagtagtgtagattcgcgggggatggcctccctcgagtctacagtgctctgagcgggctggcaaggcgcatag

SEQ ID NO: 155218 - DNA, 110 bp, Homo sapiens
  misc_feature: GYAE6OF01D77G1.53.81.H04.1.454.CMB.1.raw
  modified_base (106)..(110): a, c, t, g, unknown or other
  misc_feature (106)..(110): n is a, c, g, or t
tcagcgcgtatacacacgaccggtgctcgatttagtagtgtagattcgcgggggatggcctccctcgagtctacagtgctctgagcgggctggcaaggcgcatagnnnnn

SEQ ID NO: 155219 - DNA, 136 bp, Homo sapiens
  misc_feature: GYAE6OF01A3WOF.53.81.H04.1.454.CMB.1.raw
  modified_base (108)..(136): a, c, t, g, unknown or other
  misc_feature (108)..(136): n is a, c, g, or t
tcagcgcgtatacacacgaccggtgctcgatttagtagtgtagattcgcgggggatggccgtccctcgagtctacagtgctctgagcgggctggcaaggcgcataggnnnnnnnnnnnnnnnnnnnnnnnnnnnnn

SEQ ID NO: 155220 - DNA, 106 bp, Homo sapiens; identical to SEQ ID NO: 155216
  misc_feature: GYAE6OF01C24GF.53.81.H04.1.454.CMB.1.raw
  modified_base (106)..(106): a, c, t, g, unknown or other
  misc_feature (106)..(106): n is a, c, g, or t

SEQ ID NO: 155221 - DNA, 123 bp, Homo sapiens
  misc_feature: GYAE6OF01A273P.53.81.H04.1.454.CMB.1.raw
  modified_base (107)..(123): a, c, t, g, unknown or other
  misc_feature (107)..(123): n is a, c, g, or t
tcagcgcgtatacacacgaccggtgctcgatttagtagtgtagattcgcgggggatgggcctccctcgagtctacagtgctctgagcgggctggcaaggcgcatagnnnnnnnnnnnnnnnnn

SEQ ID NO: 155222 - DNA, 106 bp, Homo sapiens; identical to SEQ ID NO: 155216
  misc_feature: GYAE6OF01DE1A1.53.81.H04.1.454.CMB.1.raw
  modified_base (106)..(106): a, c, t, g, unknown or other
  misc_feature (106)..(106): n is a, c, g, or t

SEQ ID NO: 155223 - DNA, 163 bp, Homo sapiens
  misc_feature: GYAE6OF01BTLAD.53.81.H04.1.454.CMB.1.raw
  modified_base (108)..(163): a, c, t, g, unknown or other
  misc_feature (108)..(163): n is a, c, g, or t
tcagcgcgtatacacacgaccggtgctcgatttagtagtgtagattcgcgggggatggcctccctcgagtctacagtgctctgagcgggctggcaaggcggccatagnnnnnnnnnnnnnnnnnnnnnnnnnnnnnnnnnnnnnnnnnnnnnnnnnnnnnnnn

SEQ ID NO: 155224 - DNA, 110 bp, Homo sapiens; identical to SEQ ID NO: 155218
  misc_feature: GYAE6OF01COCM0.53.81.H04.1.454.CMB.1.raw
  modified_base (106)..(110): a, c, t, g, unknown or other
  misc_feature (106)..(110): n is a, c, g, or t

SEQ ID NO: 155225 - DNA, 106 bp, Homo sapiens; identical to SEQ ID NO: 155216
  misc_feature: GYAE6OF01EWUG9.53.81.H04.1.454.CMB.1.raw
  modified_base (106)..(106): a, c, t, g, unknown or other
  misc_feature (106)..(106): n is a, c, g, or t

SEQ ID NO: 155226 - DNA, 107 bp, Homo sapiens
  misc_feature: GYAE6OF01DZU40.53.81.H04.1.454.CMB.1.raw
  modified_base (106)..(107): a, c, t, g, unknown or other
  misc_feature (106)..(107): n is a, c, g, or t
tcagcgcgtatacacacgaccggtgctcgatttagtagtgtagattcgcgggggatggcctccctcgagtctacagtgctctgagcgggctggcaaggcgcatagnn

SEQ ID NO: 155227 - DNA, 122 bp, Homo sapiens
  misc_feature: GYAE6OF01A1HPU.53.81.H04.1.454.CMB.1.raw
  modified_base (107)..(122): a, c, t, g, unknown or other
  misc_feature (107)..(122): n is a, c, g, or t
tcagcgcgtatacacacgaccggtgctcgatttagtagtgtagattcgcgggggtatggcctccctcgagtctacagtgctctgagcgggctggcaaggcgcatagnnnnnnnnnnnnnnnn

SEQ ID NO: 155228 - DNA, 106 bp, Homo sapiens; identical to SEQ ID NO: 155216
  misc_feature: GYAE6OF01EBSCQ.53.81.H04.1.454.CMB.1.raw
  modified_base (106)..(106): a, c, t, g, unknown or other
  misc_feature (106)..(106): n is a, c, g, or t

SEQ ID NO: 155229 - DNA, 105 bp, Homo sapiens; identical to SEQ ID NO: 155217
  misc_feature: GYAE6OF01BOL27.53.81.H04.1.454.CMB.1.raw

SEQ ID NO: 155230 - DNA, 105 bp, Homo sapiens; identical to SEQ ID NO: 155217
  misc_feature: GYAE6OF01B3ZSF.53.81.H04.1.454.CMB.1.raw

SEQ ID NO: 155231 - DNA, 107 bp, Homo sapiens; identical to SEQ ID NO: 155226
  misc_feature: GYAE6OF01CCA46.53.81.H04.1.454.CMB.1.raw
  modified_base (106)..(107): a, c, t, g, unknown or other
  misc_feature (106)..(107): n is a, c, g, or t

SEQ ID NO: 155232 - DNA, 126 bp, Homo sapiens
  misc_feature: GYAE6OF01BSQUI.53.81.H04.1.454.CMB.1.raw
  modified_base (108)..(126): a, c, t, g, unknown or other
  misc_feature (108)..(126): n is a, c, g, or t
tcagcgcgtatacacacgaccggtgctcgatttagtagtgtagattcgcgggggatggcctccctcggagtctacagtgctctgagcgggctggcaaggcgcataggnnnnnnnnnnnnnnnnnnn

SEQ ID NO: 155233 - DNA, 106 bp, Homo sapiens; identical to SEQ ID NO: 155216
  misc_feature: GYAE6OF02IAWI8.53.81.H04.1.454.CMB.1.raw
  modified_base (106)..(106): a, c, t, g, unknown or other
  misc_feature (106)..(106): n is a, c, g, or t

SEQ ID NO: 155234 - DNA, 105 bp, Homo sapiens; identical to SEQ ID NO: 155217
  misc_feature: GYAE6OF02FK326.53.81.H04.1.454.CMB.1.raw

SEQ ID NO: 155235 - DNA, 107 bp, Homo sapiens; identical to SEQ ID NO: 155226
  misc_feature: GYAE6OF02JFMLZ.53.81.H04.1.454.CMB.1.raw
  modified_base (106)..(107): a, c, t, g, unknown or other
  misc_feature (106)..(107): n is a, c, g, or t

SEQ ID NO: 155236 - DNA, 105 bp, Homo sapiens; identical to SEQ ID NO: 155217
  misc_feature: GYAE6OF02HWVTT.53.81.H04.1.454.CMB.1.raw

SEQ ID NO: 155237 - DNA, 144 bp, Homo sapiens
  misc_feature: GYAE6OF02FJF6W.53.81.H04.1.454.CMB.1.raw
  modified_base (144)..(144): a, c, t, g, unknown or other
  misc_feature (144)..(144): n is a, c, g, or t
tcagcgcgtatacacacgaccggtgctcgatttagtagtgtagattcgcgggcacgaccggtgctcgatttagtagtgtagattcgcgggggatggcctccctcgagtctacagtgctctgagcgggctggcaaggcgcatagn

SEQ ID NO: 155238 - DNA, 107 bp, Homo sapiens; identical to SEQ ID NO: 155226
  misc_feature: GYAE6OF02IAHRC.53.81.H04.1.454.CMB.1.raw
  modified_base (106)..(107): a, c, t, g, unknown or other
  misc_feature (106)..(107): n is a, c, g, or t

SEQ ID NO: 155239 - DNA, 105 bp, Homo sapiens; identical to SEQ ID NO: 155217
  misc_feature: GYAE6OF02FUDPC.53.81.H04.1.454.CMB.1.raw

SEQ ID NO: 155240 - DNA, 106 bp, Homo sapiens; identical to SEQ ID NO: 155216
  misc_feature: GYAE6OF02G6GCB.53.81.H04.1.454.CMB.1.raw
  modified_base (106)..(106): a, c, t, g, unknown or other
  misc_feature (106)..(106): n is a, c, g, or t

SEQ ID NO: 155241 - DNA, 106 bp, Homo sapiens; identical to SEQ ID NO: 155216
  misc_feature: GYAE6OF02HKB4T.53.81.H04.1.454.CMB.1.raw
  modified_base (106)..(106): a, c, t, g, unknown or other
  misc_feature (106)..(106): n is a, c, g, or t

SEQ ID NO: 155242 - DNA, 105 bp, Homo sapiens; identical to SEQ ID NO: 155217
  misc_feature: GYAE6OF02GFN8D.53.81.H04.1.454.CMB.1.raw

SEQ ID NO: 155243 - DNA, 110 bp, Homo sapiens; identical to SEQ ID NO: 155218
  misc_feature: GYAE6OF02GEPA1.53.81.H04.1.454.CMB.1.raw
  modified_base (106)..(110): a, c, t, g, unknown or other
  misc_feature (106)..(110): n is a, c, g, or t

SEQ ID NO: 155244 - DNA, 108 bp, Homo sapiens
  misc_feature: GYAE6OF02H36H7.53.81.H04.1.454.CMB.1.raw
  modified_base (106)..(108): a, c, t, g, unknown or other
  misc_feature (106)..(108): n is a, c, g, or t
tcagcgcgtatacacacgaccggtgctcgatttagtagtgtagattcgcgggggatggcctccctcgagtctacagtgctctgagcgggctggcaaggcgcatagnnn

SEQ ID NO: 155245 - DNA, 537 bp, Homo sapiens
  misc_feature: GYAE6OF01DIT6G.22.11.A11.1.454.CMB.1.raw
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccagggaaggggctggagtggatctcagttatttatctcggtggtaacacatactacgcagactccgtggaggccgattcaccatctccagagacaattccaagaacacggtgtaatcttcaaaatgaacagcctgagagccgatgacacggccgtgtattactgtgtgagatcaaattccaagccgcggggtcacccaattgactactgggccagggaccctggtcaccgtctcctcacgcctccaccaagggcccactccggtccttcccccgtcggccgccctcgcctccgacgg

SEQ ID NO: 155246 - DNA, 554 bp, Homo sapiens
  misc_feature: GYAE6OF01CJ1JP.22.11.A11.1.454.CMB.1.raw
  modified_base (352)..(352): a, c, t, g, unknown or other
  misc_feature (352)..(352): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggaggccgattcaccatctccagagacaattccaagaacacggtntatcttcaaatgaacagcctgagagccgatgacacggcgtgtattactgtgtgagatacaaattccaagccgcggggtcaccaaattgactacgtcgggaccagggaaccctaggtccgaccgtcctcctcacgccctaccacccgaagggcccctacgtccggtccttcccccgtcggaccgccccgtcgccgtccgacgg

SEQ ID NO: 155247 - DNA, 574 bp, Homo sapiens
  misc_feature: GYAE6OF01CJ8KN.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttacaaaaggtgtccagtgtgaggtgcagctgggtggagacgtggaggagccttgatccagccgtggggggtccctgagactctcctgtgcagcctctgggttcaccgtcagtagcaagtacatgagcgtggggtcccgccaggcctccgaggggaagggctgggagtgggatcgtacaggtttatttatccgtcggtaggtaaacactatactacgcagactccggtggacgggccattccaccatcctaccagacgactaacttaccaagaacgacggtatatcttacaaatagaacagacctagaacgagaccgagtcgacgacggtccgtgtattactgtgtgagtatacaaacttccgaacggcccggtacggggtaccaacccgtaatacgaacgtcggtaccgggg

SEQ ID NO: 155248 - DNA, 553 bp, Homo sapiens
  misc_feature: GYAE6OF01EWMN0.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaggggctggagtggatctcagttatttatctcggtggtaacacatactacgcagactccgtggagggccgattcaccatctccagagacaattctaaagaacacggtgtatcttcaaatgaacagcctgagagccgatgacacggccgtgtattactgtgtgagatacaaattccaagccgcggggtcaacccaattgactacgtcgggccagggaaccctggtcaccgtctcctcacgccctcccaccgaacgggccccacgtccggtccttcccccgtcggcccgacccctcgccgtcccgacggg

SEQ ID NO: 155249 - DNA, 622 bp, Homo sapiens
  misc_feature: GYAE6OF01A5TKI.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagcctctgggttcaccgtcagtagcaagtacatgagcgtgggtccgcaggctccgaggggaagggctgggagtggatcgtcagtttattatcgtcggtaggtaacactactactacgcagactcgtggacggcctattcaccatcctccagacgactaattaccaagaaccgtacggtagtaactcctttaacaaaagttcgaaaacagacccgtaggaacgacggacccggatacggaaccgtaccgggtcccgttagttaacttacgtcggttaggtagaagtacttaacgaaaactttcccgaaacggtcccggggaccgggggtaacccaaccccgtaaagttccggaaccgttacgggtacccggggg

SEQ ID NO: 155250 - DNA, 758 bp, Homo sapiens
  misc_feature: GYAE6OF01DEA0A.22.11.A11.1.454.CMB.1.raw
tcagacatacgcgtcacgaccggtgctcgatttagctacgactgcgagggggggagaggagcccagcactgggattccgaggtgtttccattcggtgatcagcactgaacacagaggactcaccatggagttttggctgagtctgggttttccttgttgctatttcaaaggtgtccagtgtgaggtgcagctggtggagacgtgggaggagccttgactccgacggtccggtcggggggtccctgacgtacctctcctgtcgcacgtcctcgttcggtccaccgtcagtcgacgaagtacatcggacgtcgttcgggtccgaccgacgggtccgtaccggggaagggggaacggggtcgtggggtattgggtacttcgttcgttaagttttagtttacgtccgttacgggtaacggtaaacctacgtaacttaacgtacgacgaacggtaccgttccgggtagggtaccggtaccgtacttaccgaacctacgttccaacgaaggacgaaacttaaccgttaacgaaaacgtaccggtaacggttaattacttaccgtaaacaacgttacgaacgtaccgtcgtaggaaacggccgaacgtgtaaccgaccggtcggtcgttaagttacgttacgtggttacgaaaggtactaacgttaaaacccgttaacggtacccgaaacccggggtcccgggggtaccggtaaacccctaaaacggttaagggtccctaaaccgggttccggggtaacccgggg

SEQ ID NO: 155251 - DNA, 560 bp, Homo sapiens
  misc_feature: GYAE6OF01AHPXP.22.11.A11.1.454.CMB.1.raw
  modified_base (232)..(232): a, c, t, g, unknown or other
  misc_feature (232)..(232): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgaggggaagggctggagtggatctcagtttatttatctcggtggtaacncatactacgcagactccggtggaggccgattcaccatctccagagacaattccaagaacacggtntatcttacaaatgaacagcctagagagccgatgacacggcgtgtattactgtgtgagatactaaactaccaacgccggacggggtacaccgtaaagttcgaactacgtcgggacgacggacccgtcggtaccaccgtcctcctcacgcccaccgaccgacggccacgtccgtcccttccccgtcggccgccctcgcctccgacgg

SEQ ID NO: 155252 - DNA, 516 bp, Homo sapiens
  misc_feature: GYAE6OF01AUND2.22.11.A11.1.454.CMB.1.raw
tcagacatacgcgtcacgaccggtgctcgatttagctacgactgcaggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggtcaccgtcagtagcaagtacatgagctgggtccgccaggctccaggggaaggggctggagtggatctcagttattatctcggtggtaacacatactacgcagactccgtggaggccgattcaccatctccagagacaattccaagaacacggtgtatcttcaaatgaacagcctgagagccgatgacacggccgtgtattactgtgtgagatacaaaattccaagccgacggggtcacccaaattcgactcgtacgggg

SEQ ID NO: 155253 - DNA, 720 bp, Homo sapiens
  misc_feature: GYAE6OF01CC03I.22.11.A11.1.454.CMB.1.raw
  modified_base (211)..(211): a, c, t, g, unknown or other
  misc_feature (211)..(211): n is a, c, g, or t
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
tcagacatacgcgtcacgaccggtgctcgatttagctacgactgcagggtgtacacctgtggttctcggggctgccctgtagggacagaggttggcacagcggtcactcccgagggcagagggtgggccgagccggcctctgtccatgtcggccctcactaccccgcgggtccctgacgactctcctgtgcagcctcgtgggttcaccgtnagtagcaagtcatgagctgggtccncaggcctcgagggagggctggagtggatcgtcagtttattancgtcggtagtaacacatactacgctagactccggtggacgggcctattccaccattcaccaagacgaactaattcccaaagaactacgggtatactccgttaacaaagttcgaaacctgtcctaggaacggacgtacccgaattacggaacgaccgggtaccgttaggttaacgtttaaccgttggttaggtaggtaacgtaacttaacgtaaaacgttccggaaacggcccggtaccgggggtaaccctaacccgtaaacgttacggtaaccgtaacggtccggggaaccgtaaccgggtaacccgtacggtaccgtaccgtcccgttccctaccgaccgtacccgtacccgaaccggaaccgggccccgtaacggttccccggttaccccttacccccggtccgggtacccgtaccccgtcgtcccgtcccggaaccggg

SEQ ID NO: 155254 - DNA, 728 bp, Homo sapiens
  misc_feature: GYAE6OF01DFGAX.22.11.A11.1.454.CMB.1.raw
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactaccccgcgggtccctgagactctcctgtgcagcctctgggttcaccgtcagtagcaagtacatgagctgggtccgccaggctccgagggaaggggctgggagtggatctcagttatttatcgtcggtggtaacanatactacggcagactccgtggacggccattcaccatctccagacgacaattccaagaacacggtntactcttacaaatcgaaacacgtcctagaaggacgaccgtagtacgaccgaaccgggtaccgttacgttaactttacgttaggttaggtaggtaaggtaacttaaccgtaaaaacgttacccgtaaacgggcccgggtaccggggggtaccctaacccgtaaagttacggtaaccgtaaccggtcggggaccccgtaacgggtaaacccgttcgggtacccgtacccgtacccgttacccgaccgtaccggtacccctacccgaaccccgtaaaccggggaccccctaaccggtttccccgggttaccccgtttccccccccggtcgggtacccccgtacccccgtccggtcccgtccccgtaaccgggg

SEQ ID NO: 155255 - DNA, 560 bp, Homo sapiens
  misc_feature: GYAE6OF01AJ6KH.22.11.A11.1.454.CMB.1.raw
  modified_base (518)..(518): a, c, t, g, unknown or other
  misc_feature (518)..(518): n is a, c, g, or t
  modified_base (542)..(542): a, c, t, g, unknown or other
  misc_feature (542)..(542): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgagggaaggggctgggagtggatctcagttatttatctcggtggtaacacatactacgcagacctccgtggaggccgattcaccatcctccagagacaattccaagaacacggtgtatcttacaaatgaacagcctgagagccgatcgacacggccgtgtattactgtgtagagtatacaaaattccaagccggcggggtaccaccaaattcgaactacgtcgggaccgagggaccctggtaccaccgtctcctcacgcctccgaccgaacggcccnctccggtcccttccccgtcggccncccgtcgccgtccgacgg

SEQ ID NO: 155256 - DNA, 731 bp, Homo sapiens
  misc_feature: GYAE6OF01EUD2B.22.11.A11.1.454.CMB.1.raw
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgaggggagggctggagtggatctctagtttattatcgtcggtagtaacacatactacgcagactccggtgggacggcctattccacctatctccgaagacgaactaacttcccaaagaacctacgggttataacttccttaacaaaatcgaaactacgtacccgtaggaacgacgcccgtaagtacggaaccgaccggtaccgtagttaacttacgtgtagtagaagtaactaactaaaacttaccgaacggccggtaccggggtaccaacccgtaagttacgaaccgttaacggtacggggacccgtaaccgggtaacccgttacggtacccgtacccgttccgtacccgtaccgtaccgtcccccgtaccccgtaaacccggtaacccgggtaccccctaaccggttccccgggttacccccgtttacccccccggtccgggtacccccgtacccccgttcccggtccccgtaccccggtaaaccggg

SEQ ID NO: 155257 - DNA, 667 bp, Homo sapiens
  misc_feature: GYAE6OF01CRNWW.22.11.A11.1.454.CMB.1.raw
  modified_base (388)..(388): a, c, t, g, unknown or other
  misc_feature (388)..(388): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtggaggtgcagctggtggagactgggaggagccttggactccaggtccgtcggggggtacctggaagctctcctgtgcagcctcgtgggttccacggtcaagtagacaagtacagtgagcgtcgggtccgcgagccaccggagggaagggcgtaggagtaggactctacgtagtttattaagtcgtacggtagtaaacacattacgacncagtctacggtgggaggacctaagttcaacctacgtcctacgacgtaacgaactaattaccgaaaagtaaccgacggttagtaacttacgttaacaaaattacgaacagtcctaggaagacggccagtacgaacgaccgggtactaggtaacttacgtagtacggtagaagtaacgttaaacgtaaaaccgttcgaaacccgggaccccgggttaacggggtaacccctaaacccggtaaaacgtttacccgggtaaacgttacggtaaccccgggggg

SEQ ID NO: 155258 - DNA, 589 bp, Homo sapiens
  misc_feature: GYAE6OF01ET765.22.11.A11.1.454.CMB.1.raw
  modified_base (233)..(233): a, c, t, g, unknown or other
  misc_feature (233)..(233): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccnccaggctccgaggggagggctggagtggatctcagttattatctcggtggtaacacatactacgcagactccgtggacggccgattcaccatctccagagaacaattaccaagaacacggttagtattcttacaaaatcgaacagcctgagagccgtatgacgacgccgtgtattacgtgtgtagtagatacaaattccaagccggcgggtaccaacctaagttcgaacgtacgtcgggaccgtacggaacccgtggtcctaccgtcctaccgtccgacgccctaccgaccgaacggccccacgtcccggtcccttcccccgtcggcccgtccccgtcgtcccgtccgtaaccggg

SEQ ID NO: 155259 - DNA, 762 bp, Homo sapiens
  misc_feature: GYAE6OF01DBPJB.22.11.A11.1.454.CMB.1.raw
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcacgtctggtcgtaccncntagacgananacagagcgtcggtccggtccgacggacggtcccgacggggaagggggacgggtcggtagggtagggtaggtacttacgtagttaacgttttatttacgtcgggttacggttaacgtaacctaacttaacgttaaccgtaaccgtacgaaccgttacccggtacgggtacggggacccggtaccgtttactacccgaaccttaccgttacccgacgaaaggaacctaaacttaacccgtaaaccgaaacgaaccggtttagtaacgtttaccttactaaagtaacgtaaccgaacgccgttacggaaggaaccggaccggaccgtaagtaccgaaccgggtacccggttacgttatttaacggttacgttggtaaggtaacgaacttaaacgaaaacgtttaacggaaccggtacccgggtccgggggtaaccgtaaaccctaaaacggtttgtaacccgtaccgggttacggggtaaccccgggg

SEQ ID NO: 155260 - DNA, 604 bp, Homo sapiens
  misc_feature: GYAE6OF01BLSFG.22.11.A11.1.454.CMB.1.raw
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcgggtccctgagactctcctgtgcagcctctgggttcaccgtcagtagcaagtacatgagctgggtccgccaggctccgagggaagggctggagtggatctcagtttatttatctcggtagtaacacatactacgcagactccgtggaggccattcaccatctccaganacaattccaagaacacggtntatctcaaatgaacagtcctagagacgccgaatgacacggccgtagtacttactgtgtgagtatacaaaacttccaacgccgcggggtaccaaccgtaaagttacgaaccgtaacgtacgggaccgtaacgggaaccctaggtacccgaaccgtcctcctccgacgtcccgtacccaccgtaaacgggccccaacgtcccggttacccttccccccgtcgggacccgtccccgtcgtcccgtccgtaaccggg

SEQ ID NO: 155261 - DNA, 887 bp, Homo sapiens
  misc_feature: GYAE6OF01CAJMY.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagcgtgggtggagacgtgggaggagccttgatccgaggccgtggggggtccctggagactcctcctgtgcagccgtctgggtcaccgtcagtagcaagtacagtgagtcgtcgggtcccgccgaggcctaccggaggggaaggggcgtagggagttgggacttcgtacgtaaggtttaactttagtaccgtcgggttaacggtaaactacgtaatttaaccgaaccggtaccgaacggttaccggttacccgggttaggggaaaccggggtcccgtaactttcccgaaccgtaccgttacccgtacccgtaacggaaccgtaaaccttaaaacgtttaacccgaaaacggtaaacccgttaacggggttaccgttaaacgtttacctttaaacccgtaaaaagttaccggaaaaccgtaacggtaccccggtttaagggaaaccgggtaaaccgggaccccggttaaacgtaccgggtaaacccggtaacccgggggttaccccggttaaggtttaaacgttttacccgggttacggttaagggttaacgggaacgttaaaccggtaaacgttaaaaacccggttacccggtaaacccgggtaccccgggggttaaccgggggttaaaccccctaaaccccggttaaaacggtttaccgggttaaacccgggttaacccggggtttaaaccccgggggg

SEQ ID NO: 155262 - DNA, 561 bp, Homo sapiens
  misc_feature: GYAE6OF01BI7JJ.22.11.A11.1.454.CMB.1.raw
  modified_base (254)..(254): a, c, t, g, unknown or other
  misc_feature (254)..(254): n is a, c, g, or t
  modified_base (440)..(440): a, c, t, g, unknown or other
  misc_feature (440)..(440): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctntgggttcaccgtcagtagcaagtacatgagcgtgggtccgccaggctccgaggggaaggggctgggagtggatctctagtttattatcgtcggtggtaacactatacctacgcagactccggtggaggccattcacctatctccagagacaattccaagaacacggtatactactacaatagaacngacctgacgagccgagtcgactaccggacgttagtattacgtggtgtagagactaactaaacgttccgaacggtcccggacggggtaccaaccctaaagttcgaacgttacggtaccgggg

SEQ ID NO: 155263 - DNA, 691 bp, Homo sapiens
  misc_feature: GYAE6OF01EH52M.22.11.A11.1.454.CMB.1.raw
  modified_base (231)..(231): a, c, t, g, unknown or other
  misc_feature (231)..(231): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcgggtccctgagactctcctgtgcagcctctgggttcaccgtcagtagcaagtacatgagctgggtccncaggctcgagggagggctggagtggatctcagttattatcgtggtagtaacatatactacgcagactccgtggacggcctattccaaccatcctaccaagacgaactaacttacccgaaagaacctacgggttataacttcttaaacaaaagttcgaaacctagtccctaggaacgtacgacccgtaagtcggaaccgtaccggtaccgttagttaacttaacgtgtagtacgaagtaactaacgtaaaacgttacccgaacggtacccgggtaccggggtaccaacccgtaaagttacgtaaccgtaaccggtacgggtacccgtaaccgggtaacccgtcggtacctacccgtccgtcctaccgaccgtacccgtacccgaacccgtaaccgggcccctacgttcccggtaccccttacccccgtcggccccgtcccgtcgtcccgtccgtaaccggg

SEQ ID NO: 155264 - DNA, 563 bp, Homo sapiens
  misc_feature: GYAE6OF01A5FA6.22.11.A11.1.454.CMB.1.raw
tcagacatacgcgtcacgaccggtgctcgatttagctacgactgcagggtgtacacctgtggttctcggggctgccctgtagggacagaggttgacacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgaggggaaggggctggagtggatctcagttatttatctcggtggtaacacatactacgcagactccgtggagggccgattcaccatctcagagacaattccaagaacacggtgtatcttacaaatgaacagcctagagagccgatcgacgacggcgtgtattactgtgtagagatacaaacttccgaagccgcggggtacaccaattgactacgtcgggccgacgggacctcggtacaccgtctcctcgacgccctaccgaccgtacgggaccctacgttccggtcccttcccccgtcggcccgtccctcgccgtccgacgg

SEQ ID NO: 155265 - DNA, 609 bp, Homo sapiens
  misc_feature: GYAE6OF01A8EDG.22.11.A11.1.454.CMB.1.raw
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggcctccgagggagggctggagtggatctctagtttattatcgtcggtagtaacacatactacgcagactccggtggacgggccattccacctagtcctccaagacgactaattcccaaagaactacggtgtatcttacaaatgaacagcctaggagacgccgatacgacgaccggtcgtagtacttacgtgtgtagagatactaaattccaacgccggacggggtacaaccgtaattcgaactacgtcgggaccgtaacgggacccgtcggtcctaccgtcctaccgtccacgtcccgtaccgaacccgtaaccggccctcgtacccgtcccgttcccccgtcggcccgtacccgtcgtcccgtccggaccgg

SEQ ID NO: 155266 - DNA, 575 bp, Homo sapiens
  misc_feature: GYAE6OF01EGWJQ.22.11.A11.1.454.CMB.1.raw
  modified_base (349)..(349): a, c, t, g, unknown or other
  misc_feature (349)..(349): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgagggagggctggagtggatctcagttatttatcgtcggtggtaacacatactacgcagactccggtggagggccgattcaccatctccagagacaattccaagaacncggtatatcttacaaatgaacagcctgagacgccgatcgacgacggccgtagtattacgtgtgtgagatactaaattaccaagccggcggggtacaaccctaattgaactacgcgggaccacgggaacctcggtcacccgtcctcctcacgtccctacccgacccgaacgggccccagtcccggttcccttcccccgtcgggcccgcccgtccgtccgtccgacgg

SEQ ID NO: 155267 - DNA, 642 bp, Homo sapiens
  misc_feature: GYAE6OF01CZ5AF.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggcccctcactacccccgcgggtccctgagactctcctgtgcagcctcgtgggttcaccgtcagtagcaagtacatgagctgggtccgccaggctccgagggagggctggagtggatctcagtttatttatcgtcggtaggtaacacatactaccgcagacctccggtggacgggcccgaattccaccagttacctccgaagagaacaattcccaaagactacggtgtaactcttacaaaatcgaaacacgccgtagacgagcccgagtgacgacggccgtagttattactgtgtagagtatacaaatccgaagccggacggggtacaaccctaaagttcgaacgttaccgtacgggtacccgaacgggacccgttcggtaccgaccgttacctcccgtaccgaccgtcccgtacccgaacccgaacgggacccctacgtcccggttcccgttcccccgtcgggtccccgtccctccggccgtcccggtaacggg

SEQ ID NO: 155268 - DNA, 556 bp, Homo sapiens
  misc_feature: GYAE6OF01ER74I.22.11.A11.1.454.CMB.1.raw
  modified_base (355)..(355): a, c, t, g, unknown or other
  misc_feature (355)..(355): n is a, c, g, or t
  modified_base (512)..(512): a, c, t, g, unknown or other
  misc_feature (512)..(512): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggcctccgaggggaaggggctgggagtggatctcagttattatctcggtgtaacacatactacgcagactccgtggaggccgattccaccatctccagagacaattccaagaacacggtntatcttacaaatgaacagcctgagagccgatgacacggcgtgtatactgtgtgagatacaaattccaagccggcggggtacaacccgaattcgactacgtcgggaccgacgggacccgtggtccaccgtctcctcacgccctccgaccgaaggcccncgtccggtcccttcccccgtcggccgcccgtcgccgtccgacgg

SEQ ID NO: 155269 - DNA, 605 bp, Homo sapiens
  misc_feature: GYAE6OF01DGKYU.22.11.A11.1.454.CMB.1.raw
  modified_base (233)..(233): a, c, t, g, unknown or other
  misc_feature (233)..(233): n is a, c, g, or t
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccnccaggcctccgaggggagggctggagtggatctcagtttatttancgtcggtgtaacncatactacgcagactccggtggaggcccgattcaccatctccagacgaacaattccaaagactacgggtntatccttacaaatgaacngcctgagagccgatgacgacggccgtagtattacgtgtgtagagtatactaaacttaccgaacggcccggcggggtaccaacccgtaagttacgtacctacgtacggggaccgacgggtaacccgtcggtaccgtaccgttcgtccctcgtaccgcccgtacccgaccgaacgggccctaccgtccggtcccttcccccgtcggcccgccctcgccgtccgaacgg

SEQ ID NO: 155270 - DNA, 620 bp, Homo sapiens
  misc_feature: GYAE6OF01DIP3I.22.11.A11.1.454.CMB.1.raw
  modified_base (231)..(231): a, c, t, g, unknown or other
  misc_feature (231)..(231): n is a, c, g, or t
  modified_base (561)..(561): a, c, t, g, unknown or other
  misc_feature (561)..(561): n is a, c, g, or t
  modified_base (582)..(582): a, c, t, g, unknown or other
  misc_feature (582)..(582): n is a, c, g, or t
  modified_base (604)..(604): a, c, t, g, unknown or other
  misc_feature (604)..(604): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcataccccgcgggtccctgagactctcctgtgcagcctctgggttcaccgtcagtagcaagtacatgagctgggtccnccaggctccgaggggaaggggctggagtggatctcagttatttatcgtcggtaggtaacacattactacgcaaggtacctccggtgggacgggcccgtattccacctagtcctaccgaagacgaactaaacgttccaaagaacctacgggttgtaacttcctttaacaaaagttcgaaactagcctaggagacgcccgaatcgaacgaccgggacgttagtattacgtgtagtagaagataactaaacttaccgaacgccggacggggtaccaacctaatcgaacgtacgtcgggaccgacgggtaaccctggtaccaccgtcctcctcncgcctacccgaccgacggccncgtccgtccttccccgtcgccncccgtcgcctcgacgg

SEQ ID NO: 155271 - DNA, 619 bp, Homo sapiens
  misc_feature: GYAE6OF01CARA1.22.11.A11.1.454.CMB.1.raw
  modified_base (376)..(376): a, c, t, g, unknown or other
  misc_feature (376)..(376): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttccaccgtcagtagcaagtacatgagcgtgggtccgccaggcctccgaggggaaggggctggagtggatctcagtttatttatcgtcggtagtaacacatactacgcagactccggtggacgggcctattccaacctatcctaccaagacgaactaacttaccaaagaactacgggtntactaccttacaaaagtcgaaacacgacctagagacgccgagtcgaacgacggtccgtagtattacgtgtagtagagtatactaaacttcgaacgccggcgggtaccaacctaaagtcgaacgtacggtacgggaccgtaacgggaccctggtacctaccgtcctcctacgaccgccctaccgaaccgaccgggaccctcgttccggtcccttccccgcggtcccaccctcgcccgtcgacgg

SEQ ID NO: 155272 - DNA, 578 bp, Homo sapiens
  misc_feature: GYAE6OF01B3K2D.22.11.A11.1.454.CMB.1.raw
  modified_base (232)..(232): a, c, t, g, unknown or other
  misc_feature (232)..(232): n is a, c, g, or t
  modified_base (353)..(353): a, c, t, g, unknown or other
  misc_feature (353)..(353): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggagggctggagtggatctcagttatttatctcggtgtaacacatactacgcagactccggtggacggccgattccaccatctccagagacaattccaaagacacggtntatcttacaaatgaacagcctgagacgccgatcgacgacggcgtagtattactgtgtgagactacaaacttccgaacgccggacggggtaccaacccgtaaattgaaccgtacgtcggggaccgtacgggtaacccgtcggtaccaccgtctcctcacgtcccacccgaccgacggcccacgtcccggtcccttccccgtcggcccgcccgtcgccgtccgacgg

SEQ ID NO: 155273 - DNA, 670 bp, Homo sapiens
  misc_feature: GYAE6OF01ESBDF.22.11.A11.1.454.CMB.1.raw
  modified_base (162)..(162): a, c, t, g, unknown or other
  misc_feature (162)..(162): n is a, c, g, or t
  modified_base (290)..(290): a, c, t, g, unknown or other
  misc_feature (290)..(290): n is a, c, g, or t
  modified_base (401)..(401): a, c, t, g, unknown or other
  misc_feature (401)..(401): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagcgtggtttcgtgtagctattanaaaggtgtcagtgtgaggtgcagctggtggagactggagagccttgatccagcctggggggtccctgagactctcctgtgcagcctcgtggttcaccggtcagtagcaagtacatgagcgtgggtccnccgaggtcgtaccgaggggaaggggctgggagtggacttcgtctaaggtttacttttatccgttggtacggttaacaacctataaccgtacggacaacggaccttccgggnggacggggtacctagtttaccaacctactaccttacccgaaggacgaactaaacgttaccgaaacgtaaccgtacggtcgtttacttactttaacaaattacgaaacgtacgacccgttagaacggacggtacccggtagacgtaccggtaccggaccgttaggttaagttacgtggttacgagtaagtactaacgtaaaacgttaccggaacgtaccgggtaccggggtaaccaacccgttaaagtcgtaacgacgggttacccgggg

SEQ ID NO: 155274 - DNA, 776 bp, Homo sapiens
  misc_feature: GYAE6OF01CPEH2.22.11.A11.1.454.CMB.1.raw
  modified_base (233)..(233): a, c, t, g, unknown or other
  misc_feature (233)..(233): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcactaccccgcgggtccctgacgactctcctgtgcagcctctgggttcaccgtcagtagcaagtacatgagcgtgggtccncaggcctccgagggagggctggagtggattctacgtagtttatttagtcgtacggtagtaacactactactacgcagtacctccggtggacgggccattccacctatcctaccgaagacgaactaaacgttccgaaagtaacctacgggttattaacttacctttaacaaaaagttcgaaaacctacgtacccgttaggaaacggtacggacccgtaagttaccggaaccgtaaccgggtacccgttaggtttaacgtttaaccgttaggttacgtaaggtaaacgtaacgttaacctaaaacgtttacccgaaacgggtacccggtaccggggtaaccctaacccgtaaagttacggaaccgttacggtaccgggtacccggtaacgggtaacccgtcggtaccctaccgtcctacccgtaccgaccgtacccgtacccgaacccggtaaccgggtacccctaccggttccccggttaccccgttaccccccggttcggttaccccggtccccgttacccggtcccgtacccggtaaccggg

SEQ ID NO: 155275 - DNA, 801 bp, Homo sapiens
  misc_feature: GYAE6OF01DYRJX.22.11.A11.1.454.CMB.1.raw
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcgggtccctgagactctctgtgcagcctntgggttcaccgtnagtagcaagtacatgagtcgtggtccgcaggctccgagggagggctggagtggatctactagttatttatcgtcggtagtaaacacgtatacgtacgcaacgacgttccggtggacgggccgtattccgacctagtcctaccaagaacgaactaaacgttacccgaaaaggtaaaccgtacgggttagttaacttccgtttaaacaaaacgttcggaaaacctacggtacccgttagggaacggtaacggcccgtaaagttacggaaccgaaccgggtacccgttaggttaacgtttaacgtggttacgttaggaacgtaaacttaacgttaaaaacgtttacccgaaacggtaccccgggtaccgggggttaaccctaaacccgtaaagtttaccgtaaccgttaaccggtaccggggacccgtaaaccggggtaaccccgttacgggtaccctaacccggttcctacccgttaccgaccgtaccccgtacccgtaacccggtaacccgggacccctaccggtttacccggttacccccgtttaccccccggtacgggtccccgtacccggttccgtcccgtacccggtaaccggg

SEQ ID NO: 155276 - DNA, 586 bp, Homo sapiens
  misc_feature: GYAE6OF01A79J4.22.11.A11.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (361)..(361): a, c, t, g, unknown or other
  misc_feature (361)..(361): n is a, c, g, or t
tcagacatacgcgtcacgaccggtgctcgatttagctacgactgcagggtgtacacctgtggttctcgggctgccctgtagggacagaggttggcacagcggtcactcccagggcagagggtgggccgagccggctctgtccatgtggccctcagtaccccgcgggtccctgagactctcctgtgcagcctctgggttcaccgtnagtagcaagtcatgagctgggtccncaggctccgagggaagggctggagtggatcgtctagttattatcgtcggtagtaacacatactacgctagactccgtggacggcctattcaccattccgcaagtacgactaacttccgaaagaaccaggtntatcgttacaaatcgaacacgctagagagccgtatcgacgacggcgtagtacttacgtgtgtagagtatactaaattcgaacgcgacgggtacaacgtaatcgtaacgtacgtacggaccgacggtaacccgtggtaccaccgtctcctacaccgtacctacccgacgaaccggcccacgtcccgtcccttaccccgtcggaccctacccgctccgtccgaacgg

SEQ ID NO: 155277 - DNA, 617 bp, Homo sapiens
  misc_feature: GYAE6OF01DKORD.22.11.A11.1.454.CMB.1.raw
  modified_base (232)..(232): a, c, t, g, unknown or other
  misc_feature (232)..(232): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccncaggctccgagggagggctggagtgatctcagttatttatcgtcggtagtaacacatactacgcagactcgtggaggccgatcacntctcagnacatccaagacacggtntatctacaaatgaacagcctagagacgccgatcgacgacggccgttagtattacgtgtgtagagactactaaattaccgaacggcccggtacggggtaccaacccgtaaagttacgaaccgtacggtaccggggaccgaacggggtaacccgttcgggtaccgtacccgttcctacccgtacgaccgtccctacccgaacccgaacgggcccctacgttcccggtccctttaccccccggtcggtccccgtccccgtcgcccgttccgaaccggg

SEQ ID NO: 155278 - DNA, 578 bp, Homo sapiens
  misc_feature: GYAE6OF01C7FD5.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccctgagactctcctgtgcagctctgggttccaccgtcagtagcaagtacatgagcgtgggtccgccaggcctccgaggggaagggctgggagtggatctctagttattatcgtcggtaggtaacacatacctacgcagtacctccggtaggacgggccgattccaccatcctaccagagactaacttaccaaagaaccgacggtatatacttacaaatagaacacgcctgaagacgaccgatcgacgacggtccgtagttacttacgttgtgtagagtataactaaattcccgaacggcccgggacggggtacccaacccgtaattacggacgttacggtaccgggg

SEQ ID NO: 155279 - DNA, 565 bp, Homo sapiens
  misc_feature: GYAE6OF01AGYMJ.22.11.A11.1.454.CMB.1.raw
  modified_base (232)..(232): a, c, t, g, unknown or other
  misc_feature (232)..(232): n is a, c, g, or t
  modified_base (357)..(357): a, c, t, g, unknown or other
  misc_feature (357)..(357): n is a, c, g, or t
  modified_base (547)..(547): a, c, t, g, unknown or other
  misc_feature (547)..(547): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggcctccgaggggaagggctggagtggatctcagttatttatctcggtggtaacacatactacgcagactccgtggacgggccgattcaccatcctccagagacaattccaagaacacggtntatcttacaaatgaacagcctgagagccgaatcgacacggccgtgtattactgtgtgagatactaaattccgaagccggcggggtacaacccgaaattcgactacgtcgggaccacgggaaccctggtaccaccgtcctcctcacgcctccgaccgacggccctacgtccgtacctccccgtcggacccncccgtcgccgtccgacgg

SEQ ID NO: 155280 - DNA, 655 bp, Homo sapiens
  misc_feature: GYAE6OF01CBGUK.22.11.A11.1.454.CMB.1.raw
  modified_base (231)..(231): a, c, t, g, unknown or other
  misc_feature (231)..(231): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcgggtccctgagactctcctgtgcagcctctgggttcaccgtcagtagcaagtacatgagctgggtccnccaggctccgagggagggctggagtgatctcagttatttatctcggtggtaacacgatactaccgcagacctccggtggagggcccgatttccaccagttcctccgagacgacaattccaaagtaacacggtgtaactcttacaaatcgaaacacgccgtaggaacgacggacccgtaatacggaaccgacgggtcccgtagttaacttaacgtgtcgtagaagtactactaaaacgttccgaaagcccggtacggggtaccaaccgaaattcgaacgtacggtagggaccctacgggtaaccctcgtaactccgaaccggttcctacccgtacgacgtcccttacccgaacccggaaccggcccctaacgttcccggttacccgttcccccgtcgggacccgccccgtcgtcccgtaccccgg

SEQ ID NO: 155281 - DNA, 631 bp, Homo sapiens
  misc_feature: GYAE6OF01AFK27.22.11.A11.1.454.CMB.1.raw
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
  modified_base (276)..(276): a, c, t, g, unknown or other
  misc_feature (276)..(276): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcataccccgcgggtccctgagactctcctgtgcagcctctgggttccaccgtnagtagcaagtacatgagctgggtccnccaggcctccgaggggagggctggagtggatctcagttatttanctggtggtaacacatactacgcagtacctccgtaggacgggccgattcaccatcctccagagacaattccgaagaactacggtgtactactttacaaagttcgaacagaccctagtaggacgacccgagttacgacgacggaccgtagtacttacgttagtgtagagtatactaaacgttaccaacgtccggaccggggtacaccgtaatacgacgtacgtacgggaccgtacggaacccgtacggtaccgtaccgtcctccgtactacgtacccgtacccgaccgaaccggcccgtaccgttccgtcccgttacccccgtcggtacccgccccgtcggccgtcccggtaaccgg

SEQ ID NO: 155282 - DNA, 628 bp, Homo sapiens
  misc_feature: GYAE6OF01B7W9G.22.11.A11.1.454.CMB.1.raw
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgaggggagggctggagtggatctcagtttatttatcttcggtagtaacacatactacgcagacctccggtggacggccctattccacatctaccagagacaatccaaagaacacggtntatcttanaaancgaacagcctagagagccgatcgacgacggcgtgtatacgtgtgtagagatactaaataccgaacgccggcggggtaccaaccgtaaacgttacgtaacgtacggtcgggaccgtaaccgggtaacccgttcggtacccgtaccgtcctacccgtacgaccgtaccctacccgaacccgaacggaccccgtaccgttcccggttaccccgttcccccgtcggaccccgtccccgtccgtcccgtacccggtaccggg

SEQ ID NO: 155283 - DNA, 793 bp, Homo sapiens
  misc_feature: GYAE6OF01CWV1N.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagactggaggagccttgatccagccgtggggggtccctgacgactctcctgtgcagcctcgttcgggttccaccgtcagtagacaagtacagtgagcgtcgggtcccgccgaggcctaccggaggggaaggggcgtgggagtggaatcgtactagtttatttacgtcgttacggtacgtaaacactaacttaaccgtacgacgaacgtacccgtccgggtagggacgggcccgtaattaccgacctaacttcccgtaccgaagtaacgtaaacctaaacttaacccgaaaagtaaaccgacgggtttacttaactttaccgttaacaaacgttacgaaaaccgtacgtacccgtaggaaaccggaacgtacccggtaacgtacggaacccggtaacccgggttaccggttacgttaaacgtttaacggttacggttagggttacggtaaacggtaaaacttaacccgtaaaaaacggtttccccggaaaaccggggttacccccggggttaacccggggggttaaccctaaaaacccccggttaaaaggtttaacccggtaaacccgggtttaacccggggtaaaccccggggggg

SEQ ID NO: 155284 - DNA, 674 bp, Homo sapiens
  misc_feature: GYAE6OF01EGXDL.22.11.A11.1.454.CMB.1.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (384)..(384): a, c, t, g, unknown or other
  misc_feature (384)..(384): n is a, c, g, or t
tcagacatacgcgtcacgaccggtgctcgatttagctacgactgcagggtgtacacctgtggttctcggggctgccctgtagggacagaggttggcacagcggtccactccccagggcaggagggtgggccgagccggcctctgtccatgtcggccctcatacccccgcgggtccctgagacctctcctgtgcagcctgtgggtccaccgtcagtagcaagtacatgacgcgtgggtcccgccgaggcctccgaggggagggctggagtggatcgtacgtagtttatttancgttcgggtagtaacnctatactacgcagcgtccgngggacggccgtattcaccatcctcaagaacgctaaacgttaccaagaaccgaggttntaacttcgttaacaaattcggaaaccacgtccagaggaacgccgtatacgacgacgggtccgttagtacttacgtgttagaggaatactaacgtaaacttaccgaacggtacccgggtacggggtaaccaacccgtaagtacgaccgttaacggcgggtaccgtaaccggacccgtcggtacctaccgtcctacccgtccgtaccgcccgaccgtaacccggaacggtaccctccgtcccggttccccgttacccccgtcggcccgtaccccgtcgtccgtccggaacgg

SEQ ID NO: 155285 - DNA, 721 bp, Homo sapiens
  misc_feature: GYAE6OF01C5XG7.22.11.A11.1.454.CMB.1.raw
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtcggccctcactaccccgcgggtccctgagactctcctgtgcagcctcgtgggttcaccgtnagtagcaagtacatgagcgtgggtccncaggctccgagggagggctggagtgatcgtctagtttatttatcgtggtagtaacactatactacgcaagactcggnggacggcctatcacatctacagacactaatcaagactacggtatactcttacaaatcgaacacgcctagacgacgccgaagttcgaacgaccggtccgttagttaacttacgtagttagtagtaacgtataaccgtaaaacttaccccgaaacggcccgggtaaccggggtaccctaaacccgttaaagtttacggtaaaccgtaccggtacgggggtaacccgtaaccgggtaacccgttacgggtacccgtacccgttccgttacccgtaccgacccgtccccgtaaccccgtaaaccccggaaccggggtacccccttaccggttccccggttaccccccgtttccccccggtaccgggtacccccgtaccccgttcccggccccgttacccggtaaacccgggg

SEQ ID NO: 155286 - DNA, 549 bp, Homo sapiens
  misc_feature: GYAE6OF01AOOGA.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggaggccgattcaccatctcagagacaattccaagaacacggtgtatcttcaaatgaacagcctgagagccgatgacacggccgtgtattactgtgtgagatcaaattccaacgccgcggggtcaccaattgactacgtgggccagggaccctggtccaccgtctccctcacgccctccgacccgaacgggcccacgtcccggtccttccccccgtcggccgcccctcgtccgtcccgacgg

SEQ ID NO: 155287 - DNA, 620 bp, Homo sapiens
  misc_feature: GYAE6OF01A6VEA.22.11.A11.1.454.CMB.1.raw
  modified_base (336)..(336): a, c, t, g, unknown or other
  misc_feature (336)..(336): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (423)..(423): a, c, t, g, unknown or other
  misc_feature (423)..(423): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtgccctcataccccgcggtccctgagactctcctgtgcagcctctgggttcaccgtcagtagcaagtacatgagcgtgggtcccgccaggcctccgaggggaagggctggagtggatctcagtttattatcgtcggtaggtaacacatactacgcaagacgtccggtgggacggccgtattccaccatcnccagacgaatatccaagacacgtagtatctanaaagtgaaacngcctagaagagccatcgacgacgcgtagtattactgtagtaganatactaaacttaccgaacgccggtacgggtaccaaccgtaattcgaacgtacggtcgggaccgtaacgggaacccgttcgtaccgtaccgtacctcctacgaccgtacccgtacccgacccgtaaccggtaccccgtacgtcccggttaccccgttcccccgtaccggcccgtccccgtcgtcccgtccggacccgg

SEQ ID NO: 155288 - DNA, 591 bp, Homo sapiens
  misc_feature: GYAE6OF01C860K.22.11.A11.1.454.CMB.1.raw
  modified_base (154)..(154): a, c, t, g, unknown or other
  misc_feature (154)..(154): n is a, c, g, or t
  modified_base (234)..(234): a, c, t, g, unknown or other
  misc_feature (234)..(234): n is a, c, g, or t
  modified_base (278)..(278): a, c, t, g, unknown or other
  misc_feature (278)..(278): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctnactaccccgcgggtccctgagactctcctgtgcagccctcgtgggttccaccgtcagtagcaagtcatgagctgggtccnccaggctccgaggggagggctggagtggatctctagttatttanctcggtagtaacacatactacgcagtactcgnggacggccattccacatctccagcacatccaagacgacggtntatcttacaatcgaacnggcctgagngaccgatgacacggccgtatattacgtgtgtgagactacaaattccgaacgccggaccggggtaccaacccgtaaattcgaacgtacggtacgggaccgtacggtacccgtcggtacctaccgtccgtcctccgacgccctacccgaaccgaacgggcccctacgtcccggttcccttcccccgtcggtcccgtcccgttccgctccgtacgg

SEQ ID NO: 155289 - DNA, 644 bp, Homo sapiens
  misc_feature: GYAE6OF01AEGPO.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgtgggttcaccgtcagtagcaagtacatggagcgtcgggtcccgccgaggcctccgaggggacggggctgggagtggatcgtcgtagtttattagtcgtcggtagtaaaccactacttacgtacgctagaccgtccggtagggacgggccgtattccacctactcctaccgaagacgaactaacttaccgaaacgaacgtacggttagtaacttacttaactaaatacgaacagtacccgtagacgacgccgtagtacgaccgtacgggtaccgttagttaacgttacgtggttagtacgaagtaactaactaaaacggtccgaaaccgggtcccgggaccggggttaacccaacccgtaaagttcggtaaccgtacgggtacccgggg

SEQ ID NO: 155290 - DNA, 702 bp, Homo sapiens
  misc_feature: GYAE6OF01DD874.22.11.A11.1.454.CMB.1.raw
  modified_base (211)..(211): a, c, t, g, unknown or other
  misc_feature (211)..(211): n is a, c, g, or t
  modified_base (236)..(236): a, c, t, g, unknown or other
  misc_feature (236)..(236): n is a, c, g, or t
tcagacatacgcgtcacgaccggtgctcgatttagctacgactgcagggtgtacacctgtggttctcggggctgccctgtagggacagaggttggcacagcggtcactcccagggcaggagggtgggccgagccggctctgtccatgtcggccctcactacccccggcgggtccctgacgacctctcctgtgcagcctgtggttcaccgtnagtagcaagtacatgagctcggccncaggctcgagggagggctggagtgatctatagttatttagcgtcggtagtaacactactacacgcaagacttccggtaggacggccgtattccaacctactcctaccgaagaacgaactaacttacaaagtaaccgtacggttactaactccttaacaaaagttcgaaactacgtaccgtagaacggaacgcccggtaataccggaccgtaccggtcgttagttacttacgtggttacgtagaacgtaataacgtaaacgttaccgaacggtaccggtaccgggtaaccaaaccgtaagttacgtaacgtaaccggtcgggacccggtaaccggacccgttacggtacccgtccttacccgtcctccgacccgtcccaccccgaaccggtacccggtaccctaccgtttacccggttccccttacccccggtcggttaccccacccgtccgccgtcccgaaccggg

SEQ ID NO: 155291 - DNA, 792 bp, Homo sapiens
  misc_feature: GYAE6OF01DGYTJ.22.11.A11.1.454.CMB.1.raw
  modified_base (250)..(250): a, c, t, g, unknown or other
  misc_feature (250)..(250): n is a, c, g, or t
tcagacatacgcgtcacgaccggtgctcgatttagctacgactgcagggtgtacacctgtggttctcggggctgccctgtagggacagaggttggcacagcggtcactcccagggcaggagggtgggccgagccggcctctgtccatgtcggccctcactacccccggcgggtccctgacgacctctcctgtcgcacgccttcgtcgggttaccaccgtcagtacgcaagtacatggagcgtcgggtccncgaggcctaccggaaggggaacgggctgggagtggactctacgtagtttattacgtcgtcggtacgtaacactactacctacgacaggtaccgtccgggtagggaccggtcctattaccacctatccgtacaagactaactaacttacgaaacgaacgtacggttactaactacgttaacaaaagtcgaaacgtaccgtcgtaaggaacggtaccgtaccgtaagtaccggaaccgtaccgggtacgttacgttaacgtttacgtaggttcgtaaggtaacgtaacgttaaaccgttaaaaccgttaccggtaaccgggtacccgggtaaccggggtaaccctaaaccgttaaacgttacgtaacccgtacgggtaccggggaccgtaaccgggtaacccgtacggtacccgtacccgtcctacccgtaccgtaccgtacccgtaacccgtaacccggaaccggtcccctaccggtttccccggttacccccgttcccccggtccggaccccgtcccgtaccgtcccgtacccggaaccggg

SEQ ID NO: 155292 - DNA, 715 bp, Homo sapiens
  misc_feature: GYAE6OF01D3QAG.22.11.A11.1.454.CMB.1.raw
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
tcagacatacgcgtcacgaccggtgctcgatttagctacgactgcaggggggggagaggagcccagcactgggattccgaggtgtttccattcggtgatcagcactgaacacagaggactcaccatggagttttggctgagcggtggttttcgtcgtaggcgtacttataaaggtgtcagtgtgaggtgcagntgggtggagagtggaagngccttgactccnggccgtgggggtccngagctcctcgtgtgcacgcctgttcgggtaccncgtacaaggtacanaaacgttcagtggcgccgttcggggcccgcgacgggtcctaccgggaagggggaacggggtcttaggggacgttacggggtaattccggacgttattttaagtttccgtggtttacggtaacggtaactacaacttaacctacgataacggaccggttcggcgggaacggtcctagttcccaacctcttacccaacgaacgtacaaaccgttaaacttccgaaaaggtaacgtaccgggtattaacgttactaacttaagaacgaacacgaccgtagaagacggtaacccgagtaccggacaccggggttactagggtttaccttagtggttaggtaccggaagtacttaaagaaaccttccggaccggtaccggggtacccgggttaaccaaaccccggtaaaggttactccgtaaccggggtaccggg

SEQ ID NO: 155293 - DNA, 805 bp, Homo sapiens
  misc_feature: GYAE6OF01BF0TE.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcataccccgcgggtccctgagactctcctgtgcagcctcgtggttcaccgtcagtagcaagtacatgagcgtgggtccgcgaggcctccgagggaagggctggagtggatctacgtaagtttatttagtccgttcgggtagtaaaccactaagttaaccgtaccgcaacggtaccgttcccggtaggggaccgggaccgtagtttccaaccgtattcccgtaccgaaggaacgtaaacctaagttacccgaaaagtaacgtaccggttagttaactaccgtttaaacaaagttacgaaaccgtacggactagggaaacgacggacctagtacgaccgtaccgggtaccgttacgttagttaccgttaggtagttaggtaacgtaacttaactaaaacgttacccgaacggtcccgggtacggggtaaccctaaaccgtaaacgttacggtaacgtaccgggtacggggtaacccgtaaccgggtaacccgttccggttacccgtacccgttaccgttaccccgtacgacccgtaccccgtaacccggaacccggtaacccgggtaccccttcgttacccccgggtttacccccttaccccgggtcccggtaccccggtacccccgttcgtaccccggtacccgtaacccgggg

SEQ ID NO: 155294 - DNA, 604 bp, Homo sapiens
  misc_feature: GYAE6OF01ED0DV.22.11.A11.1.454.CMB.1.raw
  modified_base (232)..(232): a, c, t, g, unknown or other
  misc_feature (232)..(232): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaagggctggagtggatctcagtttattatctcggtggtaacacatactacgcagactccggtgggagggccgattcaccatctccagagacaattccaagaacncggtatatcttacaaatgaacngacctgaagacgccgatcgacacggtccgtagtattactgtgtagagatactaaattccgaacgccggaccggggtacaacccgtaattacgaacgtacgtcggggaccgaacgggtaaccctcggtccgaccgttccgtccctacgaccgcccctacccgaccggaccggacccgtccgttccccgttccccttccccggtcgcccgtcccgtccgtcccgtccggaccgg

SEQ ID NO: 155295 - DNA, 780 bp, Homo sapiens
  misc_feature: GYAE6OF01BK55S.22.11.A11.1.454.CMB.1.raw
  modified_base (647)..(647): a, c, t, g, unknown or other
  misc_feature (647)..(647): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagcgttgggttttccttgttgcttatttacgaaaaggtgtccagtgtgaggtgcagcgtgggtggagacgtgggaggagtccgttgactccgaggtcccgggtcggggggtccctgacggccttccgtcctgtcgcgacgtccgttcgtcgggttaccaccgtcgaaggtagacgaagtacagtggacggcgtcgggtccgcgcggaccgtacggaacggggagggtcgtagggacgtggactcgtacgttaagtttactttacgtccggttacggtaacggtaaacctaacgtaccgtaaccgtacggaccgtaacggacccgttaccggggtagggtaaccgggacgttaaccgttcccgaacctacgtcccgtaacgaacgtaacgaacttaaaccgttacgaaaacggtaaccggttagggttaactaactttctaaacgtaaaacgcgtaaactcggtaaccgtagggaacgtaccggaccggtaagtcgaaccggtcccggtntttaaggtattcccggttggacggtaacgaggtaaaccttaacggtaaacggtacccccgaagggggtccccgggtaaccggtaacccctaaaacgtaaccggttcggaaaccggttccggggtaaaccgggg

SEQ ID NO: 155296 - DNA, 737 bp, Homo sapiens
  misc_feature: GYAE6OF01D47FR.22.11.A11.1.454.CMB.1.raw
  modified_base (154)..(154): a, c, t, g, unknown or other
  misc_feature (154)..(154): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctnactaccccggcgggtccctgagactctcctgtgcagcctcgtgggttccaccgtnagtagacaagtacatgagcgtgggccncaggcctacgaggggaagggctagggagtggatctacaggtttattatcgtcggtagtaacncattacacgcaagcctccggtagggacggccattcacctatcacagacaactaacttccaaagtaacacggttatactcttaanaaagtcgaacngcctaggaacgacgaccgtatacggaaccgaccgggtacgttacggttaactttacgttaggtagttacggaacgtaacgtaaccgtaaaacgttacccgaaacgggtcccgggtaccggggtaaccctaaacccgtaaacgtttaccgaaccggttaaccgggtacggggtaacccgtaaccgggtaacccgttaccgggtacccgtacccggtacccgttacccgtaccgacccgtaccccgtaacccgaacccggtaacccgggtaccctaccggttaccccggttccccgttaccccccggtcggtaccccggacccgttccggcccgtccggaaccggg

SEQ ID NO: 155297 - DNA, 791 bp, Homo sapiens
  misc_feature: GYAE6OF01BTS6J.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcactaccccggcgggtccctgacgactctcctgtgcagcctcgtgggttccaccgtcagtagcaagtacatggagcgtcgggtcccgccgaggcctaccggaggggacgggctggagtggatcgtactagtttatttagtcgtacggtagtaacactattaccgtacgacacggtaccgtccggtaggggacggtacccgtatttcccaacctattccctaccgaaggtaacgtaacctaacttacccgaaaaggtaacccgtacggggttattaacttaccgtttaacaaaaacgttcggaaaaccgtcggtacccgtaagggaacgacccggtacccgtaagtacggaacccgtaccgggtaccgttacgtttaacgttacgttaggtcggtaaggtaacgtacgttaaactaaaaccgttccgaaacggtcccgggtacggggtaaccctaaccgtaagttacgaaccgttaccggtcgggaaccgtaaccgggtacccgttcgtaccgtacccgtaccgtcccgtacgacccgtacccctacccggaacccggaccggtacccctaccggttaccccggtttcccccgttacccccggtcggcccccgtacccgtccgtacccgtcggaaccgg

SEQ ID NO: 155298 - DNA, 547 bp, Homo sapiens
  misc_feature: GYAE6OF01AGKMA.22.11.A11.1.454.CMB.1.raw
  modified_base (353)..(353): a, c, t, g, unknown or other
  misc_feature (353)..(353): n is a, c, g, or t
  modified_base (452)..(452): a, c, t, g, unknown or other
  misc_feature (452)..(452): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcatacccccgcgggtccctgagactctcctgtgcagcctctgggttcaccgtcagtagcaagtacatgagctgggtccgccaggctccgaggggaaggggctggagtggatctcagttattatctcgggtggtaacacatactacgcagactccgtggaggccattcaccatctccagagacaattccaagaacacggtntatcttacaaatgaacagcctagagagccgatcgacacggccgtagtattacgtgtgtgagatacaaattcaagccgacgggtcaaccaatgactacgngggccgaggaccgtgacaccgtctcctcgacgcctccgaccacgggcccagttcccggtccttcccccgtcggcccgcccgtcgtcctccgacgg

SEQ ID NO: 155299 - DNA, 764 bp, Homo sapiens
  misc_feature: GYAE6OF01DO3K9.22.11.A11.1.454.CMB.1.raw
  modified_base (235)..(235): a, c, t, g, unknown or other
  misc_feature (235)..(235): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcactaccccgcgggtccctgagactctcctgtgcagcctcgtgggttccaccgtcagtagcaagtacatgagcgtgggtccncaggcctcgaggggaggctggagtgatcgtactagtttattactcgtcggtaggtaaaccacaatactacgcaagaccgtccggtagggacgggtcctaattccaacctacttcctaccgaaagacgtaaacctaagttacccgaaaaggtaaccgtacggggttattaaaccttccgtttaaacgaaaaagttcgaaaacccgtcgtacccgtaaggaccggtaaacgacccgtaagtaccggtaaccgtaaccggtccggtttaacgttaagtttaccgttaggttacggtaagtaagtaacttaaaccgtaaaacgttacccgaaacggcccgggtaccggggtaaccaaacccgttaagttacgaacgtacggtacgggaccgtaacgggtaaccgttcggtaccgtaccgtcctaccgtacgaccgtaccctaccgaaacccgtaacgggtacctaccggttacccggttccccgttacccccgtcggtaccccgtccccgtcggtcccgtcccggtaaccggg

SEQ ID NO: 155300 - DNA, 867 bp, Homo sapiens
  misc_feature: GYAE6OF01CO7WO.22.11.A11.1.454.CMB.1.raw
tcagacatacgcgtcacgaccggtgctcgatttagctacgactgcgagggggggagaggagcccagcactgggattccgaggtgtttccattcggtgatcagcactgaacacagaggactcaccatggtagttttggctgagtcgttgggtttttccttgttgcttatttacgaaaaggtgtccagtgtgaggtgcagtcgtgggtggagacgtgggaggagtccttgactccgacggtccggtcggggggttccctggacgtaccttccttccgtggtcgaccgtacgtccgttcgttcgggtttacccgaccgtcgtaaggtacgacctaaagtactaagtcggtacggcggttaccgggtccgaccggaggtcccgtaccgggaaggggacggggtactagggtaggtacgtacttccgtagttaagttttaacttcgtaccggtttagggtaacgtaaactaactacgttaaccgacgtacgaacgtaccggtcccgggtagggaaccggtaccgtaattacccaccgtaacgttcccgaacgtaaggaacgtaaactaaccgttaaccgaaacgtaaaccgtacggtttagttaaccttaccgttaacaaaagttacgaaacgtaacggtcccgtaaggaaccgaaccggttccgtaaacggtaccggtaaacccggtccgggttacgtttaacgttaacgtttaccgttgggtaaacgttacggaaaccgtaactttaaaacccggtaaaacccggtttaccggaaaacccggggtccccggggtaaaccggggttaaccccctaaaacgggttaaaggtttaacccggacccggttttaaaccggggaaacccccggggg

SEQ ID NO: 155301 - DNA, 669 bp, Homo sapiens
  misc_feature: GYAE6OF01CTE7X.22.11.A11.1.454.CMB.1.raw
  modified_base (404)..(404): a, c, t, g, unknown or other
  misc_feature (404)..(404): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtcggccctcactacccccgcgggtccctgagactctcctgtgcacgcctcgtcggttcaccgtcagtagcaagtacatgagcgtcgggtccgcgaggtcctaccggaggggaacgggctagggagtggactcgtacgtagtttattatcgtacggtagtaacactactactacgcaggtacctccggtagggacggcctatccgacctactcctacgagacgaacaacttaccgaaagtacgtaggtctatcttaanaaatacgacacgtcagagacgacgtatcgaccgacggtcgtagtacttagtgtgtagaagtactaactaaacgtccgaacggccggtacgggtaccctaaacgaagttacgaccgtacgggtaccgggaccgtaaccggtacccgtgtacccgtaccgttcctaccgtacgacccgtaccctacccgaaccgacccggtaccctccggttcccggttccccgttcccccggtcggtccccgtccgtccgcccgtccggtaaccgg

SEQ ID NO: 155302 - DNA, 617 bp, Homo sapiens
  misc_feature: GYAE6OF01BPU8F.22.11.A11.1.454.CMB.1.raw
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggcctccgaggggaaggggctggagtggatctcagtttatttatctcggtgtaacactatactacgcagactccggtggacgggccgattcaccatcctccagagacaattccaagaacacggtntatctanaaatgaacngcctgaagacgaccgatcgacgacggccgtagtattacgtgtgtgagatactaaacttaccgaacgcccggcggggtaccaacccgtaaagttacgaaccgttaacggtcggggaccgtaacgggtaacccgtcggtacccgaccgtccgtacccgtactacgccctacccgaccgaaccgggccctacgtcccggtcccttcccccggtcggtcccgccccgtcgtcccgtccgtaccgg

SEQ ID NO: 155303 - DNA, 681 bp, Homo sapiens
  misc_feature: GYAE6OF01DEZGO.22.11.A11.1.454.CMB.1.raw
  modified_base (154)..(154): a, c, t, g, unknown or other
  misc_feature (154)..(154): n is a, c, g, or t
  modified_base (236)..(236): a, c, t, g, unknown or other
  misc_feature (236)..(236): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctnactacccccgcgggtccctgacgactctcctgtgcagcctcgtgggttcaccgtcagtagcaagtacatgagcgtgggtccnccgaggcctccgaggggaagggctggagtggactctacagtttatttatcgttagggtagtaaacaccatacctacgcaagtacctccggtagggacgggccatttccgaacctattcctaccaaggacgaaactaacttccaaaaggacctacgggttgttaaactccttaacaaaatcggaaactaggtccctagacggaacgcccgagtaccgaacgaccggtcgttagttacttacgtgtgtagtaagtactaactaaacgttaccgaacggtaccggtaccggggtaccaacccgtaaagttacgaaccgttacggacgggtaccgaaccgggtaccgtcggttaccaccggtcctacccgtacaccgtcctacccgaccgacgggtccctacgtcccgtccctaccccgtcggcccgtcccgtccgccgtccggaccgg

SEQ ID NO: 155304 - DNA, 890 bp, Homo sapiens
  misc_feature: GYAE6OF01ANFAX.22.11.A11.1.454.CMB.1.raw
  modified_base (162)..(162): a, c, t, g, unknown or other
  misc_feature (162)..(162): n is a, c, g, or t
  modified_base (228)..(228): a, c, t, g, unknown or other
  misc_feature (228)..(228): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcataccccgngggtccctgagactctcctgtgcagcctctgggtcaccgtcagtagcaagtcatgagctgggtccnccaggctccgagggtagggttgagtggatctcagtttattatctcggtagtaaccactatactacgcaaggaccttccggtggacggggcctaatttcccgaacccgtattcccgttacccgaaggtacggtaacctaaacgttttacccgaaaaggtaacccgttaacgggttcgtttaaacttcccgttttaaccgaaaaaacgtcggtaaaaccgaaccggttttaccccgtaagggtaacggaaaccggtccccggtaaagttaccggaacccgtaacccgggtaccccggttaagttaaccgtttaacggttcgggttaggttaacggtaacggtaacgttaaaccgtaaaacgtttaccccggaaacgggtccccggggtaccgggggttaacccgtaaaccccgtaaaacggtttcggaacccgttaacgggtacccgggggacccgtaaaccgggggtaaccccgttacgggttaccccgtaaccggttaccccgttacccgtaccgtaccggtacccccgttaccccgaaacccgggtaacccgggtaccccgttaacggtttcccccggttaccccgttttaccccccccggtacgggttcccccggtaccccgttaccggtaccccgttaccccgggacggtaaccccggg

SEQ ID NO: 155305 - DNA, 807 bp, Homo sapiens
  misc_feature: GYAE6OF01DL2MV.22.11.A11.1.454.CMB.1.raw
  modified_base (212)..(212): a, c, t, g, unknown or other
  misc_feature (212)..(212): n is a, c, g, or t
tcagacatacgcgtcacgaccggtgctcgatttagctacgactgcagggtgtacacctggtggttctcggggctgccctgtagggacagaggttggcacagcggtcactccagggcagagggtggccgagccggctctgtccatgtcggccctcactaccccggtcgggtccctgacgacttctcctgtcgcagcctcgtgggtccaccgtnagtgcaagtacgatgagcgtgggtccgcgaggctaccgaggggaagggtctggagtggatctgtagtttattactcgttacggtagtaacactaatactacggactaggtaccgtccggtgggaccgggaccgtactttaccgacctagtccgtacgaaggacgaaccgtaacttaaccgaaacggtaaacgtacgggttagttaactccgtttaaacaaaagttacgaaaccgacggccgttaggaacggacgtcccggaaatccggaaccgtacccgggtaccgttacgttaacgtttacgtaggttagtaacgtaacgtaactaaacgtaaaaccgtttaacccggaaaccgggtacccgggtaccgggggtaaccctaaacccggttaaaacgttaccggtaaccgtaaccgggtaccggggacccgtaacggggtaaccccggttcggtaacccgtacccgttaccgtaccccgtcgtaacccgtcccgtacccgtaacccggtaacccggtcccgtacggtccccggttaccccttccccccgggtacgtccccggtaccccgttcggtcccgtaacccggtaaccggg

SEQ ID NO: 155306 - DNA, 642 bp, Homo sapiens
  misc_feature: GYAE6OF01BC56I.22.11.A11.1.454.CMB.1.raw
  modified_base (233)..(233): a, c, t, g, unknown or other
  misc_feature (233)..(233): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccnccaggcctccgaggggaagggctggagtggatctcagtttatttatcgtcggtaggtaacacatactacgcagactccgtggaggccattcaccatctaccagacgacaacttaccgaaagaacacggtntactctacaaatgaacngcctgaagacgccgatcgacgacggtccgtagtacttactgtgtagaatactaactaaacttccgaacggccggtaccggggtaccaaccctaaagttacgaaccgtacggtcgggaccgaacgggtaaccctggtaccctaccgtccgtccgtaccgaccgtcccgtacccgaaccggaaccgggacccctacggttaccccggttccccttaccccccggtcggtaccccggtccccgtcggcccgttcccggaaccggg

SEQ ID NO: 155307 - DNA, 598 bp, Homo sapiens
  misc_feature: GYAE6OF01B2F5G.22.11.A11.1.454.CMB.1.raw
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
  modified_base (428)..(428): a, c, t, g, unknown or other
  misc_feature (428)..(428): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcatacccccgcgggtccctgagactctcctgtgcagcctntgggttccaccgtnagtagcaagtacatgagctgggtccncaggcctccgagggagggctggagtggatctcagtttatttatcgtcggtagtaacacatacctacgcagactccgtggacggccgattccaccatcctccgagacgaactaattcccaaagaaccaggtntactcttacaaatgaaacagcctagaagngaccgatcgacgacggccgtgtattactgtgtganatactaaacttccgaacgccggacggggtaccaaccctaagttacgacgtacggtcgggaccgaacgggtaacccgtcggtaccaccgtcctccgtcaccgtccctacccgaccgaaccggccctacgtcccggtcccttccccgtcggcccgccctcgccgtccgacgg

SEQ ID NO: 155308 - DNA, 843 bp, Homo sapiens
  misc_feature: GYAE6OF01CM928.22.11.A11.1.454.CMB.1.raw
  modified_base (297)..(297): a, c, t, g, unknown or other
  misc_feature (297)..(297): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtcgccctcactacccccgcgggtcccctgacgacctctcctgtgccagcctcgtcgggttcaccgtcagtacacaagtcatgagcgtcgggtccgccaggcctaccggaggggaacgggctggggagtggactcgtacgtagtttatttacncgttacggtagtaactacattaccgtaacgcaagtaccgttccggtagggacggaccttattaccgaacctagttcccgaaccgaaggtaaaccgtaacttaaaaccgttccgaaaaacggtaaccgtacgggttaacttaacttacccgtttaagaaaaacgttccgaaaacgcggttaccctagggaaaacgtaccggacccggtagtacccgaaccggtacggtaccgttagttacttacgttagtagtagaacgtaataacgtaaacgttaccgaacggtccggaccgggtaaccaaccgtaacgttacggtaaccgtaacggtaccggggtaacccgtaacggtaacccgttacggtaacccgttaccccggtccgttacccgtacccgacccggttaccccgtaaccccggtaacccggtaaccccgggtacccccggttaacccggtttacccccggttaccccccgttttacccccccgggtaccgggtaccccccggtaccccggtttcgtaacccccggttacccggaaccccggg

SEQ ID NO: 155309 - DNA, 631 bp, Homo sapiens
  misc_feature: GYAE6OF01EZ4O7.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctcgtgggttcaccgtcagtagcaagtacatgagctgggtccgccaggcctccgaggggaaggggctggagtggatctcagttatttatcgtcggtggtaacacatactacgcagacgtccggtgggacgggccgtattccacctatcctccagagactaacttccgaagaacacggtatactactacaaatgaacagtcctagagacgcgtatgacgacggtcgtagtattactgtagtagagaatactaaacttacgaacggccggaccggggtaccaacccgtaattacgaaccgttacggtacggggaccgtaaccgggtaacccgtcgggtacctacccgtcctacccgtaccgaccgccctacccgaaccgaaccgggcccctacgttcccgttcccttcccccgtcggcccgtccccgtcgcctcccgtaacgg

SEQ ID NO: 155310 - DNA, 846 bp, Homo sapiens
  misc_feature: GYAE6OF01ESTC7.22.11.A11.1.454.CMB.1.raw
  modified_base (296)..(296): a, c, t, g, unknown or other
  misc_feature (296)..(296): n is a, c, g, or t
tcagacatacgcgtcacgaccggtgctcgatttagctacgactgcagggggggagaggagcccagcactgggattccgaggtgtttccattcggtgatcagcactgaacacagagactcaccatggtagttttggctgagtcgttgggtttttccttgttgcttatttacaaaaggtgtcagtgtgaggtgcgagtcgtggtggagacgtgggaggcgccttgactccgaggtccggtcgggggtccctgacgtactctccgtgtcggcacgtccttcgttcgggttccaccggtntaacgtagacaaagtactagtacggacggtccgttcggggtcccgaccggacgggtccgtaccgggaagggggtaacgggtcgtgggtacgtggaacttcgtacgttaagtttagtttcgtccgtacgggttaagtaaccagtaacgttacgtaacgcgtaacgacccgttcgggtacgggacggtacccgtatttaccgaacccgtacgttaccgtacccgtaaggaacctaaccgtaaacgtttaacccgaaacgtaaaccggtaacggttacgttaacgtttaccttaacgtaaagttaacggaaactaccggtaccgtaacggaaggaaccgtaccgtaacggtaccggtaacccgggttacggtacccgtttaacggttacgttaccggtttaggttacggttaacggttacgtaaaacgtttaaacccgttaaaaacggttacccgggtaaaccgggtacccgggtaaccccgggggttaaacccctaaaccccggttaaaaccgtttaacgggttaaccccgttaacggggttaacccggggg

SEQ ID NO: 155311 - DNA, 719 bp, Homo sapiens
  misc_feature: GYAE6OF01CL4PQ.22.11.A11.1.454.CMB.1.raw
  modified_base (630)..(630): a, c, t, g, unknown or other
  misc_feature (630)..(630): n is a, c, g, or t
tcagacatacgcgtcacgaccggtgctcgatttagctacgactgcgagggggggagaggagcccagcactgggattccgaggtgtttccattcggtgatcagcactgaacacagaggactcaccagtggtagttttggctgagtcgttgggttttccttgttgtcttattacgaaaggtcgtcctagtggtggaggtgcgagtcggtgggtaggagacgtgggaggtacgtccttgactccgacggtccgggtcgggggtcctagacgtctcgtcctggtcgctcgtccgtcgttacgggttaccacgtcaaggtacgacgtaagtactagtcggacggtccggtcgggtccgaccgtacggtccggaccgggaaggggtacgggcggtaggtaggtcggttactcgtacgttaagtttacgttacgtcggttacggtacgtaaactcgtaacgtacgacgacgacgtccggtcggagggtacgaccgtactaccgactacgtacaccgagaacgtactaacgtaccaagtaacgtagttagtacttacgtaacgtaagtacaacgtggactagggaactacggcgtaacgccgtaaccggtcgtacgttacgtaattccggtaggttanaagtaacgtactaaacgttaaccggtacggaccggtccgggtacgtaaaccctaacgtaacggttcgaacccggtaacgggtacccggg

SEQ ID NO: 155312 - DNA, 725 bp, Homo sapiens
  misc_feature: GYAE6OF01BA865.22.11.A11.1.454.CMB.1.raw
  modified_base (239)..(239): a, c, t, g, unknown or other
  misc_feature (239)..(239): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcactaccccgcgggtccctggacgactctcctgtgcagtcctcgtgggttcaccgtcagtagcaagtacatgagtcgtcgggtccncgaggcctaccggaggggacgggctgggagtggatctactagtttattagtcgtcggtagtaacatatacgtacgacacgtaccgtccggtagggacggcctattccaacctactctaccgaagacgaactaactaccgaaacgaacgtacggtataacttaccttaagaaaattcggaaactcggtccgtaaggaacgacgaccgagtacgaccgtacggtcgttatacgttacgtagtacggtagacgtaactaacgtaaacgttaccgaacgggtacccgggtacgggtacccaaaccgtaaagttacggaaccgttaccgggtacgggacccggtaaccgggtacccgtacggttacccgaccgtacccgtaccgtacgacccgtccccgtaaccgtaacccggaccgggtcccctaacggttccccgtaccccgttacccccggcggtacccgtaccccgtccggtccgacccggtaccgg

SEQ ID NO: 155313 - DNA, 884 bp, Homo sapiens
  misc_feature: GYAE6OF01C9LFQ.22.11.A11.1.454.CMB.1.raw
  modified_base (239)..(239): a, c, t, g, unknown or other
  misc_feature (239)..(239): n is a, c, g, or t
tcagacatacgcgtcacgaccggtgctcgatttagctacgactgcagggtgtacacctgtggttctcgggctgccctgtagggacagaggttggcacagcggtcactcccagggcagagggtggccgagccggcctctgtccatggtcggccctcactaccccgcgggtccctgagactctcctgtcgcagtcctcgtgggttccaccgtcagtagcaagtacagtgagtctcgggccncgaggcctaccggaggggaagggtctagggacgtggacttccgtataagttttaactttcgtccgttcgggttaaggtaaaccctactaaacgttaccgttaaccggactaacggtacccgttcccgggtaggggaaccggggtaccccttaagtttacccaaacccgtaagttccccgtaaccgaaggtaaccgtaaacctaaaccgttacccgaaaaggtaaacccgttaaccgggtttagttaaacttacccgtttaaacgaaaaacgttacggaaacccgtacgtacccgttaagggaaaccgtaaccgggtacccgagttaaccggaccgtaccggtaccggtagttaacgtttacgtacgttagtacgtaagtaactaacgtaaaaccgttaccgaacggtacccgggtaccggggtacctaaaccgttaagttacggtaaccgtacgggtacccgggtaaccgggtaaccggtaacccgttcgggttacccgtacccgttacccgtacccgtaccgtacccgtacccgttacccgaacccggtaacccggggtacccctaccggttacccggttacccccgtttaccccggtacccgggtaccccgtacccgttacccgcccggtacccggaaccggg

SEQ ID NO: 155314 - DNA, 778 bp, Homo sapiens
  misc_feature: GYAE6OF01BCETL.22.11.A11.1.454.CMB.1.raw
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactacccccgcgggtccctgagactctcctgtgcngcctcgtgggttcaccgtnaggtagcaagtacagtgagcgtcgggtcccgccaggcctccggaaggggaacggggtctgggagtggactctcgtagtttattatcgttggtagtaacacactactacgcaggaccgtccggtgggacgggtcccgtattcccacgtctcctacgaacgtacgaactaacgttacccaaacggaaaccgtacgggttagtaacttacctttaacaaaacgttacggaaaccacggtaccctaggaacggtaccgccggtaagcgaaccgtaccgggtaccgttagtaacttacgttaggcgttacgaacgtaactaactaaaacgttaccgaacggtccgggtaaccgggtacctaacccgtaaagtttccggaacgttaaccgggtaccgggacccgtaacgggtaaccccgttcgggtaccctacccgttcgtaacccgtccgtacccgtaccctaacccggaacccggtaacccgggtaccccgttccggtcccccgggtttacccccgtccccccggttacgggtccccccgtacccggtccgtccccggttacccggaaccggg

SEQ ID NO: 155315 - DNA, 957 bp, Homo sapiens
  misc_feature: GYAE6OF01B0EID.22.11.A11.1.454.CMB.1.raw
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcggtccctgagactctcctgtgcagcctctgggttcaccgtcagtacgcaagtacatgagctgggtccnccaggcctccgaggggagggctggagtggactctctaagtttatttacgcgttacgggtaggtaaacnctagttaacctacgacgtagtaccgttccggtgggacgggtccctattacccgacctattcctaccgaaggtaacgtaacctaaacgtttacccgaaaaggtaaccgtacggggtttactaaacctttccgtttaaacaaaaagttccgaaaaccgtcggtacccgttagggaaacggtaacccggtaccccggtaagttaccgggtaacccggtaacccggggtacccggtttaacggtttaacgttttaaccggtttaggttacgggttaacgggttaaacgttaaaccgttaaaccgttaaaaacccgtttaacccgggtaaaaccgggtaccccggggtaacccggggggttaaccccttaaaccccggttaaaacgtttaacccgggttaaacccggttaaccgggttacccgggggtaaccccggggttaaaccccgggggtaaacccccgtttaccggggttaacccccgttaccccggtttacccgttacccccgttaacccggtacccggtaacccccgttaccccggaaaccccgggtaacccgggtaacccccgttaccggtttacccccggttaccccggttccccccggttacccggtccccgggttacccccgtccggtaccccgttccccgggtaaacccggg

SEQ ID NO: 155316 - DNA, 663 bp, Homo sapiens
  misc_feature: GYAE6OF01BAI2T.22.11.A11.1.454.CMB.1.raw
  modified_base (284)..(284): a, c, t, g, unknown or other
  misc_feature (284)..(284): n is a, c, g, or t
  modified_base (516)..(516): a, c, t, g, unknown or other
  misc_feature (516)..(516): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttacaaaaggtgtccagtgtgaggtgcagctggtggagactgggaggagtccttgactccaggccgtcggggggtccctgacgacctctcctgtgcagcctcgtcgggtccaccgtcagtanacaagtacatggagccgtgggtcccgcgacggctaccgaggggacgggctgggagtggattcgtacgtagtttactttacgtcgttacggtaggtaaccacgtaactactacggacacgtaccgtaccggtagggacggtacccgtaattccacctagtcctacccgaagacaacctaacgttaccaaaggaaccgtacggttagtacttaccgttaacaaaagtcgaaacncgtaccaggacgtacgccgtaagtaccggaaccgaccgggttcttagtacgttctggtgtagacgtaacttacaaaaccgttcgaaacggtccccgggtaacgggaccctaaacccgttaattcccggaaccgttcgggacccgggg

SEQ ID NO: 155317 - DNA, 847 bp, Homo sapiens
  misc_feature: GYAE6OF01DYPJR.22.11.A11.1.454.CMB.1.raw
  modified_base (744)..(744): a, c, t, g, unknown or other
  misc_feature (744)..(744): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactaccccgcgggtccctgagactctcctgtgcagcctcgtgggttccaccgtcagtagacaaagtacagtgagtccgttcggggtaccccgccgaagggtccgtacccgggaaggggggtaacgggggcgttagggtaggtagggtacttcgttacgttaaggttttaattttacgtccggtttacgggttaacgtaaacacgtaacttaccgtaccggaccgtaacgtaccgttaccgggtagggaccggggtacctaacgtttccaacccgtaacttcccgtaaccgtaaggaaccgtaaacctaacgtttaacccgaaaacggtaaaccgtaacgggttacgtttaaactacgttaacaaaacgttacggaaaccgtacgtacctagggtaaggaccgaaccggtagtaccggtaaccgtaaccgggtaccgtttacggttaactttaacggttggttaggtaacgtaacgtaactaactaaacgttccgaaacggtcccgggtaccgggttaaccaaccgttaaagtcgaaccgttacgggaccgggtaaccgtaccggtaccgtcgtacccgtacccgttccncctaccgactacccgaccgaccggtaccggacccgtaccgttccccggttcccccttaccccggtccggtaccccgtcccgtccgtaccggtcccgtaccggg

SEQ ID NO: 155318 - DNA, 782 bp, Homo sapiens
  misc_feature: GYAE6OF01E3JRG.22.11.A11.1.454.CMB.1.raw
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaggggctggagtggatctcagtttatttatcgtcggtagtaacactatactacgcacgactccggtggacggccgtattccaccatcctccaagacgaacctaattaccgaaagtaacaccggttagtacttcttacaaaatcgtaaacagtcccgtaggaggtacgacccgtaagtacgaaccgtaccggtaccgttagttaactttacgttggttacggtagtaacgtaacttaaccgtaaaaacgtttacccgaaacgggtccccgggtaccggggggtaccctaaaccccgtaaagtttacggtaaccgttaaccgggtaccggggtacccggtaaacggggtaaccccggttacgggttaccccgtaccccggttacccgttcccgtacccgtaccgtacccccgttaccccggaaaccccgtaacccggggtacccccgtaccgtttacccccgggttacccccgtttacccccccggtacccgggtacccccggtcccccgttaccggtcccgtaccccggtaaccggg

SEQ ID NO: 155319 - DNA, 693 bp, Homo sapiens
  misc_feature: GYAE6OF01ER5HY.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcacgcctctgggttcaccgtcagtagcaagtacatgagctgggtccgcaggctccgaggggagggctggagtggatctcagtttattactctcggtagtaacagatactacgcagacgtccggtagggacgggcctattcacctatcctaccgagacgaactaacgttaccaaagaaccacggttagtacttctaacaaattagaaacacgtcctaggacgtacgccgtatacgacgtaccggtccgtagttacttacgtgtagtagagtaactactaaagttaccgaacggtcccgggtaccggggtaccaacccgtaagttacggtaaccgtaacggtaccggggtacccgaacgggtaaccccgttcggttacccgtacccgttccgtcccgtaccgtaccgtacccctacccgtaacccgtaacccggggcccctaccggttcccggttcccccgttcccccggtccggacccgtccccgttcgtcccgtaccggtaaccggg

SEQ ID NO: 155320 - DNA, 675 bp, Homo sapiens
  misc_feature: GYAE6OF01CI0YO.22.11.A11.1.454.CMB.1.raw
  modified_base (237)..(237): a, c, t, g, unknown or other
  misc_feature (237)..(237): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
  modified_base (655)..(655): a, c, t, g, unknown or other
  misc_feature (655)..(655): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactacccccgcgggtccctgagactctcctgtgcagcctcgtgggttcaccgtcagtagcaagtacatgagcgtcgggtccncgaggcctccgaggggagggctggagtggatctntagtttatttancgtcggtagtaacacatactacgcagaccttccggtggacgggccattccacctatcctcaagacgtaactaattccgaaagtaacacggttntaacttctaacaaatcgaaacagtccaggaancgaccgatcgacgaccggcgttagtacttacgtggtagtagaagtactaactaaacttaccgaacggcccgggtaccggggtacctaaacccgtaaagtacgtaaccgtaccggtacgggacccgtaaccgggtaacccgtcggtaccctacccgtccctcccgtaccgacccgtacccgtacccgaacccggtaaccggccccgttaccgtcccggttccccgttcccccggtcggacccgtcccnccggtccgtcccggtaccgg

SEQ ID NO: 155321 - DNA, 868 bp, Homo sapiens
  misc_feature: GYAE6OF01BAA7L.22.11.A11.1.454.CMB.1.raw
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (498)..(498): a, c, t, g, unknown or other
  misc_feature (498)..(498): n is a, c, g, or t
tcagacatacgcgtcacgaccggtgctcgatttagctacgactgcagggtgtacacctgtggttctcggggctgccctgtagggacagaggttggcacagcggtcactcccgagggcagagggtggccgagccggcctctgtccatgtcggccctacacgtaacccgcgggtccctgacgactctcctgngcagcctgtcggtcaccgtcagtagcaagtacngtgagcgtgggccacgaggcctaccggaaggggacgggctaggggtagtgggtacttctacgtaagttttactttacgtccgttacgggtagtaaacctacgtaacttaacgtaccgacgacggtaccggttccggacggggacgggtaccgtattcccgaacctacgtccaccgaagactaaactacgtaaccgaaagtaaccggtacgttagtaaccttaccgtaacgaaagtacgaaaccgtcgtaccgtacggaaggtaccggaaccgtanaaccggtaccggaccgggttacttaagtttaacggttacgttgggtacgtaaggtaacgtaacttaaaccgttaaaaccggttccggaaacccgggttccggggaacccggttaacctaaacccggtaaagtttacccgggaaacgtttaccgggggtacccggaacccgggttaaaccgggtaccccgttacgttaccccggactttcccgacccccggttaaccacccggggtaacccccttaacccgggtaacccggtaaacccgttccccggttaaaccccgttcccccgggttttaccccccttcccccggggtaacgacccccggttccccctaacgggtccccctaccgggggtaaacccccg

SEQ ID NO: 155322 - DNA, 770 bp, Homo sapiens
  misc_feature: GYAE6OF01CB5ZS.22.11.A11.1.454.CMB.1.raw
  modified_base (244)..(244): a, c, t, g, unknown or other
  misc_feature (244)..(244): n is a, c, g, or t
  modified_base (449)..(449): a, c, t, g, unknown or other
  misc_feature (449)..(449): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagcccggcctctgtccatgtcggcccctcactacccccggcgggtcccctgagacctctcctgtgcagcctcgtgggttccaccgtcagtagcaagtacatgagcgtcgggtccnccaggcctccgaggggacgggctggagtggactcgtacgtaagtttatttacgtcgtacgggtagtaaacactagtacctaacgcaacggaccttccggtgggacggacctattccgaacctatccctaccgaaggtaacgtaactaaacttaccgaaaacggtaacgtacgggttataacttacttaacgaaaagtcggaaacncggtacctagggaacgtacggaccgtaagtccgaacggtaccgggtaccgtttagttaacgtttaacgttcggttacggtaagtaagtaacgttaaccgtaaaaccgttacccgaaacggtcccgggtaccgggtaccctaaaccgtaagttacgaaccgttacgggaccgggtacccgtaacgggtaacccgtacgtcccgtaccgttcctccgtaccgtaccgtaccccgtacccgtaaccgaccgggtaccccttacgtcccgggttcccccttcccccgtcgggaccccctacccgttcgtcccgtaccgtaccggg

SEQ ID NO: 155323 - DNA, 785 bp, Homo sapiens
  misc_feature: GYAE6OF01DOH17.22.11.A11.1.454.CMB.1.raw
tcagacatacgcgtcacgaccggtgctcgatttagctacgactgcgaggggggagaggagcccagcactgggattccgaggtgtttccattcggtgatcagcactgaacacgagaggactcaccagtggtagttttggctgagtcgttggttttccttgttgtcttatttacgaaaggtgtcagtgtgaggtgcagtcgtggtggacgtacgtggaggacgtccttgacgtccgacggtccggtcgggggtcctacgacgtaccttccgtcgtgtacgcgtcgtccgttcggttcggttccaccgtcgtaaggtacgaccgtaagtacgtagtcggacggtcggttccggaccccgcgacggtccgtaccgggaagggacgggtgtaggtaggtgtacttcgttacgttagtttagttacgtcggttaacggtacgtaactacgtacgtaccgtacgacgtacgttaccgtcgggtacgggacgtaccgtacgtacctaccgtacgtacccaacgaacgtaaccgtacttaaaccgtaacgaaacgtaccgttaaggtacttaacttaccgaaacgtaaacgacgtaacgtacgtacgtaacggaccgtacgaccgtacgtacccggtacgtaccggtttacgttaacggtttacgtacggttacggtacgttacgaacgttaaaccgttaacgtaaacccgttccgggaaacccgggttacccgggtaaaccggtaaccctaaccggttaacgttacggtaacccggtaacggggtcccccggg

SEQ ID NO: 155324 - DNA, 703 bp, Homo sapiens
  misc_feature: GYAE6OF01CB93F.22.11.A11.1.454.CMB.1.raw
  modified_base (212)..(212): a, c, t, g, unknown or other
  misc_feature (212)..(212): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
tcagacatacgcgtcacgaccggtgctcgatttagctacgactgcagggtgtacacctgtggttctcggggctgccctgtagggacagaggttggcacagcggtcactcccgagggcaggagggtgggccgagccggcctctgtccatgtcggccctcactaccccgcgggtccctgagactctcctgtgcagcctcgtgggttccaccgtnagtagacaagtacatggagcgtgggtccgccaggcctccggaaggggagggntgggagtgatctntagttattancttcgggtgtaacacattactacgcagtaccgtcggnggacggcctatcacatcnccgagagacaatccaaagactacgggtntatacttacaaatcggaaactagcccgtagacgaacgtccggtaancggtaccgacgggtccgtacgttattacgtggtagagtaagtaactaacgtaaaccgttaccgaacgggtccgggacgggtaacctaacccgttaaagttacgaaccgttaacgggacgggaccgtaaccgggtacccgttcggtaccctacccggtccgttacccaccggtcccgacccctcccgaaacccggtaccggtacccccgttaccggttccccggttacccccgttccccccgtcccgggtacccctccccggtacccgtcccgtaccggtaccccggg

SEQ ID NO: 155325 - DNA, 733 bp, Homo sapiens
  misc_feature: GYAE6OF01CBSJZ.22.11.A11.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtcgccctcatacccccgcgggtccctgacgacctctcctgtgcagcctgtggttccaccgtnagtagcaagtacatgagtcgtgggtccnccaggtcctaccggaaggggacggtctggagtcggatcgtactaagtttatttacgcgttcggtagttaaaccacgtactacgtacgctaacggaccgttccggagggacgggtcctaatttccgaacctagttccctaccgaagaacgtaacctaaacttccgaaaacgtacctaaccggggttataacttaccgttaacaaacgttgaaacccgtaggtccctaggaacggtacgtaccgtaagtggaaccgtacgggtaccgttaggttacttacgtgtacgtagaacgtataactaaacgttacgacgtccggtaccgggtacaaccgtaactcgtaacgtacggtcgggaaccgtaccggtaacctcggtaccgtacccgtaccgtaccgtaccgaccgtcccgaccgtaaccggtaaccggtacccgtaccgttcccggttacccgttcccccggtacgtccccgtacccgtacgtcccgtccggtaaccgg

SEQ ID NO: 155326 - DNA, 819 bp, Homo sapiens
  misc_feature: GYAE6OF01CV8G4.22.11.A11.1.454.CMB.1.raw
  modified_base (796)..(796): a, c, t, g, unknown or other
  misc_feature (796)..(796): n is a, c, g, or t
  modified_base (812)..(812): a, c, t, g, unknown or other
  misc_feature (812)..(812): n is a, c, g, or t
tcagacatacgcgtcacgaccggtgctcgatttagctacgactgcagggtgtacacctgtggttctcggggctgccctggtagggacagaggttggcacagcggtcactcccgagggcagagggtgggccgagccggcctctgtccatgtcggccctcacgtacccccggcgggtccctgacgacctctcctgtcgcacgtcccttcgtgggttccaccgtcgaagtacgacaagtacagtgacgtcggtcgggccgcgaggcctacggaaggggacgggtctggaggtacggtactccttagtaagtttactttacgtcggttacggtaacgtaaccactacgttaaccgaccggaccgacggtaccgttaccgggtggggaaccgggtcccttaacgttacccgaacctacgttacccgaaccgaaggaaacgtaacctaaaccgttaaccggaaaacgtaacgtacgggtaactttacgttaaccgttaaacgaaacgtaacgaaacgtacgtacccgtaaggaacggaccgtacgtaaggtaccgaaccggtaccgggttaaccggtttagttaacggtttactagggttaacgttaggaaacccgttaaattaacccggtaaaaccggttccggaaacccggggtccgggttaacccggtaaaccctaacgttaacgttacggtaaccgtaccgggaccgggttaccgaccggtaccgttccgtaacgtccctctacgccgaccctacccgacccgacgaacccggcctccgttcccgtccccttacccgnggcccctacgccgtcnccggacg

SEQ ID NO: 155327 - DNA, 785 bp, Homo sapiens
  misc_feature: GYAE6OF01CLP22.22.11.A11.1.454.CMB.1.raw
  modified_base (119)..(119): a, c, t, g, unknown or other
  misc_feature (119)..(119): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
tcagacatacgcgtcacgaccggtgctcgatttagctacgactgcagggtgtacacctgtggttctcggggctgccctgtagggacagaggttggcacagcggtcactcccagggcagngggtggccgagccggctctgtccatgtggccctcactaccccgcgggtccctgacgactctcctgtgcagccttcgtgggttcaccgtnagtagcaagtacatgacgctcgggtccncaggctccggagggagggctggagtggactcgtatagtttatttacgcttacggtagtaaaccactagttaccgtacgcgtaacgtaccgttccgggtaggacgggtccattccgacctatcctaccgaagacgaactaacttacgaaacgtaacgtacggttagttaactacttaacgaaatcggaaactcgacccgttaggaacgacggtaccaggtaccgaccgaccggtcggttagttaacgttactacggtaggttacgaaacgttaacgttaacgtaaaaccggtttacccggaaacgggtcccgggtaaccggggttaccctaaaccgtaaacgttacgtaccgtttaaccgggaccggggtaacccgtaacggggtaacccgttccgggtaaccctcccggttaccgttcccgtaccgaccccggtaccctaaccccgtaaccgggtacccgggacccttcccgggttaccccggttaccccttcccccgggttccgtaccccggttaccccgtacccggccccgttaccgggtaacccgg

SEQ ID NO: 155328 - DNA, 757 bp, Homo sapiens
  misc_feature: GYAE6OF01COFJN.22.11.A11.1.454.CMB.1.raw
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (376)..(376): a, c, t, g, unknown or other
  misc_feature (376)..(376): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagacatacgcgtcacgaccggtgctcgatttagctacgactgcagggtgtacacctgtggttctcgggctgcctgtagggacagaggttgcacagcggtcactcccgaggcagagggtggccgagccggcctctgtccatggtcgccctcacgtacccccgcgggtcccagagtactctctgnacngcctcgtggtaccaccgtanagtagacaagtacagtgagtcgtacgggtccnccgaggtccgaccggaagggacggggtctgggagtggatccgtagtagttaattacgcgtacggtaagtaacactaacgtacgaacgtcgaacgtaccgtcggtagggaccggtaccctattccaactagtcctanaagacaataaacctcgaaagtaacgtaccgtattactaccttaagaaaaactgggaaacncgtaaccgnggaacgacggaacccggaatcggaaccgacggtcgtagttaactacgtgttacgagaaagtaactaacgtaaaacgttccggaacggtaccgggtacgggttaaccaaaccctaaaggttacgaaccggtaaccgggtacgggaacccgtaaccgggaaacccgttcggtaaccccgtaccgttccgtaacccgttacgaaccgtacccgtaacccgaaacccggtaacccggaccctaccgttaacccgggttccccgttaccccccggtacggtaccccgtccccgtacggtcccgtaccggaaaccggg

SEQ ID NO: 155329 - DNA, 702 bp, Homo sapiens
  misc_feature: GYAE6OF01BTE3X.22.11.A11.1.454.CMB.1.raw
  modified_base (248)..(248): a, c, t, g, unknown or other
  misc_feature (248)..(248): n is a, c, g, or t
  modified_base (409)..(409): a, c, t, g, unknown or other
  misc_feature (409)..(409): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggtagttttggctgagcttgggtttccttgttgctattcaaaaggtgtcagtgtgaggtgcagcgtggtggagactgggaggagccttgatcgagccggtgggggtcctgagactctcctgtncacgcctcgtggtccaccgtcagtagcaagtacagtgagcgtcgggtcccgaccgacggcctccggaaggggaacggggcgtagggaggtggaacgtcgtacgtaagtttaattacgtcgtacggtaggtaaactacgtatacgtacgacagaccgtcggnggacggtccgtatcacctatcgacaagacgtaactaacgtacaaacggacgtacggtacgtaacttcttaacaaagtacaaacgacgtaccgtaaggaacggaccggtacccgaagtaccgggaaccgaccgggtacccgttaggttaaccgttacggttggtaagtaggtaaacgtaccttaaaacgtaaaaccgttcccggaaaccggggtccccgggttaacgggggtaaaccccctaaaccggttaaaaccttacgggtaaaccccgtacgggggttaaccccgggggg

SEQ ID NO: 155330 - DNA, 804 bp, Homo sapiens
  misc_feature: GYAE6OF01DJG5S.22.11.A11.1.454.CMB.1.raw
  modified_base (467)..(467): a, c, t, g, unknown or other
  misc_feature (467)..(467): n is a, c, g, or t
tcagacatacgcgtcacgaccggtgctcgatttagctacgactgcagggtgtacacctgtggttctcggggctgccctgtagggacagaggtggcacagcggtcactcccgagggcaggagggtggccgagccggcctctgtccatgtcggccctcacgtaccccggcgggtccctgacgactctcctgtcgcacgcctcgtcggttcaccgtcagtacgacaagtacatgacgtcgtcgggccacgaggtctaccggaggggagggtcaggagtgactctcgtagtttattacgtcgttacgggtacgtaacactaacgtaccgtaccggaactacggtaacccggttcgggtacggggacggtacccgtaactttcccgaactaccgttccgaacgaacggtacaaccttaacttaccgaaaacgtacgtaggttacttacgttacctacgaaaatacggaaccncgtccgtagggacgtaccgacgtaagtacggacgtaccggttacgtacgtttaacgtacgttggtaacgtaggtaaacgtactaaacgtaaacgtacccggaacgggtacccgggggttaaccggtaaacccgtaacccgttaaacgttacggtaacccggttaccgggaccggggtaacccgtaaccgggtacccgttaccggtacccgtaccgttccggtacccgttaccgacccgtaccctacccggaacccgtaccgggaccccttttcggtcccggtttcccccgtacccggtcccggaccccgtacccgtccggtcccgtccggtaaccgg

SEQ ID NO: 155331 - DNA, 871 bp, Homo sapiens
  misc_feature: GYAE6OF01EC0U2.22.11.A11.1.454.CMB.1.raw
  modified_base (231)..(231): a, c, t, g, unknown or other
  misc_feature (231)..(231): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcgggtccctgagactctcctgtgcagcctctgggttcaccgtcagtagcaagtacatgagctgggtccncaggctccgagggaaggtctggagtggatctactagtttatttagtcgtcggtagtaacactatacctacgcagaccgtccggtggacgggcctaattccaacctattccgtaccaaggacgtaaacctaactttacccgaaaacggtaaaccgtaaccggggtttattaaactttacccgtttaaaacgaaaaagttcgggtaaaacctacggtaccccgttaagggaaacggtaccggtacccggtaagttaccgggaacccgtaaccgggtacccggtttaggttaactttacgttaggttaggttagtaacggtaacttaaccgtaaaacgtttacccggaaaccgggtaccccgggtaacccggggggtaaccctaaaccccgtaaacgtttaaccggtaaccgttaaccgggtaccgggggtaacccggtaaaccggggtaaccccgttaccgggttacccgtaccccggttaccctacccgttaccgtaacccggttaccccgtaccccgtaaaccccggtaacccggggtaaccccctaccgggtttacccccgggttacccccgtttacccccccggttaccgggtacccccggtaccccgttccggtccccgttccccggaaacccgggg

SEQ ID NO: 155332 - DNA, 632 bp, Homo sapiens
  misc_feature: GYAE6OF01BXKI7.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaagtgtccagtgtgaggtgcagctggtggagactggaggagccttgatccagcctggggggtccctgagactctcctgtgcagcctcgtgggtccaccgtcagtagcaagtacatgagctcgggccgaccgaggccgtaccgaggggaacggggctgggagtcggatctcaagtttattagtcgtacggtaggtaaacacgtatactacgcaagactcggtaggacgggccgattcacctatcctaccagacgaactaacttaccgaacgaacaccggtataactacttaactaaacgtagaaactacgaccgtagaacgacggacccgtaagtacgaaccggtacggtccgtagtacgttacgttcggttagtacggaagtaactaacgtaaaacttaccgaacggacccgggtaccggggttaaccaaaccgtaaagttacgaaacgttaccggtaaccggggg

SEQ ID NO: 155333 - DNA, 835 bp, Homo sapiens
  misc_feature: GYAE6OF01CUCUO.22.11.A11.1.454.CMB.1.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (319)..(319): a, c, t, g, unknown or other
  misc_feature (319)..(319): n is a, c, g, or t
tcagacatacgcgtcacgaccggtgctcgatttagctacgactgcagggtgtacacctgtggttctcggggctgccctgtagggacagaggttggcacagcggtcactcccagggcaggagggtggccgagccggcctctgtccatgtcggccctcactacccccgcgggtcccctgacgtactctcctgtcgcacgtcctcgtgggttccaccgtnagtagacaagtacagtgacgcgtcgggtcccnccaggcctaccggaaggggaggggctgggagtggacttctagtaagtttatttagcgttcggtagtaacnctaactacacgctacgaccgttccggtagggacggtaccctattacccacctacgttcctacccgaagtacgtaacctaaacttacccgaaaggaacctaggggttcttaacttaccttaacgaaaagttcgaaaccgtacgcccgttaaggaaacgcggtacccgtaagttaccggaacccgtaacccgggtaccggttacgttaacgttaccgtaggtttacggtaagtaacggtaactaaaccgtaaaaccgtttaccggaaccgggtcccgggaacccggggttaacctaaaccccgttaaaggtttaccggaaaccgtttaccggggtaccggggtaaccccggtaaccgggttaaccccggttcggtaaccccgtacccgttcccgtacccgtaccgacccggtcccctaacccgggaacccggtaccggacccgttacccgttcccggttcccccttaccccgggtcccggtccccgtaccccgtacggtcccgtacccggtaaccggg

SEQ ID NO: 155334 - DNA, 627 bp, Homo sapiens
  misc_feature: GYAE6OF01ELTEZ.22.11.A11.1.454.CMB.1.raw
  modified_base (165)..(165): a, c, t, g, unknown or other
  misc_feature (165)..(165): n is a, c, g, or t
  modified_base (171)..(171): a, c, t, g, unknown or other
  misc_feature (171)..(171): n is a, c, g, or t
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (412)..(412): a, c, t, g, unknown or other
  misc_feature (412)..(412): n is a, c, g, or t
  modified_base (446)..(446): a, c, t, g, unknown or other
  misc_feature (446)..(446): n is a, c, g, or t
tcagacatacgcgtcacgaccggtgctcgatttagctacgactgcgagggggggagaggagcccagcactgggattccgaggtgtttccattcggtgatcagcactgaacacagacggactcaccagtggagttttggctgagtcggtgttcgtgtagcgtatanaaagtntcgagtntgagtgcagngtggtgagactggaggngccgttgactcgagccggtggggcctagacgctcgctgtncgagtccgtcgtggtaccacgtcgtagcgacatcagtgacgngtcgccacgngtccgtacgagggacgtcgagnggtcctagtacncgttagtttaactcgcgttacggtgtaaaccntacggtaanaccgagtactacgccgtaaggtcgtacgtattcgaacctnttaccgccgagtacgaaccttactaaccggaaanacgtacgtacgtaacgttactaacgtacgtagtacgacgtcgtagacgaacgcgacgtacgacgtacgtacgttacgtagttacgtcgtagtacgttaacgtaagtaaccgttaacggtacccgaccgggtacgtacccgggttaacctaaccgttaggttacgtaccggtccgggtacgg

SEQ ID NO: 155335 - DNA, 993 bp, Homo sapiens
  misc_feature: GYAE6OF01DVVIG.22.11.A11.1.454.CMB.1.raw
  modified_base (533)..(533): a, c, t, g, unknown or other
  misc_feature (533)..(533): n is a, c, g, or t
tcagacatacgcgtcacgaccggtgctcgatttagctacgactgcagggtgtacacctgtggttctcggggctgccctgtagggacagaggttggcacagcggtcactcccgaggggcagggaggggtcgggccgacggcccggcctctcgtccagtggtcggccctcaccgtaccccggcgggtccctaggacgtaccttcctccgtggtcgaccacggtccgttcggttcgggttacccaccggtcgtaacgggtacgaccgtaaaggtacctagtacgggtaccggtccggttaccggggtcccgacccggtagggcccgtaccgggggaaaggggggtacggggtccgtggggacggttaggtaccttcgtacgttagtttacttacgtcggttacggtacgtaacactacgtaacgtacggctaacggtcgttcggagggacggtcctacgtaccaccacgttccgacgaagaacggaaaccttaacgtaccgaaacggtaacgtacggttattacctaccgttaaanaagtaccgaacgaccgggtactaacgggaacgtaccggtaccggtagtaccgggaacccggtacccgggtttacgtaacgttttaacgtacggttacgggtaacgtaacgggtaaccttaaacggtttaaacccgttaaaacgttaccccgggaaaccggggggttaccccggggtaacccggggttaaaaccccctaaacgttaacgggtttcccggtaaaccggttacccgggggtaaccggggtaacccggggtaaaccccggttaaccccgggttacgttaacccgtaacccccggttcccgtaccgtacccgggtaccccggaacccgtttaaccccggaacgggaaacccccgggttccccttaaacggggttccccccggttacccccgcccccggggttaacgggcccccttaccccggttaccgggtaccccggttaacccggggacccgg

SEQ ID NO: 155336 - DNA, 721 bp, Homo sapiens
  misc_feature: GYAE6OF01COATY.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagtttgctgagctgggttttccttgttgctatttacaaaaggtgtccagtgtgaggtgcagtcgtggtggagacgtgggaggagtccttgactccgaggtccgtcgggggtccctgacgtactctcctgtcgcgacgcctcgtcggttcaccggtcagtagacaagtcagtgagtcgtcgggtccgccgaggtccgtaccggaaggggacgggtcgtagggtacggtggacgttccgttacgtaagttttaacgtttaacgtccggttacggtacggtaaaccacgtaacttaaccgtacgtacgaacgttaccgtccgggtagggtacgggtaccgtacttacccaaccgtacgtaccgtaccgtaacggaactaaccgtaacttaaccgaaacgtaaacggtacggtagtacttaactaacgtaaagtacggaactacggacctaggacgtaacggccgtaagtccgacgtaccggtcgttagttaagttacgtggtagtaggtaacgtactaacgtaaaacgttccgaaaccgggtccggtaccggggtaacccaaccgttaagttacgtaaccggttcggtaacccgggg

SEQ ID NO: 155337 - DNA, 745 bp, Homo sapiens
  misc_feature: GYAE6OF01C0CVE.22.11.A11.1.454.CMB.1.raw
  modified_base (664)..(664): a, c, t, g, unknown or other
  misc_feature (664)..(664): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagtcgttgggttttccttgttgtctatttacaaaaggtgtccaggtgtgaggtgcagcgtgggtggagacgtgggaggtacgtccttgactcgacggtccggtcggggggtcctggacgtacctcgtccgtgtcgaccacgtccgtcggttcgggttaccaccgtacgtacgtaagtacgtaacgtacgagtcggacggtcggttccggggacccgtccgacgggccgtaccggggaacgggggtaacggggtcggtacggggtaggtacgggtacttaccgttacgttaaagtttaccggtttaacgttccggttacgggttaacgtaaactagtaacttacgtaacgacgtacgtaccgtcggtacgggacggaccgtactacgacctagtccctaacggagaacgaacttaaacgtaccgtaaacggaacgtacggttatacgttaacgtaacaagtaacgtacctagtccgaaggtaacaccggacgagttacgaaccggtcgtaaccgtagttaacctagngtagaagaataaccgtaacaacgttaccgacggtacccgggacgtaactaacccgaaagttccgaacgtccggtaccgggg

SEQ ID NO: 155338 - DNA, 729 bp, Homo sapiens
  misc_feature: GYAE6OF01DL2WR.22.11.A11.1.454.CMB.1.raw
  modified_base (128)..(128): a, c, t, g, unknown or other
  misc_feature (128)..(128): n is a, c, g, or t
  modified_base (206)..(206): a, c, t, g, unknown or other
  misc_feature (206)..(206): n is a, c, g, or t
  modified_base (268)..(268): a, c, t, g, unknown or other
  misc_feature (268)..(268): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
  modified_base (411)..(411): a, c, t, g, unknown or other
  misc_feature (411)..(411): n is a, c, g, or t
tcagacatacgcgtcacgaccggtgctcgatttagctacgactgcagggtgtacacctgtggttctcgggctgccctgtagggacagaggttggcacagcggtcactcccagggcagagggtgggccngccgctctgtccatgtcggccctcactccccgcggtccctgagtactctcctgtgctagcctcgtgggttccaccgtnacgtacgcaagtcagtggagcgtcgggtacccgcgaggtcctaccgggaggggtaacggggntgggtagtaggtactcgtacgttagtttatttacgcgttacggacgtaacactatacctacgctagtaccgttcgaggggcgcctatccacgattccncaagagctaactcgaagaccnggttcaatctaacgaaatccaacncgccgtagacggtaacgccgtagaccgtacaccggtaccgttaagttattacgtggttagtacaaggttactaaacctaaagttcccggaaccggtccggggttacccgggtaactaacccgtaagttccggaactttacgggaacccgggtacgtaacccggttacaccgttaaccgccggtaacccttccactacccgtcccggtaaccccgaacccgttaacccggacccgggtttaccccacccgggttttccccgttccccccgttccccccgggacggtcccctccccggttccgccccggttaaacccggg

SEQ ID NO: 155339 - DNA, 984 bp, Homo sapiens
  misc_feature: GYAE6OF01D9ZJ7.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccgagggcaggagggtggccgagccggcctctgtccatgtcggccctcactaccccggcgggtccctgagacctctcctgtgcagcctcgtgggttcaccgtcgagtacgacaagtacagtggacgtccggttcgggcccgaccgaggtcccaccgggaagggggacgggtcgtagggaggtcggtacttcctacgttaagttttaactttacgtcggttaacgggtaaccgtaaaacctacgtaacgttaacccggtaaccgtacgtaacgttacccggttcggggtaacgggggaccggtaccgttaaccgtttacccgaaccttacttacccgtaaccgaaaggtaacgtaaaaccttaaccgttaaacccgaaaaggtaaccggttacggtttataaccttaccgttaaaactaaaggtaacgaaccgactaccggtagaaacggtacccggacgtaaacgtcgtaaccggtaccgggttcggttaacgttacgtttaacgggttggtaaggtaacggtaacttaaaccgttaaaaccgtttaaaacccggttacccgggaacccgggtacccggggggttaaccccggggttaaaccctaaaaccccgggtttaaagtttacccggaaacccggtttacccgggggaacccgggggtaacccggttaaacccgggggttacccctttaaccgggtaccccttaccccggtttccgtacccgttacccggtacccgtaccccgtaaaccccggaaccccgggttaaaccccgggtcccgtttacccggtttacccccgggttacccccgtttccccccgggtacggttccccccggtaccccttcgggaccccctaaccgggtaacccggg

SEQ ID NO: 155340 - DNA, 714 bp, Homo sapiens
  misc_feature: GYAE6OF01B7NCT.22.11.A11.1.454.CMB.1.raw
  modified_base (207)..(207): a, c, t, g, unknown or other
  misc_feature (207)..(207): n is a, c, g, or t
  modified_base (386)..(386): a, c, t, g, unknown or other
  misc_feature (386)..(386): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtgccctcactaccccgcgggtccctgacgtactctcctgtgcagcctcgtgggtccaccgtnagtagctaaagtacatgagcgtcgggtccgccgaggtccgtaccggaaggggagggctggagtggacttctacgtagtttattagtccggttacggtagtaaaccataacgttacctacggctaacggaccttccgggtaggaccggacctattccaacctacttccgaccgaaggaanaacctaaattcccgaaagaaccgtaggtataactcttaacaaagtcgtaaacgcgtacgtagacgaacgccgtaagtcgaccgtacgttccgttaattacgtgtacgtaagagtaactaataaactccggaacgtccgggacggtacaaaccgtaataccgtaacgttacggacgggtaccgaaccggtacccgtacgtcctaaccgtcctccgtacgacccgtcccgtaacccgacccggtaccggtacccctacggttccccgttaccccgtcccccgtacggtaccccctacccttacccgtaccgaaacggtcccgtaacccgg

SEQ ID NO: 155341 - DNA, 628 bp, Homo sapiens
  misc_feature: GYAE6OF01DNTU7.22.11.A11.1.454.CMB.1.raw
  modified_base (249)..(249): a, c, t, g, unknown or other
  misc_feature (249)..(249): n is a, c, g, or t
  modified_base (350)..(350): a, c, t, g, unknown or other
  misc_feature (350)..(350): n is a, c, g, or t
  modified_base (457)..(457): a, c, t, g, unknown or other
  misc_feature (457)..(457): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccgagccgtgggggtcctgagactctcctgtgcngcctcgtgggttcaccgtcagtagacaagtacagtgagtcgtcgggtccgccgaggcctaccggaggggaagggctggagtggatctactagttactttancgtcggtaggtaacactatacgtacgcagactccggtagggacggtccgtattccgaacatccacaagacaactaactaccgaaagaacgtaggtctattacctaanaaactcgaacacgaccgtgaacgacgacgtacgtacgaaccgtaccggtacgttagttacttaacgtgtacgtaggacgtaaacgtaactaaaacgttccggaaccgggtacccgggtacggggtaaccctaaacccgaagtttaccgaaccggttaacgggtaccggggg

SEQ ID NO: 155342 - DNA, 793 bp, Homo sapiens
  misc_feature: GYAE6OF01B12AU.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttcctgttgctattcaaaaggtgtccagtgtgaggtgcagcgtggtggagacgtgggaggacgccttggactccgacggtccggtcgggggtcctgacgaccttctccgtgtcgcacgtccgtacgtcggtaccaccgtcgtagtacgactaagtcgagtggacgtcgtcgggtaccgaccgacggtccgtaccgggaagggggtaacgggccggtagggaacggttcgggtaacttcgttacgttaaggttttaacgttttacgttaccggttacggttaacggtaaacctacgtaaacgttaccgtaaccgacgtacgtacgtccgggtagggaccggtacctagtaccctaacgtacttcccgtacgtaacgaactaacgtaacccttaacgaaacggacgtacggttagttaccttaccgtaaacgaacgttacgaaaccacggttaccgaggtaaccgtaacgtacccggtaaggtacccggtaacggtaccgggttaccgtttaaggttaaacgttaccggttgggttacgtaaggtaacttaacggtaaccttaaaacgtcccggaacgggtacccggggtaaccggtaaccctaacccgggttaaagtaccggtaaaccgtaaccggggtaccgggg

SEQ ID NO: 155343 - DNA, 764 bp, Homo sapiens
  misc_feature: GYAE6OF01BNUCB.22.11.A11.1.454.CMB.1.raw
  modified_base (488)..(488): a, c, t, g, unknown or other
  misc_feature (488)..(488): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggtagttttggctgagcttgggttttccttgttgcttatttacaaaaggtgtccagtgtgaggtgcagctgggtggagacgtgggaggagtccttgactccgaggccggtcggggggtccctggacgtacctctccgtgtcgcacgtcctcgtcggttaccaccgtcgagtagactaagtacagtgacgtcggtcgggtcccgaccgacggtccgtaccgggaagggggacgggcgtagggtacggtggtacttcgttacgttaagtttacgtttacgtcggttacggttaacggtaaactacgtaactaccgtacgacgacgtaccgtacgggtacgggacggtaccgtacttaccaacctnttcccgacgtaagaactaaacgttaactaaccgaaagtaaccgtacggtttataaccgtttactaacgtaaacgtaccgaaacctacgtacgtaggaacgaccgtaccggtacgtacggaacccggtaccggttacgttagttaaccgtttggtacggtacgtaggtaacgttaacttaaccggtaaaacgttcccgggaaccgggtacccggggtaacccgggtacctaaacccgggttaagttccggtaaaccggttccggggaaacccggggg

SEQ ID NO: 155344 - DNA, 781 bp, Homo sapiens
  misc_feature: GYAE6OF01EC0EC.22.11.A11.1.454.CMB.1.raw
  modified_base (250)..(250): a, c, t, g, unknown or other
  misc_feature (250)..(250): n is a, c, g, or t
  modified_base (285)..(285): a, c, t, g, unknown or other
  misc_feature (285)..(285): n is a, c, g, or t
tcagacatacgcgtcacgaccggtgctcgatttagctacgactgcagggtgtacacctgtggttctcggggctgccctgtagggacagaggttggcacagcggtcacctcccgagggcagagggtggccgagccggcctctgtccatgtcgccctcactacccccgcgggtccctgacgacctctcctgtcgcacgtcctcgtcgggttccaccgtcagtacgactaagtacatggagtcgtcgggtccnccgaggccgtccggaaggggaacgggcgtaggagnggtacttcagttaacgttttatttacgcgttacggtacgtaaacactaactaccgtacgactacggtacgtccgggtaggggaccggtaccttacttccgacctattcccgtacgaacggactaactaaccgttacccgaaaggtaacccgtaacgggttagtttaactaccttaaacgaaacgtacgtaaccgaacgtacccaggaacggtacccgtacgaacgttaccgaccggtaccggtacgttaagttacgtttagtaggtagaacgtagtaaccttaacttaaacgttacccggaacggtccgggtaacccgggttaccaacccgttaacgtacgtaacccggtaacgggtaccgggtaaccggtaacccggtacccgtcggacccttacccgtcctccgtaccgaccgtacccaacccggtaccgtaccggcccgttacccgtccgttacccctccccgtacggcccctaccggtctcccgccgaacgg

SEQ ID NO: 155345 - DNA, 1065 bp, Homo sapiens
  misc_feature: GYAE6OF01ANEG3.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccgagggcaggagggtggccgagcccggcctctgtccatcgtcggcccctcgactacccccggcgggtcccctggacgtaccttctccctgtgccacgtcccttcgttcggggttccaacccgtcaaggtacgacctaaaggtaccagtcgggacgtccgttcgggcccgaccgacgggggccggttacccgggggggaagggtccgtaggggtacgtaggacttccgtacgtaagttttacgtttacgttccgttcgggttaacggtaaccaacgtaattaaccgtaccggacctaacggtacccgttaccgggtagggaccggggtcccgtaactttcccaaccctacttccgtaacccgtaacggtaacgtaacgtaaacctttaaccgaaaacgtaaccggtaccggttagttaaccgttacctttaaccggaaaagttaaccgaaaccgtacggtaccgtaggaacggtaaccgaccggtaactaccggtaccgtaccgggtaccgtttaaggtttaacgttacggttacggttaacgaacgtttaaacctaaacgttaaaaccccgtttacccggtaaacccggggtacccggggttaaacccgggggttacccctaaaaccccggtttaaacgtttaaccggtaaaccccgggtttaaccgggtacccggggggtaaaacccccggttaaccggggttaaaccccccggttaccgggggtttaacccccttaaccccggggtttaccccttaaccccggttaacccggtaacccccggttacccccggtaaaaccccggtaaacccccgggaaaccggggttcccccccgttaaacccgggttccccgggtttaccccccccggtttaccccccggtcccggtacccccggtccccggtttacccggacccccggttacgggtaaccccgggtcccgtaaccccccggg

SEQ ID NO: 155346 - DNA, 637 bp, Homo sapiens
  misc_feature: GYAE6OF01B7WK5.22.11.A11.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccncaggctcgagggaaggggctggagtggatctcagtttattatctcggtgtaacacatactacgcagacctcgtggaggccattcaccatctcaganacaattccaagaacacggtntatcttanaaatgaacngcctgagacgcgatgacacgccgtgtacttacgtgtgtagagtactactaaaattccgaaacgtccggacgggggtaccaacccaaaagtttcgaaccgttaacggttcggggacccgtaaccggggtaaaccccgtaggtaccgtaacccgtccttacccgtaccgacgtaccccgttaccccgaacccgaaacggggacccctacgttccccgggttccctttccccccccgtacgggccccgtcccctcgtcccgtcccggaaacggg

SEQ ID NO: 155347 - DNA, 793 bp, Homo sapiens
  misc_feature: GYAE6OF01CVUXZ.22.11.A11.1.454.CMB.1.raw
  modified_base (264)..(264): a, c, t, g, unknown or other
  misc_feature (264)..(264): n is a, c, g, or t
  modified_base (398)..(398): a, c, t, g, unknown or other
  misc_feature (398)..(398): n is a, c, g, or t
tcagacatacgcgtcacgaccggtgctcgatttagctacgactgcagggtgtacacctgtggttctcggggctgccctgtagggacagaggttggcacagcggtcactcccgagggcaggagggtggccgaggccggtcctctgtccagtggtcggccctcactaccccggcgggtccctgaacgacctctccgtggtacgcagtccttcgttgggttaccaccgtcagtacgacaagtacatcggagtccgttcggggtcccnccgaggcctacggaagggggtagggctggggagtcggattcctagttagtttatttactcgttacgggtaagtaaccactaacgttacacgactaacggtccgtacgggtaggaccggtccgtataccaacctnttaccgaccgaagtaacgaaaccttaacgtaacccgaaaacgtaccgtagggttaactaactacttaacgaaatcggaaactacgcgtagacgaccgtacgagtccgaaccgtcggtaccgttacgttaacgtttacgtaggtagtacgtaaagtaacttaaacgtaaaccgtaccggaacggtccgggtaaccggtaacctaaccgtaacgtaacggtaaccgtaacgggcgggtaccgtaaccgggttcccgttacggtaacctcccggttacctcccgtaccgacccgttccccaaccggtaccccggtaaccgtccccgttaccggttccccgttacccccgttccccgggtcccggtaccccgtccgtacccgccgtaccggtaacccgg

SEQ ID NO: 155348 - DNA, 774 bp, Homo sapiens
  misc_feature: GYAE6OF01CEMRD.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactacccccgcgggtccctgagactctcctgtgcacgcctcgtgggttccaccgtcagtagcaagtacatgagcgtcgggtcccgccgaggcctaccggaggggaacggggctggagtggattcgtcgtaagttttattttacgtcgttacgggttaggtaaaccactaacgttacctaaccggacgaacggtacccgttacccggggttaggggaccgggggtaccccgtaactttcccgaaccctacttcccgttacccgaaggtaacgaacctaaaactttacccgaaaacggtaaacctacggggttattaacttaccttaacaaaagttcgaaacgcgtacctagacggacgtccgaagtacgaccgtaccggtacgttagttaacgttacgtgttagtagaagtactaactaaacttaccgaacggccgggtaccgggtacctaaccgtaagttacgacgtacggtacgggaccgtaaccgggtaacccgtcggtaccgtaccgtacctcccgtaccgaccgtccctacccgaacccggtaacccggcccgtaccgttcccgttccccgttccccggtcggccccgtcccgtccgtcccgtaccggacccggg

SEQ ID NO: 155349 - DNA, 608 bp, Homo sapiens
  misc_feature: GYAE6OF01EYDMT.22.11.A11.1.454.CMB.1.raw
  modified_base (444)..(444): a, c, t, g, unknown or other
  misc_feature (444)..(444): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagactggaggagccttgatccagccgtggggggtccctgagactctcctgtgcagcctcgtgggttcaccgtcagtagcaagtacatgacgcgtcggggtccgccgagggccgtccggaggggaacggggctgggagtggatcgtctagtttattatcgtcggtagtaacacagtactacgcagactccggtggacggccattccacctagtcctaccgagagactaacttaccaaagactacggtntactcttacaaatgaacacgctagacgacgccgagtacgaccgtacggtcgttagttacttacgtggttacgtagagtaacttaacgtaaaacgttccgaaacgggtcccgggacggggttacccaaacccgtaaagtttcgacccgttacgggtacccggggg

SEQ ID NO: 155350 - DNA, 790 bp, Homo sapiens
  misc_feature: GYAE6OF01DWLQU.22.11.A11.1.454.CMB.1.raw
  modified_base (244)..(244): a, c, t, g, unknown or other
  misc_feature (244)..(244): n is a, c, g, or t
tcagacatacgcgtcacgaccggtgctcgatttagctacgactgcagggtgtacacctgtggttctcggggctgccctgtagggacagaggttggcacagcggtcactcccgagggcaggagggtggccgagccggcctctgtccatgtcgccctcactaccccggcggtccctgacgactctcctgtgcagcctcgtgggttccaccgtcagtagacaagtacagtgacgtcgtcgggtcccncgaggcctaccggaggggaagggctaggagtgacttcgtacgtagtttatttcgtcgtcggtaacgtaaccactaacgttaccgacgacgaacgtaccgttccgggtagggaaccgggtccttaacttacccaaccgtactttcccgaacccgaaaggtaaaccgaaacttaaaccgttaacccggaaaaacggtaaacccggttacggggtttaacttaaaccgtttaccgttaaaacaaacggttaccgaaaccgtacgggtaccctaagggaacgtaaccgacccggttaagtaccggaacccgtacgggttccttaggttaacttacgggtgtacgtagaacttaactaaccgtaaacgtcgaaccgggccgggtacggtaccaacttaagtccgacgtaccgggcggaccgtaaccggtaccgtcgttaccgacccgttctccgacgacccgttaccccaaccggacccgacggtccccttcggttcccccgttaccccgtccccggaacgtcccctacccgcgttcccgaccggaaccgg

SEQ ID NO: 155351 - DNA, 788 bp, Homo sapiens
  misc_feature: GYAE6OF01DNTZD.22.11.A11.1.454.CMB.1.raw
  modified_base (161)..(161): a, c, t, g, unknown or other
  misc_feature (161)..(161): n is a, c, g, or t
  modified_base (173)..(173): a, c, t, g, unknown or other
  misc_feature (173)..(173): n is a, c, g, or t
  modified_base (225)..(225): a, c, t, g, unknown or other
  misc_feature (225)..(225): n is a, c, g, or t
  modified_base (355)..(355): a, c, t, g, unknown or other
  misc_feature (355)..(355): n is a, c, g, or t
tcagacatacgcgtcacgaccggtgctcgatttagctacgactgcagggtgtacaccgtgtggttcgtcggggctgcccgtggtagggacaggagggttggcacagcggtcactccgagggcaggaggggtggccgagccggctctgtccatgtggccctnacgtaccccggngggtccctgacgtcctctccgtagtgctagccctcgttgggttccaccggtnaggtcgacaagtacagtcggacgtccgttcggggtcccgccgtaaggccgtaccggaagggggaacggggctagggacgtggactctacgtagttattgtcgtacggtagtaacacgtaactcgtacggnaacggtaccgtcgggagggaccggtccgtacttacccgacctagttcccgaccgaaggtaccgaaacctaaccgttaaccaaacgggtaaaccgttaaggttcgttaaaccgtaccgtttaaacgaaaagttacggaaaccgtacggtaccggtaggtaacggacgtaccggtagtaccggtaccggtaaccggttcggtaacgttacgttaacggtacgggttagtaacggtaactaacgtaaccgtaaacgttacccgaacgggtaccgggtaacccgggtacctaaaccgtacgtacggaaccgttccgggacggtaccggtaacggtacccgtcggtaccgaccctcgtaccgacctaccgccgtaccggaccgaaccgggctccggtcccgtcccgtcccgcggacctcccggcgccctcgaacccgg

SEQ ID NO: 155352 - DNA, 738 bp, Homo sapiens
  misc_feature: GYAE6OF01ESKS2.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcactacccccgcgggtccctgagactctcctgtgcagcctcgtgggttcaccgtcagtagcaagtacatggagctgggtcccgccaggcctccgaggggaaggggctggagtggatctcgtaagtttatttacgtcgtcggtaggtaaccactataccgtacgcaacgtaccgtccggtagggacggccgtattccaccgtatcctaccgagaacgaacctaattaccgaaacgtaaccgtagggttatacttacttacaaagttacgaaacgtcgtaccgtggaacgcgtaccgagtacgaccgtaccggtccgtagttattacgtgtagtagtaagtactaactaaacgttaccgaacggtcccgggtaccggggtaccaacccgtaacgttacgaaccggttacggtaccggggaccgtaacccggggtaaccgttccggtacccgtacccggttaccctcccgttaccgaccgtacccccgtaccccgaacccggtaacccgggcccctaccggttccccgggttcccccttcccccgggtcccgtccccgtacccggtaccgtcccggtccgaacccggg

SEQ ID NO: 155353 - DNA, 858 bp, Homo sapiens
  misc_feature: GYAE6OF01CFDEN.22.11.A11.1.454.CMB.1.raw
tcagacatacgcgtcacgaccggtgctcgatttagctacgactgcagggtgtacacctgtggttctcgggctgccctgtagggacagaggttggcacagcggtcactcccgagggcaggagggtgggccgaggcccggctctgtccatgtcggccctcacgtacccgcggtccctgacgactctccgtgcgcacgtcctcgtcggttccaccgtcagtacgcaagtacagtcggacgtcgtcggggtcccaccgacggtccgtaccgggaaggggaacgggggtcgttaggggaggttacgggtaacttccgttacgttaaggttttactttaactcggttacgggtaacgttaacaacgtacgtaccgtacgactaacggtaccgtccgggtaggaccgggtacctacttaccaaccgacgtaccgtacccgaaggaaccctaaacgtaaaccgttaccgaaaacggtaaacccgtagggttacttaacttaccgttaaacaaaagttccgaaacgttacggaccctaggaaccgacgtaccgaggtacgaccgacgggtcgtagttacttagtaggtgttaagacttaacgtaacgtaaaccgtaccggaaccggtacccgggtaccgggtaacccaaccggttaaacgttacggaacccgttacggggaacccggggtaaccggtaaacccgggtaacccggttccggtaacccgtaccccgggttccctttaacccggacgtaacccccggtaccgtacccccggtaaacgggaccccgtacccgtcccggtttaaccccgtccccgttacccccggtacgcccccgtaccgtacccgtccgtaacgacccggg

SEQ ID NO: 155354 - DNA, 686 bp, Homo sapiens
  misc_feature: GYAE6OF01C81US.22.11.A11.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
tcagacatacgcgtcacgaccggtgctcgatttagctacgactgcagggtgtacacctgtggttctcggggctgcccgtggtagggacaggaggttggcacgagcggtcactcccagggcaggagggtgggccgagccggctctgtccatgtcggccctcactacccccggcgggtccctgacgtacctctcctgngcacgccttcgtgggtccaccggtnaagtcgcaagacagtggcggtcggttcgggccgccgagggccaccgggaagggggacggggctgggagtggtacttcgtagttagtttattacgtgttacgggtagtaacactatacgtacgacaggtaccgtcgggtggaccggtacctattcccaacgtacttccaaccgaaggtacctaaactactaacgaaagaccgtaggtacttactacgtanaaacgtcgaacncggtacgagaacgcgactagcgacgcgtcgtatagtcgtgtagtagagtaactaacgtaacgttacgaccggtaccgggtacggtaacctaacgtaacgtacgtaaccgtacggggacggacccgggtaacgttacccggcgtaccgtccgtaccgtccacgtcccgcctaacccggactaccgggccctccgtcccggtccccttccggccgccgtaccgcgccgtcggaccg

SEQ ID NO: 155355 - DNA, 781 bp, Homo sapiens
  misc_feature: GYAE6OF01AY9VE.22.11.A11.1.454.CMB.1.raw
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcgggtccctgagactctcctgtgcagcctcgtgggtcaccgtcagtagcaagtacatgagcgtgggtccncgaggcctccgagggagggctggagtggatctcgtagtttatttacgtccgttcgggtacggtaacctactagttaccgtaccgacgtaacggtaccgttccgggtaggggaccgggtacccgtactttacccgaccctattcccgtaccgaagtaacgtaacctaaacgtttacccgaaacgtaaccgtaccgggttattaacttacctttaacaaaagttcgaaacgacgtacccgtaggaacggtacggacccgtagtacggaccggtaccgggtacccgttagttaacttacgttggtacggtaggtaacgtaactaaccgtaaaaccgttaccgaaaccgggtcccggggtaaccgggggttacccctaacccgttaaacgttcggtaacccgttacgggtaccgggggtacccgtaaccggggtaaccccgttcgggtacctacccggtctacccgtccaccggtacccctaccgacccgtacggaccccgtacgttcccgtaccccgttccccgtcggcccctacccgtcgcctccggacgg

SEQ ID NO: 155356 - DNA, 669 bp, Homo sapiens
  misc_feature: GYAE6OF01DMFWR.22.11.A11.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (326)..(326): a, c, t, g, unknown or other
  misc_feature (326)..(326): n is a, c, g, or t
  modified_base (396)..(396): a, c, t, g, unknown or other
  misc_feature (396)..(396): n is a, c, g, or t
tcagacatacgcgtcacgaccggtgctcgatttagctacgactgcagggtgtacacctgtggttctcgggctgccctgtagggacagaggttggcacagcggtcactcccagggcagagggtggccgagccggctctgtccatgtcggccctcactaccccgcggtccctgacgactctcctgtgcagcctcgtgggttccaccgtnagtagcaagtacatgagctgggccnccaggcctccgaaggggagggctggagtgacttctactagtttatttacgcgttacggtagtaaacacgtatacgtacgcaacgtaccgtcggngggacggtcctaattccaaccattccgtaccgaagacgtaaacctacttacccgaaagaccgtacggttntaactaccgttaacaaaagttcgaaacgtacgccgtagacgacgtccgaagtcgaaccgtacggtccgttagttacttacgtggtagtagtaagtactaactaaacgttcccgaacggtcccgggacgggtacccaaccgtaagttcgaacgtacggcgggaccgtaacggtacccttcggaccgtaccgtctccctacgaccgtcccgtaccgaaccggaccggccctcgtcccgttccctccccggtcgccctcccgtcgccgtccgacgg

SEQ ID NO: 155357 - DNA, 778 bp, Homo sapiens
  misc_feature: GYAE6OF01C5302.22.11.A11.1.454.CMB.1.raw
  modified_base (134)..(134): a, c, t, g, unknown or other
  misc_feature (134)..(134): n is a, c, g, or t
tcagacatacgcgtcacgaccggtgctcgatttagctacgactgcgagggggggagaggagcccagcacgtggattccgaggtgtttccattcggtgatcagcactgaacacagagactcaccatgtagtttgntgagcgttggttttccttgttgtacttatttacgaaaaggtcgtacagtggtgaggtgcgagcgtgggtaggacgacgtgggaggacgccgttgacgtccgacggtccgggtcgggggttccctaggacgtaccttccgttccgttggcgtccgacgtccgttaccggttccgggttaccctaccggtagaacggttacgactaagtaccgtagtacggacgtccggttccgggacccgccgacggtccgtaccgggaaggggaacgggtcggtaggtggtacgttactccgtagttaagtttacgtttacgttacggttacggtaacgtaaccaataaccgtacgtacacgtaccgtaccgtccgggtacggaccgtcgtacctaccaccgtactccgacgaagtaactaacgttacctaacgaagtaacgtcgttaagttaccttacgtaacaagtaccgaacgtcgacgtaggaaccgaccggtacgaacgtacgtaaccgggtccgttaacgttagttaccgttaggtccgtagggaattaacgttaacaaaccttaaacccggtccggaacccgggtaccccgggtacggttaaacccaaaccggttagtacccggtacggtaacccggggtacccggg

SEQ ID NO: 155358 - DNA, 698 bp, Homo sapiens
  misc_feature: GYAE6OF01B3MHR.22.11.A11.1.454.CMB.1.raw
  modified_base (521)..(521): a, c, t, g, unknown or other
  misc_feature (521)..(521): n is a, c, g, or t
  modified_base (552)..(552): a, c, t, g, unknown or other
  misc_feature (552)..(552): n is a, c, g, or t
  modified_base (627)..(627): a, c, t, g, unknown or other
  misc_feature (627)..(627): n is a, c, g, or t
tcagacatacgcgtcacgaccggtgctcgatttagctacgactgcgagggggggagaggagcccagcactgggattccgaggtgtttccattcggtgatcagcactgaacacagaggactcaccatggtagttttggctgagcgttgggttttccttgttgctatttacaaaaggtgtccagtgtgaggtgcgagcgtggtggagacgtggaggagccttagactccgagtccggtacggggggttcccaggacgtacctcgtccgtggtacgccacggtccttcggttcggggttaccaccggtcgaacggtaacggacctaaaggtaaccgagttacggaacggtccggtcggggtaccccgtaccggacggtccggtaccgggaaggggaacggggtcttaggggacggtaggacttaccgtagttaaggtttattacgttcggtacggttacgaactactactaccgtacgacacgtaccgtcggtgggacggcctataccgactatccctacgganaacgtactaactacgaacgtaacctaggttntaacttcgtaactaaagcgaacacgaccgtagaacgccgtacgtagtaccgaacgcggtccgttatacgtacgtntacggataacgtagtaactaaccgtcgaccggtaccggcgttaacccaactagtcgtaccgcggtaccggg

SEQ ID NO: 155359 - DNA, 799 bp, Homo sapiens
  misc_feature: GYAE6OF01C9QCS.22.11.A11.1.454.CMB.1.raw
  modified_base (176)..(176): a, c, t, g, unknown or other
  misc_feature (176)..(176): n is a, c, g, or t
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (596)..(596): a, c, t, g, unknown or other
  misc_feature (596)..(596): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtcgaccctcactacccccggcgggttcccnggaacgccttctcccgtagtggcacggcccttcgttcgggggttacccaccgtacgaaggttaacgaccaaaggttaccngttacggacggtccgttacgggggtccccncccgtaagggtcccttacgggaagggggggtaagggcttaggggaacggttggacttaccttacgtaggtttaacttttagtaccggttacgggtaacgttaaacaacgtacttaccggtacgacgtaaggtacccttcgggtggggaacgggcccttaaattcccgaactactaccctaccgtagaacgtaacctaaccgtaaccgaaaccgtaagtacggtactactactacgtaaaagtcgaactacggctagacgacggactacgacgaccgtaccgtacgtacttaagtcgtagtacgacggtanaacgtaaccgtaaagtacccggacgggccgggtaacccgggttacaacgttaactacggaaccgttacgggaccgggaccgtaccggtaacccgtcgtaacccgtcctaccttccgactcccgtccaaccggaccgtacccggtcttccgtccccggtttcccggtacccgaccggtcccaggtcccgtacgtcgaacccggg

SEQ ID NO: 155360 - DNA, 690 bp, Homo sapiens
  misc_feature: GYAE6OF01A84DW.22.11.A11.1.454.CMB.1.raw
  modified_base (584)..(584): a, c, t, g, unknown or other
  misc_feature (584)..(584): n is a, c, g, or t
  modified_base (643)..(643): a, c, t, g, unknown or other
  misc_feature (643)..(643): n is a, c, g, or t
tcagacatacgcgtcacgaccggtgctcgatttagctacgactgctgggggggagaggagcccagcactgggattccgaggtgtttccattcggtgatcagcactgaacacagaggactcaccatggagttttggctgagtcttgggttttccttgttgcttatttacgaaaaggtgtccagtgtgaggtgcagcgtgggtggagacgtgggaggagtccgttgactccgaggtcccggttcggggggtcccctggacgtaccttcctccgtggtcggccacgtcccgttcggttcgggttaccaccggtcaggtacgactaaagtacagtggacgtccggtcggggtcccgccggaggtccgtaccgggaagggggaacggggtcgtagggtaggtggtacttcgtacgttagttttatttacgtccgttagggtaacggtaacactactacgtacgactacggaccgtcgggtacgggacggtacctacttacccgactcgttaccgtacgagtaacgtaacttaacctaaccgaagaaccgtaggttattacttaaccgtaacaagtacgaacacgtacgnggaacgacggcgtacgtacgaccggtacggcgttattactgttgtagtagagtactaanaacgtcgacggtccgggacgtaccaacgtagtcgacgtaggtccggg

SEQ ID NO: 155361 - DNA, 1000 bp, Homo sapiens
  misc_feature: GYAE6OF01BSDK2.22.11.A11.1.454.CMB.1.raw
  modified_base (197)..(197): a, c, t, g, unknown or other
  misc_feature (197)..(197): n is a, c, g, or t
  modified_base (314)..(314): a, c, t, g, unknown or other
  misc_feature (314)..(314): n is a, c, g, or t
tcagacatacgcgtcacgaccggtgctcgatttagctacgactgcagggtgtacacctgtggttctcggggctgccctgtagggacagaggttggcacagcggtcacctcccaggggcagaggggtgggccgagccggcctctgtccatggtcggccctcacgtaccccggcgggtccctgagacctcctcctggtncacgtcctcgtgggtccaccgtcacgtagacaagtacagtcgagtcggtcgggtccgaccgaggccgtaccgggaagggggacggggtcgtagggagtcggtacttctataggtttnttaacgtcggttacggtaacggtaacaacgtaacttcgacgacgacgtaccggttcgggaggaccggtcctacttaccgaacctatacccgtacgaaacgacgtaaactaccttaacggaaacgtaaccggtacgggttaattaccgttaacctaaacgtaaagacccgtaaacgtaccggtaccggtaacggaaccggttaccggaacccggttaacggtacccgggtaaccggtaaaccccgggtttaaccggtttaaccgttaacgtttacgggttaacggttaaacggggtacgtaaaaccggttaaacgttaaacccgtaaaacccggtttaaaccgggacccggggttaaacccggggtaaccccggggttaaccccgttaaaccggttaaaacggtttaccgggtaaaccggtttaccccgggggtaacccggggtaaacccggggtaacccggggttaaaccccgggttccggtttaaccccggtacccccggtttaacccgtaccccggttaacccggtaacccccgttacccccggtaacccggtaaaccccggttaccccggggtaaccccggttacccccgttccccggggtttacccccccgtccccgggttaacccccggtccccggtaaacccgggttccccgggaccccgttacccgggaaacccccggg

SEQ ID NO: 155362 - DNA, 625 bp, Homo sapiens
  misc_feature: GYAE6OF01ALCAI.22.11.A11.1.454.CMB.1.raw
  modified_base (162)..(162): a, c, t, g, unknown or other
  misc_feature (162)..(162): n is a, c, g, or t
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcataccccgngggtccctgagactctcctgtgcagcctctgggttcaccgtcagtagcaagtacatgagctgggtccncaggctcagggagggctggagtggatctcagttattantcggtagtacncatactacgcagactccgtggacggccgattcaccatcctacagagacaattccgaagaacacggtgtactcgttacaaatcgaacaggccctagagacgccgatcgacacggccgtgtacttactgtgtgagtatactaaacttccgaacgccggacggggttccaacccgtaaattacggacctaacggcgggaccgtacgggaacccgttcggtacccgtaccgtccgttccctacgacgtccccgttacccgacccggaacccggggtcccctaacggtccccggttccccgttcccccggtaccgggccccgtaccccgtcgtccccgttccgaaccgggg

SEQ ID NO: 155363 - DNA, 904 bp, Homo sapiens
  misc_feature: GYAE6OF01EVI6J.22.11.A11.1.454.CMB.1.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
  modified_base (810)..(810): a, c, t, g, unknown or other
  misc_feature (810)..(810): n is a, c, g, or t
  modified_base (890)..(890): a, c, t, g, unknown or other
  misc_feature (890)..(890): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccagtgtcggccctcactacccccgcgggtccctgacgactctcctgtcgcagcctcgtggttccaccgtnagtacgacaagtacatgagcgtcgggtcccncgacggcctaccggaggggaacgggtctggacgttggacttcgtacgttaagttttactttacgtccgtttacgggtaacgtaaaacctacgtaacgttaacccgtacggtaccgaaacgggttacccgtttacccgggggtaggggtaaccgggtacccgttaacttttaccccgaaaccgttaacgttcccgtaaccgaaacgggttaaaccgtaaaccccttaaaaccgtttaacccgaaaaacgggtaacccgttaaaccggggttttacgttaacctttaaccttaaccggtaaaaacgtcgggtaaaacccgtaacgtaccccgtttaaagggaaccggtaaaccggtcccggtaaacgtaccggtaacccggtaaccgggttacccgtttaacgggtttaactttacggttggttaaccggtaaggtaaacctaaacgttaaccgttaaaaccgtacccggtacggtacccggggtacccgggtaaccctaaacccggttaagttaccgaacgtacgggtaccgggaccgtaaccggtaccgtaccgtaccgcccgttancccgtacaccgtaccctaacgtaacccggacggtaccctacgttcccggtacccccttccggccgtaccctccccgttancccggacgtaccgg

SEQ ID NO: 155364 - DNA, 845 bp, Homo sapiens
  misc_feature: GYAE6OF01BRI33.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtcggccctcacgtaccccgcgggtcccctgacgactcctcctgtcgcagtccttcgtgggttccaccgtcaagtagacgtaagtacagtgagtcgtcgggtccgccgaggcctaccggaggggacgggtcgtggagtggacttcgtactagttttactttacgtcgtacggtaacgtaactacgtaagttaacccgtacggaccgtacgtaccgttccggggtaaggggacccgggtacctagtttacccgaaccgtaacttccccgttaacccggaaggtaactaaaccgttaaacttaccggaaacgtaaccggttaaccgggtttactaacgtttacccttaaactaaaacggtacggtaaacgtaccgtaccgtaagggaacgttacgggacccgtaagtaccggtaaccggtccggttcccggttagttaacgtttacggttaggttacgtaaggtaacgtaaacttaaccgtaaacgttaccggaaccgggtacccgggtaacggggtaccctaaaccgtaagttaccgtaaccggtacgggtaccggggaccggtaaccgtaccggtacgttaccgtacccgttaccgtccgtacgacccgtacccgaacgacccggtaacccgggcccttaccgggtaccccgttccccggttacccggtcgtacccgtcccgtcgtacccgcggtaccgg

SEQ ID NO: 155365 - DNA, 869 bp, Homo sapiens
  misc_feature: GYAE6OF01ENZSM.22.11.A11.1.454.CMB.1.raw
  modified_base (122)..(122): a, c, t, g, unknown or other
  misc_feature (122)..(122): n is a, c, g, or t
  modified_base (198)..(198): a, c, t, g, unknown or other
  misc_feature (198)..(198): n is a, c, g, or t
  modified_base (854)..(854): a, c, t, g, unknown or other
  misc_feature (854)..(854): n is a, c, g, or t
tcagacatacgcgtcacgaccggtgctcgatttagctacgactgcagggtgtacacctgtggttcgtcggggctgccctgtagggacagaggttggcacagcggtcacctcccgaggcaggnggggtggccgaggccggcctctgtccatggtcgccctcacctaccccggcgggtccctgacgtactctccgtgtcncacgtcctcgttcgggttccaccgtacaggtacgaccgtaagtaccagttacggacggtccggttaccggggtccccgacccggaacgggtaccccgtaccgggggaaaggggggacggggtcgttaggggtacggttcggtacttccgttaagtttaagttttaactttacgtccggttagggtaacgtaaacctagttaaccgtaccggtaccgtacgtacggtaccggttccggggacggggtaaccggtcccgttaacctttaccaacccggttatccccgtaaccgaacggaactaaaccgtttaacctaacccgaaaaggtacccgtaggtttacgtaacctttacgtaaaacgaaacgttacgggaaccctggtacccgtaaggaaccggtacgacccggttaagaccggtaacccggtccggtttaccttagtttaaccgttacggtgttaaggagtaaacttacctaaagtaacccgtcccggaagggtcccgggtaaccggtacctaaccttagggtaccgtaccggtacgggccgggtaaccgtaacggccgttacgacccgtacccgtcgacctcgaccctcccgaccgtaacggcccgttactcccggttcccctacccgtccccggaccgccccgttacccntaccggcggaccccg

SEQ ID NO: 155366 - DNA, 843 bp, Homo sapiens
  misc_feature: GYAE6OF01BFPDZ.22.11.A11.1.454.CMB.1.raw
  modified_base (652)..(652): a, c, t, g, unknown or other
  misc_feature (652)..(652): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagcgttgggttttccttgttgcttatttacaaaaggtgtccagtgtgaggtgcagcgtgggtggagacgtgggaggagtccttgatccgacggccggtggggggtccctgacgtacctcctccgtgtgctacgcccttgtcgggttaccaccgtcgaagtacgactaagtacagtggacgtcgtcggggtcccgtccgacggtccggtaccggaaggggggaacggggtcgtaggggtacggtagggtactttaccgtaccgttaagttttaagtttaccttccgggttacgggttaacggttaaaccgtaaccgtaacttaacccgtaaccggtaccgtaacggtaacccggttacccggggtacggggaaccggggtacccgttaccgtttaccccaaccgttacctccccgtaaaccggaacggtaaaccggaaaccctttaaaaccttaaacccgggaaacgtaaaacccggtttacggggttaactttaccctttaacccggttaaaanaaaaggttccaaaaccggtccgaaccggttaggaacggtacccgaccgtaacggtacggaaccccggtcgggttacctttaagttacttaggttagtcgtaaagggtactaaccgtacgttaaaacgtcccggacgggcccggggtacggtaacccaaacgttaacggttcggaccgttcggggacccggg

SEQ ID NO: 155367 - DNA, 894 bp, Homo sapiens
  misc_feature: GYAE6OF01CGTUN.22.11.A11.1.454.CMB.1.raw
  modified_base (153)..(153): a, c, t, g, unknown or other
  misc_feature (153)..(153): n is a, c, g, or t
  modified_base (165)..(165): a, c, t, g, unknown or other
  misc_feature (165)..(165): n is a, c, g, or t
  modified_base (225)..(225): a, c, t, g, unknown or other
  misc_feature (225)..(225): n is a, c, g, or t
tcagacatacgcgtcacgaccggtgctcgatttagctacgactgcagggtgtacacctgtggttctcggggctgccctgtagggacagaggttggcacagcggtcactccgagggcagagggtggccgagccggctctgtccatgtcgccctnacgtaccccggngggtccctgacgactctcctgtgcagcctgttcgggttccaccgtcagtacacaagtacngtcgagcgtcgggccaccaggtcctacggagggggaaggctagggagtggtacttcgtacgtagttttactttacgtccgttacgggtaacgttaactactaaccgttacgtaaccggacgtaaccgggtaaccgttccgggttagggggaaccgggtacccttactttacccgaaacctttacgtaccgtaccggaaaagaaccggttaaccttaaaacttacccggaaaaacggtaaccgttacggggtttaactttaacccttaacccggttaaaactaaaacggtacggaaaaccgttaccggtacccggttaaaggaaccggtacccggtaccgtaacgtaccgggaaaccgttcccggggttaaccgtttaagttaacgtttaaccgggtgttaaggtaacgtaacgtaacctttaacctaaacggtttcccgaaacgggtccccggggtaccggttaaaccaacccggtttaaagttcggtaacccgttaacgggggtaccggtaacccggtaaccgggttaccctacggtaccccgtaccgttccgtaccctcggtacctacccccggtcgaaacccggtaccggtccccgttaccgtaccccgggttcccgttcccccggtcggtacccccggtacccttcggccccggtaccgggaccc

SEQ ID NO: 155368 - DNA, 723 bp, Homo sapiens
  misc_feature: GYAE6OF01C0A3T.22.11.A11.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtcggccctcacgtaccccggcgggtccctgaacgactctcctgtncacgtcctcgtcgggttcaccgtnacgtagacaagtacatgacgtcgttcggccnccgtacgccgtccggaaggggtaacgggcttagggcggtaggacttccgtacgttaggttatttacgtcgttacgggtacgtaacactataccgtacgcgtaacggtccgtacggaggtacggcgttactccactacgtcctaccgaaggtaacacctaacgtaccaaacgtacgacggttctaactctaacaaagtcgaaccgtntccgngaacgtacgacgtacgcgtaacgccggtacgttacgtacgttacgtgtacggtaagaaacgtacttaactaaaccgtccggtaaccgggaccggtacccgggtaacctaaccgtaacgttacgaacgtaccgggtacggaccgtaccggtaccgttaccggaccctccgtaccgtccctacgaccgtacccgtacccgaccggaccgtacctccgttacccgtccccgtaccggtcccggtacgccccttacgccgtccgtaaccgg

SEQ ID NO: 155369 - DNA, 734 bp, Homo sapiens
  misc_feature: GYAE6OF01ASTQJ.22.11.A11.1.454.CMB.1.raw
  modified_base (139)..(139): a, c, t, g, unknown or other
  misc_feature (139)..(139): n is a, c, g, or t
  modified_base (459)..(459): a, c, t, g, unknown or other
  misc_feature (459)..(459): n is a, c, g, or t
tcagacatacgcgtcacgaccggtgctcgatttagctacgactgcagggtgtacacctgtggttctcggggctgccctgtagggacagaggttgcacagcggtcactcccagggcagagggtcggccgagcccggcctntgtccatgtcggccctcactacccccggcgggtccctgagtactctcctgagcagtcctcgtgggttccaccgttcagtagaccaagtaccagtagacgtcgtcgggtcccgccagggtcctaccggaagggggaacggggcttagggaggttcggattccgtacgttaagtttacttacgttccgttaccggttaacggtaacacgtaacttaccgtccgactacggtccgtccgggtacggtacgggaccgtagttacccaccactccgtacgaacgtaacgacttaactacgaacgtaacgtacgtagtactctaanaacgtcgaacgtacgctaaggcgacgaccgataccgaccgaccggtacgttacgtacgttagtacgtagtagtacgtactaacgtaacgtaccgaccggtaccggtccggtaaccgtaaccgtacgtacgtaccgttacggtacggacgtaccggtaccgtacggtaccgtaccgtacgtaccgtacgtacccgtaccgacccgaccggaaccgcccggtaccgtcccgtacccgtttccccgccggtcccgtaccgccgtccgtccggtaccgg

SEQ ID NO: 155370 - DNA, 668 bp, Homo sapiens
  misc_feature: GYAE6OF01BCM7D.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataacccgcgggtccctgagactctcctgtgcagcctctgggttcaccgtcagtagcaagtacatgagcgtcgggtccgccaggctccgaggggagggctggagtggactctctagtttatttatcgttcggtaggtaaccactatactacgcacgtacgtccggtgggacggccgtattccaccactcctccaagacgtaacaacttaccaaagaaccgtacggtgtaatcttaacaaatacgaacacgcctagagacgccgatcgacgacggtccgttgttacttacgtgtacgtagaatactaacgtaaactaccgaacggcccggtaccggggtacctaaccgtaaacgtacgtaacgtaccggtacgggacccgtaacgggtacccgtggtacccgtaccgttcctccgtacgaccgtaccctacccgaaccgaccggacccctacgttccccggttaccccttcccccggtacggtccccgtacccgtccgtcccgttccggaccgg

SEQ ID NO: 155371 - DNA, 791 bp, Homo sapiens
  misc_feature: GYAE6OF01CQHAL.22.11.A11.1.454.CMB.1.raw
  modified_base (120)..(120): a, c, t, g, unknown or other
  misc_feature (120)..(120): n is a, c, g, or t
  modified_base (139)..(139): a, c, t, g, unknown or other
  misc_feature (139)..(139): n is a, c, g, or t
  modified_base (154)..(154): a, c, t, g, unknown or other
  misc_feature (154)..(154): n is a, c, g, or t
  modified_base (171)..(171): a, c, t, g, unknown or other
  misc_feature (171)..(171): n is a, c, g, or t
  modified_base (210)..(210): a, c, t, g, unknown or other
  misc_feature (210)..(210): n is a, c, g, or t
  modified_base (245)..(245): a, c, t, g, unknown or other
  misc_feature (245)..(245): n is a, c, g, or t
tcagacatacgcgtcacgaccggtgctcgatttagctacgactgcagggtgtacacctgtggttctcggggcttgccctgtagggacagaggttggcacagcggtcactcccagggcagngggtggccgagccggctcngtccatgtggccctnactacccgcgggtcccngacgactcctcctgtcgcagcctcgtgggttccaccgtnaggtacgactaagtcatgacgtccgtcgggtcccnccagggcctacggaagggggacgggctagggacgtggatctatacgtttattactcgtacggtagtacactataccgtacgctacgaccgtccggtggacgggtcctagttccaactcgtacctaccgtaaggtaccgtaactaacgttaccgaaaggtaaccgacggggtttacgtactttaaccgttaaacgaaaacgttcggaaaccgtacggtcccgtaggaaacggtacgtacccgtaagttcggaaacccgtcgggtaccgttaggttaacgttaccggtgttacggtacgaaagtaccgtaaccgtaaacgttcccggaaaacgggcccgggttacgggtaacccaaccgttaacggttacgtaaaccgtacggtaccgggtacccgaacggggttaaccctcgggtacctacccgttccgtaccgtacccgtaccgtcccttaaccgaacccggtaaccggtaccccttcggtttacccggttccccttacccccggtacggtaccccgtcccgtaccggtcccgtaaccggtacggg

SEQ ID NO: 155372 - DNA, 866 bp, Homo sapiens
  misc_feature: GYAE6OF01E3VYS.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggtagttttggctgagcttgggttttccttgttgctatttcaaaaggtgtccagtgtgaggtgcagctggtggagacgtgggaggagtccttgactccgacgccggtcgggggtccctgacgtaccttcctccgtgtgccgagccttcgtcgggttccaccgtacgaagtagacaagtacagtggacgccgttcgggtcccgccgtacggccgtaccggaagggggtaacggggcgtagggacgtaggtactcgtacgtagtttactttacgttccgttacggtacggtaaactacgtaacttaccgtaacgactaacggtacgttaccgggtacgggaccgggtacccgtacttacccgaacccttaacgtcccttaaccggaacgtaaaccgtaaaccgtaaacctttaacccgaaaacggtaaacccggttacgggttaacttaaccgtttaaccgttaaaccgtaaaagttaccggaaacctaaccgggtacccgttaagggtaacggtaaccgggtacccggtaaccggttaacgggaaccccggtaaccgggttacccgggtttaagttaaccgttttaacgggttacggttaccggtaaggtaaacggtaaaccttaaacccgttaaaaacccgtcccgggtaaacccgggtaccccgggggtaaccccggggtaaaccctaaaccccggttaaaagttcccgggtaaaccgttaccgggggtaaccccggggg

SEQ ID NO: 155373 - DNA, 960 bp, Homo sapiens
  misc_feature: GYAE6OF01D3WZ5.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggtagttttggctgagcttgggttttccttgttgtcttatttacgaaaaggtgtccagtgtgaggtgcagtcgtgggtggagacgtgggaggacgtccttgactccgaggcccggtgggggtcccctaggacgtaccttcctccgttggtcgacctacgccgttcggtcgggttaccctaccggtctaaggtacgtaaccgtaaaggtactagtacggtacggtccggttcggggtaccccgaccggtacggggtacccgtaccggggaaagggggggtaacggggtcggtacggggtagggttacggtactttccgttacgttaaagttttacgttttacggtaccggtttacgggttaacggttaaaccaacgttaacgttaacccgtaccggaccggtaacggtacccgttaccgggggtagggtacccgggtaacccgttacgttacccgaaccgttaacttcccgtaacccggaaagtaaccgtaaaccttaaaccccgttaaaccggaaaacggtaaacccggtttaccgggtttacgttaaccgtttaaccccgttaaaacgtaaaacgttacccgtaaaaccggtaccggtacccggtaaggggtaaacccggaccggtaaccggtaacgtaccgggaaaccgggttacccccggggtacgtttaacgtttaacgtttaccggttagggttacggtaaacggtaacgttaaacctaaaccggttaaaacccggttccgggaaaccccggggtcccgggtaaacccggggttaaccctaaaacccgttaggtttaaccccgtaacgggttacccggggaacccggggg

SEQ ID NO: 155374 - DNA, 746 bp, Homo sapiens
  misc_feature: GYAE6OF01D9FFT.22.11.A11.1.454.CMB.1.raw
  modified_base (236)..(236): a, c, t, g, unknown or other
  misc_feature (236)..(236): n is a, c, g, or t
  modified_base (385)..(385): a, c, t, g, unknown or other
  misc_feature (385)..(385): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgcttatttcaaaaggtgtcagtgtgaggtgcagctggtggagacgtggaggagccttgactccagccgtgggggtcccngagctctcctgtgcagcctcgtgggttcaccgtcagtaggcaagtacatgagcgtcgggtccgccgaggccgtaccgagggggagggcgtgggagtggactcgtcgtagtttatttagtcgtcggtaggtaacaactatacgtacgacngaccgtcggtgggacggccgtaacttccgaaccctacgtcccgtacccgtaaggaacgaaccttaaacgttaacccgaaaaacggtaacccgtacgggtttagttaacttaccgttactaaaacgttcgaaacccggtacgtacccgtaagggaacgtaccgggacccgtaaggtaccggaacccggtaacccggggttcgttaacggtttaacgtttaccggttcggttaggtaccggtaaaagtaacgttaaacctaaaacccggttaccggaaaccgggtccccgggggtacccgggtaaccctaaacccccggtaaaagttttaccgggaacccggtttacggtaaccccggggggg

SEQ ID NO: 155375 - DNA, 843 bp, Homo sapiens
  misc_feature: GYAE6OF01AG087.22.11.A11.1.454.CMB.1.raw
  modified_base (208)..(208): a, c, t, g, unknown or other
  misc_feature (208)..(208): n is a, c, g, or t
tcagacatacgcgtcacgaccggtgctcgatttagctacgactgcgaggggggggagaggagcccagcactgggattccgaggtgtttccattcggtgatcagcactgaacacagaggactcaccagtggtagttttggctgagtcgtttgggttttccttggttgtacttatttacgtaaaaggtgtccaggtgtggaggtgcaggngtgggtggagtacgtgggaggagtccttgactccgacggtcccgggttcggggggtccctaggacgtacctccgttccgtgtcgccgacgtccgttccgttcgggtcctaccggtcaggtacgactaaacgtacgtagtacggacgtccggtccgggtcccgacggacggtccggaccgggaggggtaacggggtcgtacgggtaggtacgttagtaccgtttagttaacgtttttattacggttaccggtttacggtaacggtaaaccactaacgtaaccgtacgtacgtaaccggtaccggtccgggtacggggtacggaacccgtacttacccgactaccgtaccgtaccgaacggtaactaacgtaacctaaccgaaagtaacccgtacgggttacttacctaaacgtaactaaactacgtaacgaccgtacgaacggaacgtacccggacgtacgtaaccggtcccggtaacgttcggttaacgtacgttaccggtggttagttaacggaaacgttaacgttaaacccgtaaacccggttaaccccggtaccggggaccgggtttacccggggtaaaccttaacccgggttaacgttaacccggttaacggtacccgggttaaccccggg

SEQ ID NO: 155376 - DNA, 848 bp, Homo sapiens
  misc_feature: GYAE6OF01DROHJ.22.11.A11.1.454.CMB.1.raw
  modified_base (462)..(462): a, c, t, g, unknown or other
  misc_feature (462)..(462): n is a, c, g, or t
tcagacatacgcgtcacgaccggtgctcgatttagctacgactgcagggtgtacacctgtggttctcggggctgccatggtagggacagaggttggcacagcggtcacctcccgaggcaggagggtggccgacgcccggcctctgtccagtgtcgccctcacgtccccggccgggtccctgacgtacctcctccgtgtcgcacgtccttcgtcggttccaccggtcaggtacgactaaagtacagtggacgtcgtcgggcccgcgacggccgtaccggaaggggacggggctagggagtcggacttctcgtaagttttactttacgtcggttacggtacgtaaactactacgttacgtacgactacggtaccgtcggtacgggacggtcctacttaccaacgtctcctaccgaagaactacctaactaccgaaacgaacgtcggttataacttaccgtaaanaaaacgtcgaaagtacccgtcggtaagaaagtaccggacgtaactaacggtacccggtacggttcccgttaagtttaaccgtttacggttagtaggttaacgtaaaggttaacctaaaaccgttaaacccgttacggtaaacccgggtccccggggttaacgggtaaaccccttaaacccgtaagtttaccgggttaaaccggtaccgggtacccggggtaacccgaaaccgggttacccggttccggtacccgtaccggttcccctaccgtaccgtacccgtccccgtaacccgtaaccggtacccggttacccccgtaggttaccccccggttcccctccccgggttacggaccccttccccggaacgtcccccgtaaccgggg

SEQ ID NO: 155377 - DNA, 841 bp, Homo sapiens
  misc_feature: GYAE6OF01A8BO8.22.11.A11.1.454.CMB.1.raw
tcagacatacgcgtcacgaccggtgctcgatttagctacgactgcgagggggggagaggagcccagcactgggattccgaggttgtttcctattcggtgatcagcactgaacacagaggactcaccagtggtagttttggctgagtcttgggttttccttgttgcttatttacgaaaaggtgtccagtggtaggaggtcgacgagtcgtggtggtacgacgtgggacggtacgtccgtgactccgacggtccggtcgggggtcctgacgtacctccgtccgtgtcgcgtacgtccgttcgttcgggtacctccgtacgtaggtacgtaacgtaagtacgtagtcgtacgtccggtccgggtccgaccggtcggtaccggtacgggaggggtacgggacggtgggtacggtcggtaccgttacgtaagttttacgttacggtacggtacggttaagtaaccgtacgtaactaccgtacgacgtaacggtacggtaccgggtacgggtaccgggtactaaccgtaccgtaccgtaaccgttccggtaacctaacggtaacgtaaccctaaaccggttacccgaaaaacgggtacccgttaggttaacgtacctttaaccgtaacgaaacgttaaccggaacctaacggtcccggtaaggaaccgtaccggtaacccgtaggtaaccggtaacccggttcccgggttagttacgttagttaccggtaggttacgttacggaaaatacccgtttaaacgaaccgggtaccggacgggttaccgggaacccggtttacctaaacggtagttacccgggtacgtaacggggtcccggtaaacccggg

SEQ ID NO: 155378 - DNA, 724 bp, Homo sapiens
  misc_feature: GYAE6OF01A47CO.22.11.A11.1.454.CMB.1.raw
  modified_base (584)..(584): a, c, t, g, unknown or other
  misc_feature (584)..(584): n is a, c, g, or t
  modified_base (592)..(592): a, c, t, g, unknown or other
  misc_feature (592)..(592): n is a, c, g, or t
tcagacatacgcgtcacgaccggtgctcgatttagctacgactgcagggggggagaggagcccagcacgtgggattccgaggtgtttccattcggtgatcagcactgaacacagaggactcaccagtggtagttttggctgagtcgttgggtttttccttgttgtcttagtttacgaaaaggtgtccgtaggtgtgaggtgcgagtcgtgggtggagacgtgggaggtacgtccgttagactccgacggtccggttcggggggtccctaggacgtaccttccgtcgtgtcgcgtacgtccgtgttcggtacctaccggtagagtacgacgtaaagtcagtacggacgtccggtcggccggccgacggtccgtaccggaggggacggtcggtaggtacggtgtacttacgtacgttagtttaacgttcggtacgttacggtacgtaaactacgtagtacacgacgtacgtacggtcggtacggcggtcgtaactcgactacgtcacgaagacgtaaccaacgttacgaagtaccgtagtactattacgaaacagtacgaagctacgagacgtacgacgtagacgngttaccgngttagttacctaggttcgtaggaacttaacgtacgttaaacccgtaaacgtacccgggtaacccgggaacccggttaccggtaaaccttaacccgttaaggtcccgttaaaccggtccggggtaaacccggg

SEQ ID NO: 155379 - DNA, 780 bp, Homo sapiens
  misc_feature: GYAE6OF01ENT3R.22.11.A11.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
tcagacatacgcgtcacgaccggtgctcgatttagctacgactgcagggtgtacacctgtggttctcggggctgccctgtagggacagaggttggcacagcggtcactcccagggcaggagggtgggccgagccggcctctgtccatgtggccctcataccccgcgggtccctgagactctcctgtgcagcctntgggttcaccgtcagtagcaagtacatgagtctgggtccnccaggcctccgaggggaagggctgggagtggatcgtcagtttacttatcgtcgagtacggtaacactatacctacgcaagtaccgtcggtagggacggccgtattccgaacctattacccgtaccaacggaacgtaacctaaacgttaacccgaaaacggtaaccgtaacggggttacgttaacttcctttaaacgaaaattacgaaaacgacgtcccgtaaggaacggtacggacccgtaagtaccgaaccggtaaccgggtaccggttacggtttaaacgtttacgtagggttagtacggtaacgtaacttaaaccgtaaaacgttacccggaacgggtaccccgggtaccggggttaaccctaacccgtaaagttaccgtaaccgttacgggtaccggggaacccgtacgggtaacccgtcggtaccgtacccgtcctacccgtacgaacccggtacccgtacccgtaaccggacccggccccgttacgttccccggttccccgttccccggtcggtcccgtcccgtccgtcccggtacccgg

SEQ ID NO: 155380 - DNA, 539 bp, Homo sapiens
  misc_feature: GYAE6OF02HKP2V.22.11.A11.1.454.CMB.1.raw
  modified_base (236)..(236): a, c, t, g, unknown or other
  misc_feature (236)..(236): n is a, c, g, or t
tcagacatacgcgtcacgaccggtgctcgatttagctacgactgcagggtgtacacctgtggttctcggggctgccctgtagggacagaggttggcacagcggtccacgtcccagggccaggagggtgggccgagccggcctctgtccatgtggccctcataccccgcgggtccctgagactctcctgtgcagcctctgggttcaccgtcagtagcaagtacatgagctgggtccnccaggctccaggggaaggggctgggagtggatctcagttatttatctcggtggtaacacatactacgcagactccgtggagggccgattcaccatctccagagacaaattccaaagaacacggtgtaatcttcaaaatgaacagcctgagagccgatgacacggccgtgtattactgtgtgagatcaaaattccaagccgcggggtcacccaaattgactactgggccaggaaccctggtcacgtctcctcagcctccaccaacggcccatccggtcttcccctggccgccctgcctccacgg

SEQ ID NO: 155381 - DNA, 538 bp, Homo sapiens
  misc_feature: GYAE6OF02IZ9YP.22.11.A11.1.454.CMB.1.raw
  modified_base (288)..(288): a, c, t, g, unknown or other
  misc_feature (288)..(288): n is a, c, g, or t
  modified_base (353)..(353): a, c, t, g, unknown or other
  misc_feature (353)..(353): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgggactctcctgtgcagcctctgggttcaccgtcagtagcaagtacatgagctgggtccgccaggctccagggaaggggctggagtggatctcagttatttatctcggtggtaacncatactacgcagactccgtggagggccgattcaccatctccagagacaattccaagaacacggtntatcttcaaatgaacagcctgagagccgatgacacggccgtgtattactgtgtgagatcaaaattccaagccgcggggtcacccaaatgactactgggccagggaaccctggtcaccgtctcctcagcctccaccaacgggcccactccggtccttcccctcggccgccctcgcctccgaggacg

SEQ ID NO: 155382 - DNA, 534 bp, Homo sapiens
  misc_feature: GYAE6OF02HHBMB.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgagggaaggggctgggagtggatctcagttatttatctcggtggtaacacatactacgcagactccgtggagggccgattccaccactctccagagacaattaccaagaacacggtgtattcttacaaatgaacagcctagagagccgatgacacggccgtgtattactgtgtgagatacaaattaccaacgccggcggggtaccacccgtaattacgacctacgtacgggg

SEQ ID NO: 155383 - DNA, 537 bp, Homo sapiens
  misc_feature: GYAE6OF02FV3QE.22.11.A11.1.454.CMB.1.raw
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccagggaagggctggagtggatctcagttattatctcggtggtaacacatactacgcagactccgtggaggccattcacatctccagagacattccaaagacacggtgtatcttacaaatgaaacagcctgagagccgatcgacacggccgtgtattactgtgtgagatacaaattcaagcgcggggtcaccaatgactacgtcgggcacggacccgtgtcaccgtctcctcacgcctccgaaccgaacggacccacgtccggtccttccccgtcggcccgccctcgtcctccgacgg

SEQ ID NO: 155384 - DNA, 733 bp, Homo sapiens
  misc_feature: GYAE6OF02HVCJ2.22.11.A11.1.454.CMB.1.raw
tcagacatacgcgtcacgaccggtgctcgattttagctacgactgctaggggttgggtacaacctgtggttctcggggctgccctggtacgggacaggaacggttggcgaaccagcggtcactccctagggctacgacgggtgggccgagccggcgtctcgtccaactcggtggccctctataccccgtcggggtcccctgagtacctcctccgtcgtacgctacgttcctcttcgggttcgaccgtcagtacgcctaacgttaccagtcggacgcgttcgggtaccgtccgtaacgggcctacccgaggggtaacggggccttggggaacgtggacttacgtacctaggtttactttaagtcctccggtaggtaaccacctataactaccgacaagtacttcgttcggacgggaccggacgtttccgaccatccctacagaggtacaagttccaagaacgcgggttagtagtaccttacaaacttcgaactacgtcctacgagtacgacgactacgactacggccgttacgtagttacgttgttgtacgagtatactaaacttcgacgaccggtacgggtactaaccgtaagttacgtacctaacccgtcgggaccctaacgggtacccgtgtacccggacctccgtacctccgacgtaccctaccgtaacccgaacggccctagttcccggtccttccccgtcggaccgtcccgtcgtccctccgtaccgg

SEQ ID NO: 155385 - DNA, 532 bp, Homo sapiens
  misc_feature: GYAE6OF02G35T4.22.11.A11.1.454.CMB.1.raw
  modified_base (233)..(233): a, c, t, g, unknown or other
  misc_feature (233)..(233): n is a, c, g, or t
  modified_base (477)..(477): a, c, t, g, unknown or other
  misc_feature (477)..(477): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccnccaggctccgagggaaggggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcggggtcaccaatgactactgggccagggaccctgtcaccgtctcctcncgcctccaccaacggcccagtccggtcttccccgtcggccgccctcgctccacgg

SEQ ID NO: 155386 - DNA, 585 bp, Homo sapiens
  misc_feature: GYAE6OF02IRNEV.22.11.A11.1.454.CMB.1.raw
  modified_base (231)..(231): a, c, t, g, unknown or other
  misc_feature (231)..(231): n is a, c, g, or t
  modified_base (349)..(349): a, c, t, g, unknown or other
  misc_feature (349)..(349): n is a, c, g, or t
  modified_base (417)..(417): a, c, t, g, unknown or other
  misc_feature (417)..(417): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctggtccncaggctccgaagggagggctggagtggatctcagttatttatctcggtagtaacacatactacgcagactcgtggaggccattcaccatctccagagacaattccaaagaacacggtntatcgttacaaatgaaacagcctgaacgagtaccgattagacacggaccgtgtaattactagtgtganatacaaaattaccgaagccgcggggtacaaccgtaaattacgtaactacgtcgggaccaacgggtaaccctgtaccgtaccgtctcctacgacgacctaccgaaccgaacgggcccaagttcccggtaccttcccccgtcggtcccgtcccgtcgtcctaccgtacgg

SEQ ID NO: 155387 - DNA, 541 bp, Homo sapiens
  misc_feature: GYAE6OF02H4NLM.22.11.A11.1.454.CMB.1.raw
  modified_base (232)..(232): a, c, t, g, unknown or other
  misc_feature (232)..(232): n is a, c, g, or t
  modified_base (454)..(454): a, c, t, g, unknown or other
  misc_feature (454)..(454): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaaggggctggagtggatctcagttatttatctcggtggtaacacatactacgcagactccgtggaggccgattcaccatctccagagacaattccaagacacggtgtatcttcaaatgaaacagacctagagagccgatcgacacggccgtgtattactgtgtgagatacaaaattccaagccgcggggtcacccaattagactacgngggaccagggaaccctggccacgtctcctcacgcctccaccacggcccacgttccgccttccccgtcggccgccctgcctccgacgg

SEQ ID NO: 155388 - DNA, 588 bp, Homo sapiens
  misc_feature: GYAE6OF02HKSFV.22.11.A11.1.454.CMB.1.raw
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataacccgcgggtccctgagactctcctgtgcagcctctgggttcaccgtcagtagcaagtacatgagctgggtccgccaggctccgaggggaagggctggagtggatctcagtttatttatctcggtggtaacacatactacgcagactccgtgggacggccgattcaccntcncaganacaattccaaagaacncggtatatcttacaaatgaaacngctgagagccgatgacacgcgtgtatactgtgtagagatacaaattaccgaacgacggccggggtacaacccgaaagttacgaaccgtacgtacgggaccgaacgggtaacccgtcgtaccgaccgtacctcctccacgccctacccgaaccgaaccggcccacgtccggtacccgttcccccgtacggcccgtcccgtctccgtaccgtacgg

SEQ ID NO: 155389 - DNA, 569 bp, Homo sapiens
  misc_feature: GYAE6OF02JIZNK.22.11.A11.1.454.CMB.1.raw
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctgggagtggatctcagttatttatctcggtggtaacncatactacgcagactccgtggagggccgattcaccatctccagngacaattccaagaacacggtgtancttcaaatgaacagcctgagagccgaatgacacgccgtgtattactgtgtgagatacaaattcaagccgcggggtcaccaattagactactcggggaccagggaacccgtggtacaccggtctcctccacgcctccacccgtaacgggcccgtaactccggttaccttccccccgttacgggcccgccccgtacggtccctcccgtaacggg

SEQ ID NO: 155390 - DNA, 553 bp, Homo sapiens
  misc_feature: GYAE6OF02G0ONO.22.11.A11.1.454.CMB.1.raw
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
tcagacatacgcgtcacgaccggtgctcgatttagctacgactgcagggggggaggaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtcccctgagactctcctgtgcagcctctgggttcaccgtcagtagcaagtacatgagcgtgggtcccgccaggctccgaggggaaggggctgggagtggatctctagttattanctcggtgtaacacatactacgcagactcgnggacgggccgattcgaccatctcagagacaattaccaagaacacggtagtattacttacaaatacgaacacgccagtagacgaccgatacgacacggccgtgtactacgtgtgtagagaatacaaattaccaacgtccggaccggggtaccaacccgtaaatcgtaccgtacgtacgggg

SEQ ID NO: 155391 - DNA, 552 bp, Homo sapiens
  misc_feature: GYAE6OF02I7PXP.22.11.A11.1.454.CMB.1.raw
  modified_base (232)..(232): a, c, t, g, unknown or other
  misc_feature (232)..(232): n is a, c, g, or t
  modified_base (353)..(353): a, c, t, g, unknown or other
  misc_feature (353)..(353): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgaggggaagggctggagtggatctcagttatttatctcggtgtaacacatactacgcagactccgtggacggccgattcaccatctccagagacaattccaaagacacggtntatcttacaaatgaaacagcctagagagccgatcgacacggcgtgtattactgtgtgagatacaaattacaagccgcgggacaccaatgactacgtcgggaccgacgggaacctcggtaccaccgtctccctcacgccctccaaccgaacggccctacgtccggttcccttccccgtcggccgccctcgcctccgacgg

SEQ ID NO: 155392 - DNA, 551 bp, Homo sapiens
  misc_feature: GYAE6OF02GWT2E.22.11.A11.1.454.CMB.1.raw
  modified_base (232)..(232): a, c, t, g, unknown or other
  misc_feature (232)..(232): n is a, c, g, or t
  modified_base (413)..(413): a, c, t, g, unknown or other
  misc_feature (413)..(413): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaaggggctggagtggatctcagttattatctcggtgtaacacatactacgcagactccgtggacgggccgtattcaccatctccagagacaattccaagaacacggtgtatcttacaaatgaacagcctgagagccgaatcgacgacggcgtgtattactgtgtganatacaaattcagcgcgggtacacctaatgactacgcggacgacggaccgtgtccgacgtcctcctcacgccctaccgaccgaacggccctagtccgttcccttaccccgtggcccgtcccgtcgtccgtccgaaccgg

SEQ ID NO: 155393 - DNA, 555 bp, Homo sapiens
  misc_feature: GYAE6OF02HAVQW.22.11.A11.1.454.CMB.1.raw
  modified_base (232)..(232): a, c, t, g, unknown or other
  misc_feature (232)..(232): n is a, c, g, or t
  modified_base (351)..(351): a, c, t, g, unknown or other
  misc_feature (351)..(351): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataacccgcgggtccctgagactctcctgtgcagcctctgggttcaccgtcagtagcaagtacatgagctgggtccnccaggctccagggaagggctggagtggatctcagttatttatctcggtggtaacacatactacgcagactccgtggaggccattcaccatcctccagagacaattccaagaacacggtntatcttacaaatgaaacagcctagaagagccgaatcgacgacggccgtagtactactgtgtgagatacaaattccaagccgcggggtacaccaattcgactacgtagggccacggaacctggtacaccgtcctcctcacgcctcccgaaccgaccggaccacgtccgtccgttccccgtcggcccgcccgtcgtcctccgacgg

SEQ ID NO: 155394 - DNA, 582 bp, Homo sapiens
  misc_feature: GYAE6OF02JEFPW.22.11.A11.1.454.CMB.1.raw
tcagacatacgcgtcacgaccggtgctcgatttagctacgactgcagggggggaggaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttccacgtcagtagcaagtacatgagctgggtccgccaggctccgaggggaaggggctgggagtggatctcgagtttatttatcgtcggtaggtaacacatactcgcagacctccggtaggagggccctattccaccatctaccagacgacaacttaccaagaaccgacggtagtacttacttactaaactagaacacgacctgagacgaccgagtagacgacggccgtagttacttacgtgtgtagagataactaaacttaccgaacgtacccgggaccgggggtaccaacccgtaaagttacgtaccgtacggtaccgggg

SEQ ID NO: 155395 - DNA, 545 bp, Homo sapiens
  misc_feature: GYAE6OF02GCFD3.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaaggggctggagtggatctcagttatttatctcggtggtaacacatactacgcagactccgtggaggccgattcaccatctccagagacaattccaagaacacggtgtatcttcaaaatgaaacagccctgagagccgatgacacggccgtgtattactgtgtgagatacaaattccaagccgacggggtcacccaaattgactacgtgggccgacgggaccctggtcaccgtctcctcacgcctccgaaccacggcccacgtccgtccttccccgtcggccgcccgtcgcctccgacgg

SEQ ID NO: 155396 - DNA, 694 bp, Homo sapiens
  misc_feature: GYAE6OF02IRBRG.22.11.A11.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
tcagacatacgcgtcacgaccggtgctcgatttagctacgactgcaagggtgtacacctgtggttctacggggtctggccctggtagggacagaggttcggcgacagcggtcactacccagggccagagggtgggccgagccggcctctgtccatgtggccctcataccccggcgggtccctgagactctcctggtgcagcctntgggttcaccgtcagtaggcaaggtacagtgacgctgggtccnccaggcctccgaaggggacgggctgggacgtcggatcctccagttacttactcgtcggtcggtaaccacatactacgcaggaccgtccggtgggacgggccgattcaccatctccagacgacaattccgaaagtacgacgggtgtatccgttacaaaagtgaaacagcctgagagccgatcgacacggcgtgtattactgtgtgagatacaaacttacgaacggccggacgggggtaccaacccgtaaagttacggaaccgttacggtacggggtaccgaacggggtaacccgttcgggtaccgtacccggttaccgtcccttaccgaccgtacccgttacccgaacccgaaccggggtaccccgtaaccggttacccgggttacccgtttaccccccggtacgggtccccggtcccccggtaccggtcccgtaccccggtaacggg

SEQ ID NO: 155397 - DNA, 574 bp, Homo sapiens
  misc_feature: GYAE6OF02JA897.22.11.A11.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (396)..(396): a, c, t, g, unknown or other
  misc_feature (396)..(396): n is a, c, g, or t
tcagacatacgcgtcacgaccggtgctcgatttagctacgactgcaggggggggagaggagcccagcactgggattccgaggtgtttccattcggtgatcagcactgaacacagaggactcaccatggagttttggctgagcgtggtttccgtgttaggctattacaaaaggtgtccagtgtgaggtgcagctggtggagactggaggagccttgatccagccgtggggggtccctgagctctcctgtgcngcctntgggttcaccgtcagtagcaagtacatgagctcgggtccgccgaggctccgaggggaacggggcgtgggagtggatcctcagtttatttatcgtcggtgtaacacatactacgcagactccggtggacggccgattcacntctaccagacgacaattccaagaacacgtgtattcgttacaaatgaacacgacctgagacgaccgatcgaccgtacgggtccgtagttacttacgtgttgtagaggacttaacaaagttcccgaaggtcccgggtcggggtacctaaccgtaaagttcgaccgttacggtacccgggg

SEQ ID NO: 155398 - DNA, 599 bp, Homo sapiens
  misc_feature: GYAE6OF02HP0DC.22.11.A11.1.454.CMB.1.raw
  modified_base (232)..(232): a, c, t, g, unknown or other
  misc_feature (232)..(232): n is a, c, g, or t
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggagggctggagtggatctcagttatttatctcggtgtaacanatactacgcagactccgtggacggccattcaccatctccagacgacaattccaagaacacggtntatctacaaatgaacngcctgagacgccgatcgacgacggtcgtgtatactgtgtagagatacgaagtaacttaccgaacggtccggacggggtaccaacccgtaaagttcgaaccgttacggtcggggacccgaacgggtaacccgtcggtaccacccgtcctcccgtcgaccgtcccgtacccaccgaaccgggccctaccgttccggtcccttccccgtccggtcccgcccgtcgccctacccgg

SEQ ID NO: 155399 - DNA, 666 bp, Homo sapiens
  misc_feature: GYAE6OF02GR7AP.22.11.A11.1.454.CMB.1.raw
  modified_base (232)..(232): a, c, t, g, unknown or other
  misc_feature (232)..(232): n is a, c, g, or t
  modified_base (334)..(334): a, c, t, g, unknown or other
  misc_feature (334)..(334): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggagggctggagtggatctctagttattatctcggtagtaacacatactacgcagactccggtggacggcctattccaccatctacaganactaatccaagacgacggtatactctacaatcgaacacgctagagacgaccgatacgacgacggtacgttagtaacttacgtaggtagtagtaacgtaactaactaaacgttaccgaacgggtcccgggtaccggggtaaccaaaccgtaaagttcgaacgttaccgggtacgggaccgtaaccgggtacccgttacggtaccctacccgttcctacccgtcgacccgtacccgtacccgaaccggtaacccgggtaccctaccggttccccggttcccgttacccccggtcgggtcccccgtacccgtaccggtacccgtaccggaaccgg

SEQ ID NO: 155400 - DNA, 561 bp, Homo sapiens
  misc_feature: GYAE6OF02FVUHR.22.11.A11.1.454.CMB.1.raw
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaagggctggagtggatctcagttatttanctcggtgtaacacatacctacgcagactccggtggagggccattcaccatcctccagagacaattccaaagacacggtntatcttacaaatgaacngcctgagagccgatcgacacgcgtgtatactgtgtgagatactaaattccaacgccggcggggtacaaccctaaattgactacgtgggaccgacgggaaccctcggtaccaccgtcctcctcacgcctaccgaaccgaacggcccacgttccggtccttccccgtcggcccgtccctcgtcctccgacgg

SEQ ID NO: 155401 - DNA, 563 bp, Homo sapiens
  misc_feature: GYAE6OF02HTX52.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtggggggtccctgagactctcctgtgcagcctctgggttcaccgtcagtagcaagtacatgagctgggtccgccaggctccgaggggagggctgggagtggatctcgtagttatttatcgtcggtggtaacactatactacgcagactccggtaggagggccgtatcacatctccagagacaattccaaagaacacggtatatcgttacaaatgaaacagcctagacgacgcgatgacacggtccgtagtaacttcgtagtgtagagtaactaaccaaaagttcccgaaaggtccggtacggggtaccaacccgtaagtttcgaccgtacgtaccggggg

SEQ ID NO: 155402 - DNA, 565 bp, Homo sapiens
  misc_feature: GYAE6OF02GSWL1.22.11.A11.1.454.CMB.1.raw
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccaggggaaggggctggagtggatctcagttatttatctcggtggtaacacatactacgcagactccgtggagggccgattcaccatctccagagacaattccaagaacacggtgtatcttcaaatgaacagcctgagagccgatcgacacggcgtgtattactgtgtgagatacaaattaccaagccggcggggtacacccgaaattcgactacgtcggggacccaacgggaacccgtggtaccaccgtcctcctcacgccctccgaaccgaacggcccacgtccggtcccttccccgtcggcccgcccgtcgccgtccgaacgg

SEQ ID NO: 155403 - DNA, 720 bp, Homo sapiens
  misc_feature: GYAE6OF02ITW32.22.11.A11.1.454.CMB.1.raw
  modified_base (296)..(296): a, c, t, g, unknown or other
  misc_feature (296)..(296): n is a, c, g, or t
tcagacatacgcgtcacgaccggtgctcgatttagctacgactgcaggggggaggaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagcctgggggtaccctgagactctcctgtgcagcctctgggttcaccggtcaggtagcaagtacatgagctgggtccnccgaggctccgaggggaagggctggagtgggatctctaggtttattagtcgtacgggtggtaaaccacattaccgtaacggctaaggtaaccttcccggtagggacgggcccgtatttccgaacctaacgtccgtacccgaggaacggtaacctaaacgtttacccgaaaacggaaaccgtaaccggggttacgttaacgttaccttttaaccgaaaacgttacgaaaccgtacggtacccttaggaaacggtaccgtacccggtaattacggaaccgtaaccgggttcccggttaaggttaacgtttaacgttccggttaggttacggtaacggtaacttaaaccgtaaaactttaccggaacggtacccgggacgggggttaccaaccccgttaaagttacgtaccgtacgtaacccggggg

SEQ ID NO: 155404 - DNA, 552 bp, Homo sapiens
  misc_feature: GYAE6OF02GE27Q.22.11.A11.1.454.CMB.1.raw
  modified_base (276)..(276): a, c, t, g, unknown or other
  misc_feature (276)..(276): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccaggggaaggggctggagtggatctcagttatttanctcggtggtaacacatactacgcagactccgtggagggccattcaccatctccagagacaattccaaanaacacggtntatcttacaaatgaacagcctgagagccaatgacacggcgtgtattactgtgtgagatcaaaattccaaagccgcggggtacacccaaattcgaactacgtcgggaccacgggaaccctggtccaccgtcctccgtacacgcctccgaaccgaacggcccactccggtcctccccgtcggccgccctcgctccgacgg

SEQ ID NO: 155405 - DNA, 552 bp, Homo sapiens
  misc_feature: GYAE6OF02HYPJF.22.11.A11.1.454.CMB.1.raw
  modified_base (466)..(466): a, c, t, g, unknown or other
  misc_feature (466)..(466): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccaggggaaggggctgggagtggatctcagttatttatctcggtggtaacacatactacgcagactcgtggacgggccgatttcaccatctaccagagacaattccaaagaacacggtagtatacctttacaaatcgaaacagacctagaagagccgaatcgaacncggccgtgtacttatgtagtgaggtatacgaaaattccaacgcccggacggggtaccaacccgtaaattcgacgtacgtaccgggg

SEQ ID NO: 155406 - DNA, 605 bp, Homo sapiens
  misc_feature: GYAE6OF02FZ815.22.11.A11.1.454.CMB.1.raw
  modified_base (232)..(232): a, c, t, g, unknown or other
  misc_feature (232)..(232): n is a, c, g, or t
  modified_base (375)..(375): a, c, t, g, unknown or other
  misc_feature (375)..(375): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccaggggagggctggagtggatctcagtttattatcgtcggtggtaacactatactacgcagtacctccggtgggaggtccgatccaaccattcctccaagagactaacttccaaagaacacgggtatatcttaanaaatgaaacagcctgagacgccgatcgacacggcgtagtacttactgtgtagagactacaaacttacaggtccggcggggtaccacctaagtcgactacggtcgggaccgaacgggtaccgtgtaccgtaccgtccgtaccgtacaccgtccctacccgaacgaaccgggaccctaccgttcccggttacccttcccccgtcgggtcccctcccgtcgcccgtccgacgg

SEQ ID NO: 155407 - DNA, 570 bp, Homo sapiens
  misc_feature: GYAE6OF02HJ147.22.11.A11.1.454.CMB.1.raw
  modified_base (232)..(232): a, c, t, g, unknown or other
  misc_feature (232)..(232): n is a, c, g, or t
  modified_base (354)..(354): a, c, t, g, unknown or other
  misc_feature (354)..(354): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaggggctggagtggatctcagttatttatctcggtggtaacacatactacgcagactccgtggaggccgattcaccatcctccagagacaattccaaagaacacggtntatcttacaaatgaaacagcctgagagccgatcgacacggcgtgtattactgtgtgagatacaaattaccaagccggacggggtaccaaccaaattcgacttacgtcgggaccgaacgggaacccgtcggtacctaccgtcctcctccacgcctacccgaaccgaaccggcccacgtccggtcccttccccgtcggccgcccgtcgcctccgacgg

SEQ ID NO: 155408 - DNA, 538 bp, Homo sapiens
  misc_feature: GYAE6OF02FMPFJ.22.11.A11.1.454.CMB.1.raw
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgagggaaggggctggagtggatctctagttattatctcggtgtaacacatactacgcagactccgtggacgggccattcaccatctccagagacaatccaagaacacggtgtatctacaatagaacagcctgagacgaccgatacgacgacggcgtgtattactgtgtgagtatactaaactaccgaacgccggacggggtaccaacccgtaagttacgtacgtacggtacgggg

SEQ ID NO: 155409 - DNA, 544 bp, Homo sapiens
  misc_feature: GYAE6OF02HAH06.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccagggaagggctggagtggatctcagttatttatctcggtgtaacacatactacgcagactccgtggaggccgattcaccatctccagagacaattccaagaacacggtgtatcttacaaatgaaacagcctgagagccgatgacacggccgtgtattactgtgtgagatacaaattccaagccgcggggtacacccaattcgactacgtgggccagggaccctcggtccgaccgtcctcctcacgcctccaccgaacggcccagtccggtccttcccccgtggcccgcccgtcgcctcgacgg

SEQ ID NO: 155410 - DNA, 556 bp, Homo sapiens
  misc_feature: GYAE6OF02HEHTP.22.11.A11.1.454.CMB.1.raw
  modified_base (351)..(351): a, c, t, g, unknown or other
  misc_feature (351)..(351): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgcaggctccgagggaagggctggagtggatctcagttatttatctcggtgtaacacatactacgcagactccgtggagggccattcaccatctccagagacaattccaaagaacacggtntatcttcaaaatgaaacagcctagagagccgatgacacggccgtgtatactgtgtgagatacaaattccaagccgcggggtacaccaattgactacgtgggaccacgggacctggtccaccgtctcctccacgcctaccgaccgaacgggcccacgttccggtccttcccccgtcggtcccgtccccgtcgtcccgtccgtacgg

SEQ ID NO: 155411 - DNA, 599 bp, Homo sapiens
  misc_feature: GYAE6OF02GTH43.22.11.A11.1.454.CMB.1.raw
  modified_base (232)..(232): a, c, t, g, unknown or other
  misc_feature (232)..(232): n is a, c, g, or t
  modified_base (363)..(363): a, c, t, g, unknown or other
  misc_feature (363)..(363): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccncaggctccgaggggagggctggagtggatctcagttattatctcggtggtaacacatgctacgcagactccggtggaggccgattccaccatcctaccagacgacaattccaagaacacggtatatcttanaaatgaacagcctgagacgcgatgacgacggtccgtgttaacttacgtgttgtagagtataactaaacttaccgaacgccggacggggtacctaacccgtaattcgtaacgttacgtacggggaccgacgggtaacccgtcggtaccaccgtaccctcctaccacgtccctcccgaaccgacgggcccgtacgtccggttcccttcccccgtcggcccgtccctccgccctaccgg

SEQ ID NO: 155412 - DNA, 588 bp, Homo sapiens
  misc_feature: GYAE6OF02GA02G.22.11.A11.1.454.CMB.1.raw
  modified_base (232)..(232): a, c, t, g, unknown or other
  misc_feature (232)..(232): n is a, c, g, or t
  modified_base (573)..(573): a, c, t, g, unknown or other
  misc_feature (573)..(573): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggcctccaggggaaggggctggagtggatctcagtttattatctcggtggtaacacatactacgcagacctccggtggacgggccgattcatcatctccagagacaattcccaaagaacacggtagtatcttacaaaatgaaacagcctagagacgccgatacgacacggccgtagtacttactgtgtgagatactaaaacttccaacgccggacggggtaccaacccgtaaagttcgaacgttacgtcggggaccgacgggtaacccgtggtccaccgtctcctcacgcccgtccaaccggacggccctacgtcccggtcccttccccgtcggcccncccgtcgcctaccgg

SEQ ID NO: 155413 - DNA, 637 bp, Homo sapiens
  misc_feature: GYAE6OF02I5PEL.22.11.A11.1.454.CMB.1.raw
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctgggtggagtcgtggggggaggcttggtacagccgtggggggtccctgagactctcctgtgcagcctctggattcacctttagctaattatgccatgagcgtgggtccgccaggctccgaggggaaggggctgggaggtgggtctcgagcttggttaggtggtggtgagtgggtggcacatacgtacgcagacctccggtaggaacggggtcccggtttacacctacgtcctaccgagaacgaactaacttaccaaacgaacctaaccctataacttatacgaacaaagtacgaactacgacctaggaacgacgaacccggaaagaccgaaccgggtacccgtaaacttaaccgttacgtacgggtaggaaccgggaaggggtcgtaaggaagtaacggacgtaacgacgtacgtccgttaggtttaactaggttaacttaacccg

SEQ ID NO: 155414 - DNA, 564 bp, Homo sapiens
  misc_feature: GYAE6OF02JJAAL.22.11.A11.1.454.CMB.1.raw
  modified_base (271)..(271): a, c, t, g, unknown or other
  misc_feature (271)..(271): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctgggggtccctgagactctcctgtgcagcctctgggttcaccgtcagtancaagtacatgagcgtgggtccgcaggctccgaggggaaggggctgggagtgggatctacagtttattatcgtcggtaggtaaacacgatactacgcagactccgtggacggcgattcaccatctcagacgacaactaccaaagaacacggtagtactcgttacaaatgaaactagcctagaagacgaccgatacgacgacggcgtagtattacgtgtgtagagtactaacaaacttaccgaacggtaccggaccggggtacaacccgtaagtacgtaccgtacgtaaccgggg

SEQ ID NO: 155415 - DNA, 656 bp, Homo sapiens
  misc_feature: GYAE6OF02JZCUG.22.11.A11.1.454.CMB.1.raw
  modified_base (205)..(205): a, c, t, g, unknown or other
  misc_feature (205)..(205): n is a, c, g, or t
tcagacatacgcgtcacgaccggtgctcgatttagctacgactgcagggtgtacacctgtggttctcgggctgccctgtagggacagaggttggcacagcggtcactcccagggcagagggtgggccgagccggcctctgtccatgtggccctcataccccgcgggtccctgagactctcctgtgcagcctctgggttcaccgtnagtagcaagtacatgagctgggtccgccaggctccgaggggaagggctggagtggatctcagtttatttatcgtcggtagtaaccactatactacgcagaccgtccgtggacgggccgatttccaccatcctccagagaccaattccaaagacacggttatactcttacaaatgaaacagtccctagaagtacgaccgtaatcgaacaccggtccgtagtaacgttactgttgtaggaagtatactaaaattccgaacggcccggacggggttaccaaccctaaagttacgaacgttaccgacggggaccgtaacgggaacccgttacggtacctacccggttccgtaccgtaccgaccgtcccttacccggaaccgtaaccggcccgtaacgttcccggttcccgttccccgtaccggtcccgtccccgtcgtacccgtacccgtaacgg

SEQ ID NO: 155416 - DNA, 582 bp, Homo sapiens
  misc_feature: GYAE6OF02F97PC.22.11.A11.1.454.CMB.1.raw
  modified_base (232)..(232): a, c, t, g, unknown or other
  misc_feature (232)..(232): n is a, c, g, or t
  modified_base (359)..(359): a, c, t, g, unknown or other
  misc_feature (359)..(359): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccncaggctccgaggggaagggctgggagtggatctcagttatttatctcggtgtaacacatactacgcagactccggtggacggccatccacatctccagagacaattccaaagacacggtgtatctanaaatgaacagcctgagagccgatcgacgacggcgtgtattactgtagtgagtactactaaaacgttaccgaacggtccgggacggggtaccaacccgaagttcgaacgtacgtcggggaccgaacgggtacccgtcgtccgtaccgtcctccgtcacgccctccgaaccgaccggcccacgttccggtcccttccccgtcggccgtccctcgtcctccgacgg

SEQ ID NO: 155417 - DNA, 600 bp, Homo sapiens
  misc_feature: GYAE6OF02I3KP8.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgaggggaaggggctggagtggatctcagttattatctcggtggtaacacatactacgcagactccgtggacggcgatcacatctccagagacaattccaagaacacggtatactcttacaaatgaacagcctagagacgccgatcgacgacgtcgtagtattactgtgtgagtatacaaacttaccgaagtccggacggggtaccaaccgtaaagttacgacctaacgtcgggaccgaacgggtaacccgtcggtccgaccgtacctccgtaccacgtacccgtacccgaccgaacggtcccacgttccggtcccttaccccggtcggtcccgtccccgtcgtcccgtaccgtaaccgg

SEQ ID NO: 155418 - DNA, 677 bp, Homo sapiens
  misc_feature: GYAE6OF02JXZG8.22.11.A11.1.454.CMB.1.raw
  modified_base (232)..(232): a, c, t, g, unknown or other
  misc_feature (232)..(232): n is a, c, g, or t
  modified_base (401)..(401): a, c, t, g, unknown or other
  misc_feature (401)..(401): n is a, c, g, or t
tcagacatacgcgtcacgaccggtgctcgatttagctacgactgcagggtgtacacctgtggttctcgggcgtgccctgtagggacagaggttggcacagcggtcactcccagggcagagggtgggccgagccggctctgtccatgtggcctcatagcccgcgggtccctgagactctcctagtcgcagcctctgggttcaccgtcagtagcaagtacatgagctgggtccnccaggcctccgaggggaaggggctggagtggatctcagtttatttatccgtcggttggtaacacgataccgttacgcagtacctccggttgggaagggcccgaattcgaaccctagtcctccgagaagaacctaattacccaagaacaccggttagtacttacctttanaaaacgtgaaacaacggtccctaggaagacgacccgtaagtacgtacgaaccgggtccgtaggttactttacgtggttagttacggagtactaacgtaaatttacccgaaagtcccgggtacggggtaccaacccgtaaagttacgaaccgttacgtagggaccgacgggtaaccgtcgtcgaccgttcctcctacgtacgcccgtccgaaccgtacggcccgacgttacccggtcccttacccccggtcggcccgacccgttccgccctacccgg

SEQ ID NO: 155419 - DNA, 540 bp, Homo sapiens
  misc_feature: GYAE6OF02GT4X6.22.11.A11.1.454.CMB.1.raw
  modified_base (423)..(423): a, c, t, g, unknown or other
  misc_feature (423)..(423): n is a, c, g, or t
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgagggaagggctggagtggatctcgagtttatttatcgtcggtaggtaacactatactacgcagactccggtggacgggccattcaccatcctccagacgactaatccaagaacacggtntattacttacaaatgaacacgctgagacgccgatgacacggcgtgtattacgtgtgtagagtatactaaatccgaagtccggacgggtaccaaccgtaagttcgactacgtaccggg

SEQ ID NO: 155420 - DNA, 592 bp, Homo sapiens
  misc_feature: GYAE6OF02F3FCP.22.11.A11.1.454.CMB.1.raw
  modified_base (234)..(234): a, c, t, g, unknown or other
  misc_feature (234)..(234): n is a, c, g, or t
  modified_base (279)..(279): a, c, t, g, unknown or other
  misc_feature (279)..(279): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
tcagacatacgcgtcacgaccggtgctcgatttagctacgactgcaggttgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagcgtgggtcccnccaggcctccgaggggaagggctggagtggatctcagttatttanctcggtgtaacacatacacgcagactccgtggagggccgattcaccatcctccagagacaatccaanaacacggtntatctanaaatgaacngcctgagngccgaatgacacggtcgtgtattatgtgtgagtatactaaaatccgaagcccgggacggggtacaaccctaaattcgtaaccgtacgtcggggaccgaacggaaccccgttggtaccctaccgtcctccgtccaccgccctaccgaacccgaaccggccctaccgtccgttacccgtccccgtcggcccgtcccgtcggtcctccggaaccgg

SEQ ID NO: 155421 - DNA, 923 bp, Homo sapiens
  misc_feature: GYAE6OF02FSL8W.22.11.A11.1.454.CMB.1.raw
  modified_base (320)..(320): a, c, t, g, unknown or other
  misc_feature (320)..(320): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagcgtgggtcccgccaggcctccgaggggaaggggctgggagtggatctctagtttatttatcttcggtaggtaacacattactacgcagacctccggnggacgggccgtattccactagtcctccagagactaacttaccaaagaaccgtacgggtgttaacttcctttaacaaaaattcggaaaacctacggacccttaggaaacggaacggtacccgaaagtacggtaacccggaacccggggtacccggtttacggtttaaacgttttaacccggttaggtttacgggtttacggtaaacggttaaacgttaacccgttaaaaaaaccgttttaacccggaaaaccgggtaccccggggttaacccggggggggttaacccctaaacccccggtttaaaaaggttttacccggtaaaccccggtttaaaccggggttacccggggggtaaccccggtaaacccgggggtaaacccccggttttacccggggttaaaccccgtaacccccggtttacccgtttaccccgttaccccgtacccgggtaacccccgttaaccccggaaaacccccggtaaaccccgggtaacccccgttaacccgtttacccccggggtttacccccgtttacccccccggttccggggtcccccggttacccccgtttaccggtcccccgttaccccggtaaccccgggg

SEQ ID NO: 155422 - DNA, 533 bp, Homo sapiens
  misc_feature: GYAE6OF02FFTIG.22.11.A11.1.454.CMB.1.raw
  modified_base (231)..(231): a, c, t, g, unknown or other
  misc_feature (231)..(231): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcggtccctgagactctcctgtgcagcctctgggttcaccgtcagtagcaagtacatgagctgggtccnccaggctccgaggggagggctggagtggatctcagttatttanctcggtgtaacncatactacgcagactccgnggaggccattcaccatctcagagacaattccaaagacacggtntatcttacaaatcgaacagcctgagagccgatcgacacggccgtgtattactgtgtgagatacaaattccaagccgcggggtcaccaatcgacacgtgggccagggacctcggcaccgtctcctcacgcctccgaaccacggcccacgtccgtccttccccgtcggccgccctcgcctccgacgg

SEQ ID NO: 155423 - DNA, 592 bp, Homo sapiens
  misc_feature: GYAE6OF02GS5A3.22.11.A11.1.454.CMB.1.raw
  modified_base (369)..(369): a, c, t, g, unknown or other
  misc_feature (369)..(369): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgagggaagggctggagtggatctcagttattatcgtcggtgtaacacatactacgcagacctccggtggacgggccgattccaccatcctaccagacgaacaattccaaagaactacggtatatctanaaatgaacagcctgagagccgatcgacgacgcgtagtatacgtgtgtagatatactaaacttcgaacgccggacggggtaccaaccgtaaagttacgacgtacgtcgggaccgaacgggaacccgtcgtaccaccgtcctccgtacaccgtcctacccgaaccgaaccgggcccacgttccgtcccgttccccgtcggtcccgcccgtcgtccgtccgtacgg

SEQ ID NO: 155424 - DNA, 571 bp, Homo sapiens
  misc_feature: GYAE6OF02GPR80.22.11.A11.1.454.CMB.1.raw
  modified_base (232)..(232): a, c, t, g, unknown or other
  misc_feature (232)..(232): n is a, c, g, or t
  modified_base (418)..(418): a, c, t, g, unknown or other
  misc_feature (418)..(418): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgaggggaaggggctggagtggatctcagtttatttatcgtcggtggtaacacatactacgcagactccgtggagggccgattcaccatctaccagacgacaattccaaagaacacggtgtatcttacaaatgaaacagcctagagagccgatgacacggcgtgtattactgtgtganatacaaattccaagccggcggggtacaccaattagactacgtcggggaccaacgggaccctcggtccacccgtctccctcacgccctacccgaaccgaacggcccacgtccggtacccttccccgtcggcccgtccctcgtaccgtccgacgg

SEQ ID NO: 155425 - DNA, 626 bp, Homo sapiens
  misc_feature: GYAE6OF02G9Q6T.22.11.A11.1.454.CMB.1.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcatacccccgcgggtccctgagactctcctgtgcagcctcgtgggttcaccgtcagtagcaagtacatgagctgggtccncaggctcgagggagggctggagtgatctacagtttattanctcggtagtaacncatactacgcagtactccggtggacgggccattcacctatcctccagacgacaacttccaanaacacggtntatcttacaaatgaaacagtcctagagacgccgatcgacacggtccgtagtattacgtgtagtagatactactaaattccgaacgtccggacggggtaccaaccgtaagttcgaacgtacggtacgggacctaacgggtaaccctagtactaccgaaccgttccgtacctacgaccgtcccgtaacccgaacccggtaaccgggtcccctaaccgttcccggttaccccttcccccggtcggtccccgtccccgttcgccctacccggg

SEQ ID NO: 155426 - DNA, 563 bp, Homo sapiens
  misc_feature: GYAE6OF02HYZW0.22.11.A11.1.454.CMB.1.raw
  modified_base (231)..(231): a, c, t, g, unknown or other
  misc_feature (231)..(231): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcataccccgcgggtccctgagactctcctgtgcagcctctgggttcaccgtcagtagcaagtacatgagctgggtccnccaggctccgagggaagggctggagtggatctcagttatttatctcggtggtaacacatactacgcagactccgtggaggccgattcaccatctccagagacaattccaagaacacggtntatacttnaaatgaacagcctgagngccgatgacacggccgtgtaattactgtgtgagatactaaaattaccaagcgacggggtcaaccaaattgaactacgtcgggaccgaacgggacctacggtccaccgtcctcctacacgcctccaaccgaacgggcccacgtccggttccttccccctcggacccgccccgtcgccctccgtacggg

SEQ ID NO: 155427 - DNA, 608 bp, Homo sapiens
  misc_feature: GYAE6OF02GO1HY.22.11.A11.1.454.CMB.1.raw
  modified_base (231)..(231): a, c, t, g, unknown or other
  misc_feature (231)..(231): n is a, c, g, or t
  modified_base (278)..(278): a, c, t, g, unknown or other
  misc_feature (278)..(278): n is a, c, g, or t
  modified_base (366)..(366): a, c, t, g, unknown or other
  misc_feature (366)..(366): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcataccccgcgggtccctgagactctcctgtgcagcctctgggttcaccgtcagtagcaagtacatgagctgggtccnccaggctccgaggggaacgggctggagtggatctcgagtttatttancgtcggtgtaacactatactacgcagactccggtggacggcctattccaccatcctaccagacgaacaacttccaaagaacacgggtntatcttacaaatgaaacagcctagagacgccgatcgacgacggcgtagtattactgtgtgagatactaaattaccgaacggccggacggggtacaaccgtaagttacgacgtacgtacgggaccgaacgggaccgtggtaccgtaccgtcctccgtacctacgtccctaccgaacccgtaaccggaccctacgtccggttcccttccccgtcggcccgtcccgtcgtcccgtaccgaaccgg

SEQ ID NO: 155428 - DNA, 562 bp, Homo sapiens
  misc_feature: GYAE6OF02GT19B.22.11.A11.1.454.CMB.1.raw
  modified_base (232)..(232): a, c, t, g, unknown or other
  misc_feature (232)..(232): n is a, c, g, or t
  modified_base (350)..(350): a, c, t, g, unknown or other
  misc_feature (350)..(350): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccaggggagggctggagtggatctcagttattatctcggtggtaacacatactacgcagactccgtggagggccgattcaccatctccagagacaattccaagaacaggtntatcttacaaatgaaacagcctagaggagccgatcgacacggccgtgtattactgtgtgagatactaaaattccaagccggtcggggtacaacccaaattgactacgtcgggaccacgggaaccctcggtccaccgtctcctcgacgccctaccgaccgaacggccctacgtccgtccgttccccgtacggcccgcccgtcgcctccgacgg

SEQ ID NO: 155429 - DNA, 619 bp, Homo sapiens
  misc_feature: GYAE6OF02H0GS6.22.11.A11.1.454.CMB.1.raw
  modified_base (231)..(231): a, c, t, g, unknown or other
  misc_feature (231)..(231): n is a, c, g, or t
  modified_base (350)..(350): a, c, t, g, unknown or other
  misc_feature (350)..(350): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcataccccgcgggtccctgagactctcctgtgcagcctctgggttcaccgtcagtagcaagtacatgagctgggtccncaggcctccgagggaagggctggagtggatctcagtttattatctggtgtaacacatactacgcagactccggtggagggccattcaccatctccagagacaattccaagaacacggtntatcttacaaatgaacagcctagagacgccgaatgacacggccgtgtattactgtgtagagatactaaaattccgaaagcccggacgggggtaccaacccgaaagttacgaacctaacggtcggggacccgaacggggaaccccgttacggtccgaacccggttctacccgtaccacgcccgtacccgaacccgaaacgggcccctaacgttcccggtccctttaccccccgtcgggtcccgacccccgttcggcccttccgaaccggg

SEQ ID NO: 155430 - DNA, 616 bp, Homo sapiens
  misc_feature: GYAE6OF02GODQS.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgaggggaaggggctgggagtggatctcagtttacttatctcggtggtaacacatactagcagactccggtggagggccatcacatctcgagacgacacttaccaagaacgacggttatactctttacaaatgaacagcctagacgagccgatcgacgacggcgtgtattacgtgtagtgagtactacaaacttaccaagccggtcggggtaccaaccgtaaagttcgaactacgtacggggaccgacgggaacccgttggtaccgaccgttcgtaccgtaccacggtccctaccgaaccgtaaccggggcccctaacggttcccggttcccttcccccgtcgggtcccgtcccgtcggccctaccggtaaccggg

SEQ ID NO: 155431 - DNA, 633 bp, Homo sapiens
  misc_feature: GYAE6OF02HX23R.22.11.A11.1.454.CMB.1.raw
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtcccgccaggcctccgaggggagggctgggagtggatctacgtagtttattatcgtacggtcggtaacacatactacgcaagcctccggtgggacgggccgattccaaccactcctccaagacgaactaattaccgaaagaaccgacggtagttaacttactttaacaaatacgaaacacgtaccgtaggaacgacggaccgagtacggaaccgaccggtaccggttacgttaacttacgttggttggtagaggtaactaaccgtaaaacttacccgaacggacccgggaccgggggtaccctaaacccgtaaacgttacggtaccgtaccggtacccggggg

SEQ ID NO: 155432 - DNA, 589 bp, Homo sapiens
  misc_feature: GYAE6OF02F60UU.22.11.A11.1.454.CMB.1.raw
  modified_base (437)..(437): a, c, t, g, unknown or other
  misc_feature (437)..(437): n is a, c, g, or t
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagactgggaggagccttgatccagccgtggggggtccctgagactctcctgtgcacgcctctgggttccaccgtcagtagcaagtacatgagctgggtcccgccaggcctccgaggggaaggggctgggagtggatctcagttattatcgtcggtggtaacacatactacgcagactcgtggacgggcgattcacatctcagagacaattaccaagaacacggtgtatcttacaaatanaacacgacctagagacgccgagtgacgacggccgtagttagttacgttggttgtggtagtaacgtactaaaacgttcccgaacggtcccgggtaccgggggtaccctaaaccccggtaaacgttacggtaaccgtaccggtaacccgggggg

SEQ ID NO: 155433 - DNA, 745 bp, Homo sapiens
  misc_feature: GYAE6OF02GPP2K.22.11.A11.1.454.CMB.1.raw
  modified_base (235)..(235): a, c, t, g, unknown or other
  misc_feature (235)..(235): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctcgtgggttccaccgtcagtagcaagtacatgagctgggtccncaggcctccgagggagggctggagtggatctcgtagtttattatcgtcggtagtaacnctatacctacgcagtaccgtccggnggacgggccgtattccacctagtcctaccgaagaacgaacctaaacttaccgaaaacggaaccgtacgggttagttaacttacctttaaccgaaaagttacgaaaaccgtacggtacccgttaagggaaccggtaaccggtacccgtaagtaccggaaccgtaccgggtaccggtttacgttaacgtttaaccgttggtacgttaggaacgtaacttaacgtaaacgttaccgaacgggtcccgggtaccggggtaccctaaccgtaaagttcggtaaccgtacggtacggggaccgtaacgggtacccgttgggtaccctaccgtccgtacctacgaccgtccctaaccgaacccggaccggtaccctaccgtcccggttcccctccccggtacggccccgtcccgtcggtacccgtccggaacgg

SEQ ID NO: 155434 - DNA, 643 bp, Homo sapiens
  misc_feature: GYAE6OF02IVXSX.22.11.A11.1.454.CMB.1.raw
  modified_base (236)..(236): a, c, t, g, unknown or other
  misc_feature (236)..(236): n is a, c, g, or t
  modified_base (369)..(369): a, c, t, g, unknown or other
  misc_feature (369)..(369): n is a, c, g, or t
tcagacatacgcgtcacgaccggtgctcgatttagctacgactgcagggtgtacacctgtggttctcggggctgccctgtagggacagaggttggcacagcggtcactcccaggacagagggtgggccgagccggcctctgtccatgtcggccctcactaccccggcgggtccctggagactctcctgtgcagcctctgggttcaccgtcagtagcaagtacatgagctgggtccnccaggcctccgaggggaaggggctgggagtggatctctaagtttatttatctacggtagtaaaccacatactacgcaacgactccggagggacggccattccacatcctcagagaactaataccaaagaaacncgggtatactccttaacaaatgaaacagccgtagacgagtccaatcgacgacggaccgtacgttattacgtgtagtgtaagatactaaacttaccgaacgccggtaccggggtaccaaccgtaactacgtaacgtacggtacgggaccgacgggtaacctacggtaccgaccgtcctaccgtaccgtacgtaccgtacccgaaccgaaccggtacccgtacgtcccgttacccgttccccgtccggtacccgtccctccgtcccgtccgtacgg

SEQ ID NO: 155435 - DNA, 562 bp, Homo sapiens
  misc_feature: GYAE6OF02GGEK8.22.11.A11.1.454.CMB.1.raw
  modified_base (234)..(234): a, c, t, g, unknown or other
  misc_feature (234)..(234): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagcgtgggtccncaggctcgaggggaagggctgggagtggatctcagttatttatctggtgtaacacatactacgcagacctcgtggacgggccattcacatctccaganacaattccaaagaacacggtntactcttacaaatgaacagcctagagacgcgaatgacgacggcgtgtattactgtgtgagatacaaattacacgcggacggggtacacctaattacgacgtacgtcgggaccacggaacccgtggtaccaccgtcctcctcctacgcctaccgaaccgaacggccctacgtccgtcccttccccgtccggccgccctcgcctccgacgg

SEQ ID NO: 155436 - DNA, 540 bp, Homo sapiens
  misc_feature: GYAE6OF02F41UH.22.11.A11.1.454.CMB.1.raw
  modified_base (351)..(351): a, c, t, g, unknown or other
  misc_feature (351)..(351): n is a, c, g, or t
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgagggaaggggctggagtggatctcagtttattatctcggtgtaacanatactacgcagactccgtggacgggccgattcacatctcagagacaattaccaagaacacggtagtattactacaaatagaaacacgacctagagacgaccgatagacacggccgtgtattactgtgtgagaatactaaataccgaacgccggacggggtaccaacctaatacgtacgtacgtacgggg

SEQ ID NO: 155437 - DNA, 706 bp, Homo sapiens
  misc_feature: GYAE6OF02G04XK.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataacccgcgggtccctgagactctcctgtgcagcctctgggttcaccgtcagtagcaagtacatgagcgtgggtccgccaggcctccgaggggaaggggctggagtggatctctagttattatcgtcggtaggtaacactatactacgcagacctccggtaggacgggccgtattccaccatcctaccagacgaactaacttaccaaagaaccacgggtataatcttacaaatcgaaactacgcctagagtacgccgtaagtcgaaccgacgggaccgttagttaactttacgtgtacggtagaacgtaacttaactaaaacttaccgaaaccgggccggtacgggggtaacccaaacccgtaaagttacgaacccgtaacggtaccgggaacccgtaaaccgggtaacccgttacggtacccgtacccgttaccgtccctacgacccgtacccgtaccccgaaccggtaacccgggtccctaacggttccccggttacccttcccccggtcggtaccccgtccccgtaccgcccgtaccggtaacccgg

SEQ ID NO: 155438 - DNA, 588 bp, Homo sapiens
  misc_feature: GYAE6OF02GF7IQ.22.11.A11.1.454.CMB.1.raw
  modified_base (232)..(232): a, c, t, g, unknown or other
  misc_feature (232)..(232): n is a, c, g, or t
  modified_base (288)..(288): a, c, t, g, unknown or other
  misc_feature (288)..(288): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaagggctggagtggatctcagttatttatctcggtgtaaacncatactacgcagactccgtggacggccattccacatctcagagacaattccaaagaacacggtgtatcttacaaatgaacagcctagagacgccgatcgacacggcgtgtatactgtgtgagactactaaaattccaacgcccggcggggtaccaaccctaaagttgaacctacgtcggggaccgaacgggaaccccttgggtaccacccggttctccctaccgacgtccctacccgaaccgaaccgggcccacgttcccggtccttcccccggtggcccgtccctcgtcctccgtacgg

SEQ ID NO: 155439 - DNA, 642 bp, Homo sapiens
  misc_feature: GYAE6OF02JW9FQ.22.11.A11.1.454.CMB.1.raw
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
tcagacatacgcgtcacgaccggtgctcgatttagctacgactgctgggggggagaggagcccagcactgggattccgaggtgtttccattcggtgatcagcactgaacacagaggactcaccatggagttttggctgagctgggttttccttgttgctattcaaaggtgtccagtgtgaggtgcagctggtggagtcgtgggggaggcttggtacagccgtggggggtccctgagactctcctgtgcagcctctggnttcacctttagctaatttatcgccatgagcgtgggtccnccgaggctccgagggagggcgtggaggtggtctgagctgttagtgggtggtgagtggtcggcagtactacgacgctaggacctccgggtggaacggggtccgtttacaccgtatccgtaccgaggaacgtactaaacgttacccaaaggaaccctacccgttaattacgtaactggaactaaaagtgaaaccgtacgccgttaggaaacgacgggaacccgaagaaccgtaacccgggccgttaaagtaaccgttacgtagggtacggaccgggaacggggtcctaagggtaacgtaggtacccgaacggaccgacgttacttacgggtttacgtagtttaaccg

SEQ ID NO: 155440 - DNA, 854 bp, Homo sapiens
  misc_feature: GYAE6OF02IB807.22.11.A11.1.454.CMB.1.raw
  modified_base (162)..(162): a, c, t, g, unknown or other
  misc_feature (162)..(162): n is a, c, g, or t
  modified_base (238)..(238): a, c, t, g, unknown or other
  misc_feature (238)..(238): n is a, c, g, or t
  modified_base (392)..(392): a, c, t, g, unknown or other
  misc_feature (392)..(392): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcataccccgngggtccctgacgactctcctgtgcagcctcgtgggttccaccgtcagtagacaagtacatggagtcgtcgggtccnccgaggcctaccggaggggacgggtctgggagtggactctctagtttattacgtcgtcggtagtaacatatacacgacacgtacctcggtagggacggacctattaccactatcctaccgaagacgaactacttaccaaagtaaccgtacggtnttaacttaccttaacgaaagttcgaaaccgtacggtaccgtaaggacggacgtacccgtaagtaccggaaccgtacccgggtaccggttacgttaacgtttacgttaggttaggtacggtaaacgtaacgttaaaccgtaaaacgttacccggaaacgggtacccggggtaaccgggggttaaccctaaacccggttaaacgtttaccgggtaaccgttaacccggggtaccgggggtaacccggtaaacccgggggttaaccccgttacggggttaaccccgtacccggttacccgttacccgtacccgtacccggttaccccgttaccccggaaacccgggtaacccggggtaccccttaacccgggttaccccgggtttacccccggtttaccccccgggttaccgggtacccccggttaccccggttacccggtaccccggtacccggtaacccgggg

SEQ ID NO: 155441 - DNA, 706 bp, Homo sapiens
  misc_feature: GYAE6OF02JJJTG.22.11.A11.1.454.CMB.1.raw
tcagacatacgcgtcacgaccggtgctcgatttagctacgactgcagggtgtacacctgtggttctcgggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccgcaggcctaccgagggaacgggctagggagtggatctactagtttatttactcgtcgggtagtaaccataatacctacgcaaggacctccggtagggacggcccgtaattccgaacccattccgtaccaaggtacaactaacttccgaaaaggtaaccacgggttagttaacttccttaacgaaagttacgaaaacctcggaccttaggaaacgtacgaccgtaagtaccggaacgtaccggtaccgtagttaacttaccgtgtcgtagaagtactaactaaacgttccgaacggtcccggtacgggtaaccaacctaaagttcgaacgtacggtaccgggaaccgtaacgggtaacccttggtaccgtacccgttaccgtaccctacgacgtaccctaccgaacccggtaacggccctaccgttccgttacccttacccggtcggacccgtacccgtcgtaccacccggtacgg

SEQ ID NO: 155442 - DNA, 549 bp, Homo sapiens
  misc_feature: GYAE6OF02FL6Q7.22.11.A11.1.454.CMB.1.raw
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtcccctgagactctcctgtgcagcctctgggttcaccgtcagtagcaagtcatgagctgggtccgccaggctccgagggaaggggctgggagtggatctcagttattatctcggtgtaacacatactacgcagactcgtggaggccgattcacatctaccagacgactaattaccaaagaaccacggtagttacttacttacaaatacgaacacgcctagagagccgatcgacgacggccgtagtacttacgtgtgtagagtatacaaactaccgaagccggtacggggtaccaaccgtaagttcgacgtacgtacgggg

SEQ ID NO: 155443 - DNA, 645 bp, Homo sapiens
  misc_feature: GYAE6OF02F18TY.22.11.A11.1.454.CMB.1.raw
  modified_base (232)..(232): a, c, t, g, unknown or other
  misc_feature (232)..(232): n is a, c, g, or t
  modified_base (379)..(379): a, c, t, g, unknown or other
  misc_feature (379)..(379): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggcctccgagggaaggggctggagtggatctcagtttatttatcgtcggtgtaacacatactacgcaagacctccggtagggacgggcccattccacctatcctccaagacgactaattccaaagaactacggtgtactcttanaaatgaacagcctagagacgccgtatcgacacggccgtagtattactgtgtgagataactaaagttccgaacggccggacggggtaccaacccgtaaagttcgtaacgtaccggtacggggacccgaacggggtaacccttcgggtacctacccgtccgtcctaccgaccgtaccctacccgaacccgaaccgggtacccctaacgttcccggttacccttcccccggtcggtcccgtaccccgtcggtacccgtaccgtaccggg

SEQ ID NO: 155444 - DNA, 559 bp, Homo sapiens
  misc_feature: GYAE6OF02GDCFI.22.11.A11.1.454.CMB.1.raw
  modified_base (232)..(232): a, c, t, g, unknown or other
  misc_feature (232)..(232): n is a, c, g, or t
  modified_base (352)..(352): a, c, t, g, unknown or other
  misc_feature (352)..(352): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccncaggctccgagggaaggggctggagtggatctcagttatttatctcggtgtaacacatactacgcagactccgtggaggccgattcaccatctccagagacaattccaaagaacacggtntactcttacaaatgaacagcctgagagccgaatcgacacggccgtgtattactgtgtgagatacaaattccaagccgcggggtacaccaaattcgactacgtcgggaccgacggaacccgtggttaccgtctcctcgacgtcctccaccgaacggcccacgtccgttccttccccgtcggccgtcccgtcgccctaccgaggtaccg

SEQ ID NO: 155445 - DNA, 613 bp, Homo sapiens
  misc_feature: GYAE6OF02JMSXC.22.11.A11.1.454.CMB.1.raw
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgagactctcctgtgcagcctctggttcaccgtcagtancaagtacatgagcgtcgggtccncgaggctccgaggggagggctgggagtggactctcgtagtttattatcgtacggtgttaacactatactacgcagactccgtaggacggcctatacaccatcgtaccaagacgaactaaactccaaacgtaacaccggtgtactacttacaaatgaacagacctgaacgacgaccgagacgacgacggtccgtagttaacttcgtagttaggtacgaacggtaacttaacctaaacgttacccgaacgggtcccggggtaccgggggttaaacccaacccgttaaaggttccggtaccgttaacccgggtaaccggggg

SEQ ID NO: 155446 - DNA, 655 bp, Homo sapiens
  misc_feature: GYAE6OF02IQMJD.22.11.A11.1.454.CMB.1.raw
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggcctccgagggagggctggagtggatctcagttatttatctcggtgtaaccanatactacgcagacctccggtggacgggccgattccaccatctccagagacaattccaagacacggtgtatccttacaaatgaaacagtcctagaagagccgaatcgacgaccggaccgtagtaattacgtgttgtgagtactactaaaacgttaccaacggcccggtacgggggtaccctaacccgtaaacgttacgtacgtaaccggtcggggaccgtaaccggggaacccgttcggtacccgacccgttacctcccgtaccgtacgtaccctacccgaacccggtaaccgggacccctaacgtcccgggttacccttccccccggtacggcccgtccccgtacggtcccgtacccgtaaccggg

SEQ ID NO: 155447 - DNA, 633 bp, Homo sapiens
  misc_feature: GYAE6OF02FLXEF.22.11.A11.1.454.CMB.1.raw
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtcccgccaggctccgaggggaaggggctgggagtggatctcagtttatttanctcggtggtaacacatactacncagactccgtggaggccattcaccatctaccaagagaactaacttacccgaaagaacctacgggtagtactacctttacaaaattcgaaaccacgtcctaggaacgacgtacccgatacgacgacggcgtgtattactgtgtagagtactacaaacttaccaacgcccggtacggggtacctaaccctaattacgacttacggtacgggaccgaacgggtaacccgtcgtaccacccgtacctccgtactacgaccttacccgaaccgaaccgggccctaacgtccgttcccttccccgtacggtcccgtcccgtcgtccctaccgtacgg

SEQ ID NO: 155448 - DNA, 764 bp, Homo sapiens
  misc_feature: GYAE6OF02JG9JT.22.11.A11.1.454.CMB.1.raw
  modified_base (155)..(155): a, c, t, g, unknown or other
  misc_feature (155)..(155): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtcggccctnacgtaccccggccggtcctgacgtctcctcgtgtgcacgtcctcgtggttaccaccgtcgagtacgacaagtacagtgacgtcgtcgggtcccgacgtacggccgtaccggaagggggaacgggtcgtagggtaggtcggtacttccgtacgttaaggtttactttacgtcgttacgggtaagtaaccactagtaaccgtacgcgaacgtacgtccgggtagggaccgggtacctagtttacccaacgcttaccgtacccgaaggtaccgtaactaacgttaccggaaaaagtaccgtaacggttacttaacttaccgttaaacaaagtacgaactggtaccctaggacgaccgcgtaagcgacgaccggtacgtagttactagtgtgtacgagtacgtaaactaacgtaccgtacggccggtaccgggtacctaaccgtaagttcgtaaccgtacggtacgggaccgtaacggtaccgtcgtaccgtacccgttaccgtaccgtaccgtccgtaacccgtaccgaaacccgggtaccgtacccgtaccgttacccggttcccgttccccggacggtcccgtcccgtccgtaccccgtacgtaacccgg

SEQ ID NO: 155449 - DNA, 817 bp, Homo sapiens
  misc_feature: GYAE6OF02HWIJL.22.11.A11.1.454.CMB.1.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagacatacgcgtcacgaccggtgctcgatttagctacgactgcagggtgtacacctgtggttctcggggctgccctgtagggacagaggttggcacagcggtcactcccagggcaggagggtgggccgagccggctctgtccatgtggccctcactaccccgcgggtccctgagactctcctgtgcagcctctgggttccaccgtcagtagcaagtacatgagcgtgggtccgccaggcctccggaggggaagggctggagtgattcgtntagtttattatcgtacggtagtaaccnctaatactacgactacgaccgtcggtaggggacggccgtaattccgaaccctattccgtaccgaacgaacgtaactaaccttaccaaaggtaacctacgggttacgtaacttacctttaacgaaaaagtacgaaccacggtaccctaggaacggacgaccgacgttagaaccgaccgggtaccggttacgttacgtttaacgttcggttaggttacggaacgtaacgttaaaccgtaaaaacgtttacccgaaaccgggtacccggggtaccgggggtaacccctaaacccgttaaaacgtttacgtaaacccggttaaccgggaccggggtacccggtaaaccgggtaacccgttacgggttaccccgtaacccggtcccgttaacccgtccgaccccgttacccgtaaccccggtaacccggtaaacccgggtcccctaacccggttcccggttacccccgttcccccggtaccggtccccggtcccgttcccggtacccgtacccggtaaccggg

SEQ ID NO: 155450 - DNA, 820 bp, Homo sapiens
  misc_feature: GYAE6OF02G3O87.22.11.A11.1.454.CMB.1.raw
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtggaggagccttgatccagccgtgggggtccctgagactctcctgtgcagcctcgttgggtcaccgtcagtagcaagtacatgagcgtgggtccnccgaggctccggaggggaaggggctagggngtggatctcgtagtttatttagtcgttacggtacggtaaactactaacgttacctaacgcgtaacggtaccgttacccgggtaggggaaccggggtacccgtagtttacccgaacccgtacttcccgttacccgaaggtaaacggtaaacctaaaccgtttaacccgaaaacggtaaaccggtaaccgggttacggttaacttaaccgtttaaaccgtaaaacgttaccgaaaccgtaacgtacccgtaagggaaacggaccggtacccggtaaaggttaccggaaacccggttacccggggtacccggtttagtttaaaccgttttacggttaacggttggttaacgggtaacggtaacctttaaaaccggttaaaacccgtttaaccccgggaaaaccggggttcccccggggtaaccggggggttaaccctaaaaccccggtttaaaacggtttaccggaaccccgggtttacgggtaacccccggggggg

SEQ ID NO: 155451 - DNA, 913 bp, Homo sapiens
  misc_feature: GYAE6OF02IEMJY.22.11.A11.1.454.CMB.1.raw
  modified_base (152)..(152): a, c, t, g, unknown or other
  misc_feature (152)..(152): n is a, c, g, or t
  modified_base (161)..(161): a, c, t, g, unknown or other
  misc_feature (161)..(161): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
tcagacatacgcgtcacgaccggtgctcgatttagctacgactgcagggtgtacacctgtggttctcgggctgccctgtagggacagaggttggcacagcggtcactcccagggcagagggtggccgagccggctctgtccatgtggccctnataccccgngggtccctgagactctcctgtgcagcctcgtgggttaccaccgtcagtagacaacgtacagtgacgtcgtcgggtcccnccgaggcctccggaaggggagggctggagtggactctctagtttattntcgtcggtagtaacactacgtacgtacgctacggtaccgtcggtagggacggtacccgtatttccgaacccgtacttaccctacccgaagtacgaaaccttaaacgtttaacccgaaaacggtaaaccgtacgggttaagtttaactttaccccttaaagaaaacgtttccggaaaacctacggtacccgttaaggaaccggtaaccggaacccgttaagtaaccggaaacccgggtaacccggttaccgggtttaaacgtttaacgtttacccggttgggttaagttaacgggtaaacgttaaaccgttaaaaccgttaaaaaccgtttaccggaaacccgggtccccgggggtaacccggggttaccctaaaacccggtaaaagtttccggaaaccgttacccgggtacggggtaaccccgtaaacggggttaccccgttacgggttaacccgtaacccgtttacccgtaccccgtacgtacccggttaccccgtaacccggttaaaccccgggaacccggttaacccgttaaccggtttacccccgggttaccccctttccccccgggtaaccggttcccccggtaccccggttcggttacccccggtacccggtaaccggg

SEQ ID NO: 155452 - DNA, 585 bp, Homo sapiens
  misc_feature: GYAE6OF02I5YLT.22.11.A11.1.454.CMB.1.raw
  modified_base (231)..(231): a, c, t, g, unknown or other
  misc_feature (231)..(231): n is a, c, g, or t
  modified_base (358)..(358): a, c, t, g, unknown or other
  misc_feature (358)..(358): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcataccccgcgggtccctgagactctcctgtgcagcctctgggttcaccgtcagtagcaagtacatgagctgggtccnccaggctccgagggagggctggagtggatctcagttattatctcggtagtaacactatactacgcagctccggtggacggccgattcacctatcctacagacgaacaacttccaaagaactacggtntatcttacaaatcgaacagcctgagacgccgatgacgacggcgtgtatactgtgtgagatacaaacttccgaacgccggaccggggtacaaccgtaaagttcgaacgtacggtacgggaccgacgggacccgtcggtccgaccgtctccgtaccacgccctaccgaccgaccggacctacgttccgtacccttccccgtcggcccgtcccgtacgtcctccgtacgg

SEQ ID NO: 155453 - DNA, 651 bp, Homo sapiens
  misc_feature: GYAE6OF02HSYNY.22.11.A11.1.454.CMB.1.raw
  modified_base (231)..(231): a, c, t, g, unknown or other
  misc_feature (231)..(231): n is a, c, g, or t
  modified_base (318)..(318): a, c, t, g, unknown or other
  misc_feature (318)..(318): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcactaccccgcgggtccctgagactctcctgtgcagcctctgggttcaccgtcagtagcaagtcatgagctgggtccnccaggctccgagggaggggctgggagtggctctcgtagtttatttatcgtcggtaggtaacacgtatacgtacgcagtacctccggnggaacgggtccattccacctactcctacagaacgacctaattaccgaaagaaccgtacgggttatacttaccgttaacaaaaattcgaaactacgtacctagggaacgacggacccgtaagtacggaaccgaaccgggtaccgttagttacttacgtgtacgtagagtaataactaaacgtcgaacgaccggtacggggtaccaacgtaacgttgaaccgtacgtacgggaccgacggtaccgtaggcctaccgtcctacctacacgtcccgtaccgaacgtaccggcctacgtcccgttccctcccgtcggcccgtcctcgtccgacgacgg

SEQ ID NO: 155454 - DNA, 718 bp, Homo sapiens
  misc_feature: GYAE6OF02I18PD.22.11.A11.1.454.CMB.1.raw
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (706)..(706): a, c, t, g, unknown or other
  misc_feature (706)..(706): n is a, c, g, or t
tcagacatacgcgtcacgaccggtgctcgatttagctacgactgcagggtgtacacctgtggttctcgggctgccctgtagggacagaggttggcacagcggtcactcccagggcagagggtgggccgagccggcctctgtccatgtggccctcatacccccggcgggtccctggagacctctcctgtgcagcctcgtggttccaccgtcagtagcaagtacatgagcgtgggccnccaggctccggagggacgggntgggagtggatctcgtagttatttancgtcgggtgtaaaccnacgttactacgccaagtccgtccggtggacgggcctattccgacctagtcctacgagacggtaactaaccgttacgaacgaaacgttcggggtattaaaccttcgtaaacaaagtcggaaactacgggtcccaggaacggcccggtaccggaatcgaaccgaccggtaccgtacgtattaccgtggttgtacgaacgtactaactaaacttcccgtaacggtacccggtccggggtaccaaccgtaattacgaacgtaccggtcgggaaccggtacgggtaaccccgttaccgggtcctaaccccggttccgtacccgtccgtaccgcccttacccggaacccgaccggtacccgtaccgttcccgttacccgttccccgtaccggcccgttcccggtccggtaccncccggtaaccgg

SEQ ID NO: 155455 - DNA, 552 bp, Homo sapiens
  misc_feature: GYAE6OF02HJ17A.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggcctccgaggggaaggggctgggagtggatctcagttattatcgtcggtggtaacactatactacgcagactcgtggaggcgattcaccatctcagacgacaataccaagaacacggtgtatcttacaatagaacagcctgacgagaccgatcgacgacggccgtagtacttactgtgtagagtatacgtaaacttaccgaacggccggtacgggggtaccaacccgtaagttacggtacgtacggtaccggggg

SEQ ID NO: 155456 - DNA, 561 bp, Homo sapiens
  misc_feature: GYAE6OF02FVU58.22.11.A11.1.454.CMB.1.raw
  modified_base (232)..(232): a, c, t, g, unknown or other
  misc_feature (232)..(232): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (406)..(406): a, c, t, g, unknown or other
  misc_feature (406)..(406): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgaggggaagggctggagtggatctctagtttatttatcgtcggtagtaacacatactacgcagacctccggtggacggccatcacntcncaganacatcaagacagtntatctacaatgaacagctagagagccgatcgacgacggcgtagtactactgtgtganatactaaattccgaacgccggcgggtaccacctaagtacgactacggtcgggaccgacggacccgtcgtcctaccgtcctcctcacgccctaccgaccgaccggccctacgtccgttcccgttccccgtcggtcccgcccgtcgtccctcgacgg

SEQ ID NO: 155457 - DNA, 547 bp, Homo sapiens
  misc_feature: GYAE6OF02G6YE8.22.11.A11.1.454.CMB.1.raw
  modified_base (469)..(469): a, c, t, g, unknown or other
  misc_feature (469)..(469): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagcctggggggtccctgagactctcctgtgcagcctctgggttcaccgtcagtagcaagtacatgagctgggtccgccaggctccgaggggaagggctggagtggatcgtcagtttattatctcggtggtaacacatactacgcagactccgtggacgggccgattcaccatcctccagacgacaacttccaaagaaccacggtagtatctttacaaatgaacagcctgagacgccgatgacgacggtcgtntattactgtgtgagtatactaaacttccaacggtcccggacggggtaccaacccgtaaagttcgacgtacgtacgggg

SEQ ID NO: 155458 - DNA, 659 bp, Homo sapiens
  misc_feature: GYAE6OF02H0G05.22.11.A11.1.454.CMB.1.raw
  modified_base (294)..(294): a, c, t, g, unknown or other
  misc_feature (294)..(294): n is a, c, g, or t
  modified_base (381)..(381): a, c, t, g, unknown or other
  misc_feature (381)..(381): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagcgtgggtccgccgaggcctccgaggggaacgggctggagtggatctcagtttattatcgtcggtagtaacnctatacgtacgcagtactccggtagggacggtccattccaccgtactcctaccgagacgaactaacttaccaaagaaccgacggttntaacttccttacaaatagaactacgtcctaggacgacgccagtacgaccgacggtccgtagttacttagtgtagtagagtataacgtaaacttccgaaggaccggtccgggtaaccaaccgtaagttacgaccttacgggtaccggaccgacgggtaacccgtcgtcctacccgtctacccgtacgaccgaccgtaccgaaccgtacggtaccctcgtacccggttccccgttccccgtcggccccgttaccccgtccggtaccctccggtaaccggg

SEQ ID NO: 155459 - DNA, 623 bp, Homo sapiens
  misc_feature: GYAE6OF02IFW2X.22.11.A11.1.454.CMB.1.raw
  modified_base (377)..(377): a, c, t, g, unknown or other
  misc_feature (377)..(377): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggcctccgagggaaggggctggagtggatctctagttatttatctcggtaggtaacactatactacgcacgacctccggtggacgggccgtattccaccgtatcctaccagacgactaaacttccgaaagtaacctacggtntaactcttacaaatagaaacagacctagacgacgccgatacgacgacggccgtagtacttactgtgtagagatactaaaacttcgaacgccggacggggtaccaacctaaattcgtaacgtacggtacgggaccgacgggtaaccgtcggtacctaccggtcctacctacgacgcccgtaccgaaccgaaccggccctacgttccgttccgttccccgtcggcccggtccctcgtcctaccgacgg

SEQ ID NO: 155460 - DNA, 906 bp, Homo sapiens
  misc_feature: GYAE6OF02HFWM0.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagactggaggagccttgactccagccgtgggggtccctggagactctcctgtgcagcctcgtgggttccaccgtcagtagacaagtacagtaggacggccgtcggggtcccgacccgagggtccgtacccggaaggggggtaacgggggccgtaggggtaggtggggtaacttccgtaccgttaagttttaagttttacgtaccggttacgggttaaggttaaaccaacgtaaacttaaccgttaacgaccgtaacggaccgttacccgggtacggggtaacggggtaccccgttaacgtttacccgaaacccgtaaccgtttaccccgtaacccgtaaacgggaaccggtaaaacccgttaaaacgttaaccccgaaaaaacgggtaaacccgtttaaccggggttaaccgtttaaaccgtttaaccttttaaacccgaaaaagtttaacccggaaaaaccgttacgggtacccttaagggtaaaccggaaccggtacccggtaagtacccgggtaaacccggtacccggggttaaccgggtttacgtttaaacgttttaccgtagggtttacggttaaggtaacggttaaacttaaaccgttaaaaaccgttaacccgggtaaccgggaccccgggttacccgggggtaaccctaaacccggttaaaacggtttaccggtaacccgtttaacccggggtacccgggg

SEQ ID NO: 155461 - DNA, 691 bp, Homo sapiens
  misc_feature: GYAE6OF02F5MMG.22.11.A11.1.454.CMB.1.raw
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctcgtgggttcaccgtcagtagcaagtacatganctgggtcccncaggctccgagggagggctggagtggatcncagtttattanctcggtggtaacntatactagcagactccgtggacggccgtattccaaccatctaccaaggagaacctaattacccaaagaacccgtacggtgttaatcctttaacaaaattcgaaacagccctagacgagtcccgaatcgacgaccggtccgtagttacttacgtgtgtagtaagactaactaaaacgttaccgaaacggcccgggtccgggggtaaccaaccccgtaaagttacggtaaccgtacggtacggggacccgtaacgggtaaccccgttggttacccgaccgttaccgtaccctaccgacgtaccccgtacccgaacccggtaaccgggtcccctaacggttcccgttcccgtttacccccgtccgggtaccccgttccccgtaccggtcccgtacccgaacccggg

SEQ ID NO: 155462 - DNA, 557 bp, Homo sapiens
  misc_feature: GYAE6OF02GGN2I.22.11.A11.1.454.CMB.1.raw
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccnccaggctccgagggaagggctggagtggatctcagttatttancgtcggtgtaacactatactacgcagactccggtggacggccattcaccatctcagnacaatcaagacncggtntatctacaaatcgaacagcctagagacgccgatcgacacggcgtagtattactgtgtagagactactaaattccaacgccggacgggtacaacctaaagttcgactacgtcgggaccacggaacccgtgtacctacgtacctctccagccctacgaccgaacggcccagtccgtcctaccccgtcggccgtccctcgcctaccgacgg

SEQ ID NO: 155463 - DNA, 671 bp, Homo sapiens
  misc_feature: GYAE6OF02HWQYH.22.11.A11.1.454.CMB.1.raw
  modified_base (232)..(232): a, c, t, g, unknown or other
  misc_feature (232)..(232): n is a, c, g, or t
  modified_base (363)..(363): a, c, t, g, unknown or other
  misc_feature (363)..(363): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccncaggcctcgagggagggctgggagtggatctcgtagttatttatctcggtaggtaacactatactacgcagactccggtgggagggccgattccaccatcctaccgagacgacaattccaagaacacggtntactcttacaaatgaacagcctagacgacgaccgatacgacgacggtaccgtgttaacttacgtgttcgtagagtactaactaaaactttcccgaaacggtcccgggtaccgggggtacccaacccgtaaagttacgaaccgttaaccggtaccggggacccgtaacggggtaacccgttacggtaccgtacccgtccttacccgtaccgaccgtacccctacccggaacccgaaccgggtccctaccgttcccggttacccttcccccggtcggtcccccgtcccgtcgtccctacccgtaaccggg

SEQ ID NO: 155464 - DNA, 566 bp, Homo sapiens
  misc_feature: GYAE6OF02FL3HR.22.11.A11.1.454.CMB.1.raw
  modified_base (274)..(274): a, c, t, g, unknown or other
  misc_feature (274)..(274): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccaggggagggctggagtggatctcagttatttanctcggtggtaacacatactacgcagactccgtggagggccgattcaccatcctccagagacaattccaaagacacggtgtatcttacaaatgaacagcctagagagccgatgacacggcgtgtattactgtgtgagatactaaattccaagccgcggggtccaccaaattgactacgtcgggaccgagggaccctgtccaccgtctccgtcacgcctccaaccgaacggaccccacgttccggttcccgtttcccccgtcgggcccgtccccgtcggtccctcccgtacggg

SEQ ID NO: 155465 - DNA, 629 bp, Homo sapiens
  misc_feature: GYAE6OF02FQUDA.22.11.A11.1.454.CMB.1.raw
  modified_base (350)..(350): a, c, t, g, unknown or other
  misc_feature (350)..(350): n is a, c, g, or t
  modified_base (385)..(385): a, c, t, g, unknown or other
  misc_feature (385)..(385): n is a, c, g, or t
  modified_base (450)..(450): a, c, t, g, unknown or other
  misc_feature (450)..(450): n is a, c, g, or t
tcagacatacgcgtcacgaccggtgctcgatttagctacgactgcaggggggggagaggagcccagcactgggattccgaggtgtttccattcggtgatcagcactgaacacagaggactcaccatggagttttggctgagctgggttttccttgttgctatttcaaaaggtgtccagtgtgaggtgcagctgggtggagactgggaggagccttgatccagccgtggggggtcccctgagactctcctgtgcagcctctgggttccaccgtcagtacgcaagtacatgagctcggggtccgccaggcctccgaggggaaggggctgggagtggatcgtctagttatttntcgtcggtagtaacactatactacgcagactccgngggacgggccgattccactacgtctaccgagacgaacaacttaccgaaacgaaccgtaacgggtnttattacttactaaagttacgaacacgaccgtggaacgacgacccgagttacggaaccgtaccgggtccgttagtaacgttacttagtacggtaggagtaataactaaaacttaccgaacggtcccggtaccgggggtaccaaaccccgttaaagtaccgtacgtaccggtacccgggg

SEQ ID NO: 155466 - DNA, 667 bp, Homo sapiens
  misc_feature: GYAE6OF02FHXV3.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtggggggtccccagacctctcctgtgcacgcctcgtgggttccaccgtcagtagcaagtacagtgagcgtcgggtccgccgaggctccgaggggaagggctggagtggatctacgtagtttatttatcgttcggtaggtaatacgtataccgtacgcacgacgtcggtagggacgggccgtattaccaccatcctaccgaagtacgaactaacttaccgaaagaaccgtacgggtgtaacttacttaacgaaacgtacgaaaccgacgtccgtaggaacggacgaccgtaagtacgaaccgtaccggtccggttagttaacgtttacgttaggtacgttagaacggtacttaaacgtaaaaccgttcccggaaacgggtcccgggtaccggggtacctaacccgttaagttaccggaaccgttaccgggtacggggtaaccccgg

SEQ ID NO: 155467 - DNA, 961 bp, Homo sapiens
  misc_feature: GYAE6OF02IDW6X.22.11.A11.1.454.CMB.1.raw
  modified_base (257)..(257): a, c, t, g, unknown or other
  misc_feature (257)..(257): n is a, c, g, or t
  modified_base (347)..(347): a, c, t, g, unknown or other
  misc_feature (347)..(347): n is a, c, g, or t
tcagacatacgcgtcacgaccggtgctcgatttagctacgactgcagggtgtacacctgtggttctcgggctgccctgtaggacagaggttggcacagcggtcactcccagggcagagggtggccgagccggctctgccatgtcggcctcactaccccggcggtccctgacgacctcctccgtgtcgcacgtccttcgttgggttccacccgttcgaaggtacgactaacgtacagtggacgtccgtcgggtacccncgagggcctaccgggaagggggacgggtctagggtacgttggacttcgttagtaacggttttattacgtccggttacggtaggtaaaccncgtaaccttaccgtacgacgtacgaccgttccgggtaggggacggtcctaactttccgaaccgtacgttacccgtaccggaaaggtaacgaaccttaacgttaacccgaaaaggtaacccgtacggttacttaacttccgttaaactaaaacgtcggaaaactcggttcccgtaagggaacgtacccggtaccgtaaagtcccggaaccgggtaaccgggtaccccggtttaaggtttaaccgttaacggttggttaacggtaaggtaactaaacgttaaaccgttaaaacggttaaccgaacccgggtcccgggggttaacccggggttaaaccctaaacccggtttaaattaacccggtaaccggtttaaccggggtaacccgggggtaacccggtaaacccggggtaaccccttacggggttaaccccgtaaccccggtttccgtaacccggtaacccgttaccggtaccccccgtaaccccgggaaccccgtaacccggggttaccccttaaccggggtttacccccgtttacccccggttccccccggttacgggttacccccccgttacccggttacccggttacccccggtacccggtaaacccggg

SEQ ID NO: 155468 - DNA, 647 bp, Homo sapiens
  misc_feature: GYAE6OF02F9TMH.22.11.A11.1.454.CMB.1.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
tcagacatacgcgtcacgaccggtgctcgatttagctacgactgcagggggggggagaggagcccagcactgggattccgaggtgtttccattcggtgatcagcactgaacacagaggactcaccatggagttttggctgagcttgggttttccttgttgctatttcaaaaggtgtccagtgtgaggtgcagctggtggagacgtgggaggacgccttgactccagccgtggggggtccctgacgactctcctgtcgcncgcctcgtggtccaccgtcagtancagtacagtgagcgtcgggtccgcgacggccgtccgaaggggacgggcgtggagtggactctcgtagtttattatcgtcggtaggtaaacnctaactaccgtacgacgaacgtaccgtcgggtacgggtaccgggacctacgttacccacctactaccgtaccgtaagaacgtaactaactaccgaaacgtaaccgtacggtagtactactaacaactagaacgacgtacgagacgacgcgtacgcgaccgacggtcgtacgttaacgtcgtgtagtaggacgtaactaacgtaacgtaaccgaccggtaccgggtaccggggtaccctaaaccggtaattaccggaccgttacggtaaccggg

SEQ ID NO: 155469 - DNA, 614 bp, Homo sapiens
  misc_feature: GYAE6OF02GFOET.22.11.A11.1.454.CMB.1.raw
  modified_base (155)..(155): a, c, t, g, unknown or other
  misc_feature (155)..(155): n is a, c, g, or t
  modified_base (232)..(232): a, c, t, g, unknown or other
  misc_feature (232)..(232): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctnataccccgcgggtccctgagactctcctgtgcagcctctgggttcaccgtcagtagcaagtacatgagctgggtccnccaggctccgaggggaaggggctggagtggatctctagtttatttatcgttcgggtaggtaacacatactacgcagacctccggtggacgggcctattccacctatcctccgaagacgactaacttaccaaagaacgacggtatactcttaacaaatacgaacagcctggagacgccgatcgacgacggcgttagtacttactgtgtagagtactaactaaacgttaccgaacggccgggcggggtaccaaccgtaattcgacgtacgtcgggaccgacgggtacccgtggtaccaccgtctccgtcacgtccctacccgaaccgaccggtccctacgtccgttcccgttccccgtcggcccgtcccgtcgtcctcgaccgg

SEQ ID NO: 155470 - DNA, 971 bp, Homo sapiens
  misc_feature: GYAE6OF02IKOIV.22.11.A11.1.454.CMB.1.raw
  modified_base (231)..(231): a, c, t, g, unknown or other
  misc_feature (231)..(231): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcataccccgcgggtccctgagactctcctgtgcagcctctgggttcaccgtcagtagcaagtacatgagctcgggtccnccaggcctccgaggggtacgggctggagtggatctcgtagtttattactcgtcggtaggtaacctactataccgtacgcaggtaccttccggtgggacggtcccgtattccgacctagttcctacccgaagtacgtaaccctaactttacccaaaacggtaaccgtaacggggttatttaaaccgttacctttaaacgaaaacgttacggaaaacccgtaaccggtaccccgttagggaaacgggaaccggtaccccgggtaaaggtttacccgggaaaccccggttaaccccgggggttaccccggttttaacgggtttaaaccgtttttaacccggtttagggtttaacgggtaacgggttaaacggttaaaccgttaaaacccgtttaaaaaacccggtttcccgaaaacccggggttacccccggggggtaacccgggggggtttaaaccccctaaacccccggtttaaaaaaggtttcccggtaaacccggtttaaccccggggttaacccggggggaaccccgttaaacccgggggtaaccccgtttaccggggttaccccgtaaccccgggtttaccttacccccgttaaccgtacccggttacccccctttaaccccggaaacccgggtaaacccgggtaccccgttaaccggtttaccccgggttcccccgtttaaccccccggtcgggtacccccgtccccgtaccggtaccccgttcccggaaccgggg

SEQ ID NO: 155471 - DNA, 745 bp, Homo sapiens
  misc_feature: GYAE6OF02G351A.22.11.A11.1.454.CMB.1.raw
  modified_base (233)..(233): a, c, t, g, unknown or other
  misc_feature (233)..(233): n is a, c, g, or t
tcagacatacgcgtcacgaccggtgctcgatttagctacgactgcagggtgtacacctgtggttctcgggctgccctgtagggacagaggttggcacagcggtcactcccagggcagagggtggccgagccggcctctgtccatgtggccctcataccccgcgggtccctgagactctcctgtgcagcctcgtgggttccaccgtcagtagcaagtacatgagcgtgggtccnccaggcctccgaggggaaggggctggagtggatcgtctagtttatttactcgtcggtagtaacactatactacgcaaggtacctccggtgggacggcctagttaccacctatcctaccgaagtacgaactaacttaccgaaagaaaccgtacggttataacttacctttaacaaaattacggaaactcggaccctagggtaacgacggaccgtagtacgaaccgtacggtccgtagttaacttacgtggtagtagaataactaactaaacgttaccgaacggtcccgggtacgggtaacctaaacccgtaaagttacgtaaccggttaaccggtaccggggaccctaaaccggggtaaccccttacggtacccgtacccgttacctaccgtaccgtacccgtaccccgtaaccccggaaccggtaacccggtaccccgtaacggttccccggttacccctttcccccggacggttacccccgtcccgttccggtaccccgtcccggtaacgg

SEQ ID NO: 155472 - DNA, 632 bp, Homo sapiens
  misc_feature: GYAE6OF02HFPQB.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactgggaggagccttgatccagccgtggggggtccctgagacctctcctgtgcagcctctgggttcaccgtcagtagcaagtacatggagcgtgggtcccgccgaggcctccggaggggaaggggctgggagtggatctcgtagtttatttagtcgtcggtaggtaacacatactacgcagtactcggtagggacggccgattccaccatcctacagacactaactacaagaactacggtatacttctaacaagtacgaacacgtacctagacgtacgccgtaagtacggaaccgtccggtaccggttagttaacttacgttcgttaggtagtacgtaacttaaccgtaaaacttcccggaaccggtacccgggtaccgggggttaccctaacccgttaaaggttccggtaaccgttaccgggtaacccggggg

SEQ ID NO: 155473 - DNA, 797 bp, Homo sapiens
  misc_feature: GYAE6OF02HWAGP.22.11.A11.1.454.CMB.1.raw
tcagacatacgcgtcacgaccggtgctcgatttagctacgactgcagggtgtacacctgtggttctcggggctgccctgtaggacagaggttggcacagcggtcactcccagggcagagggtggccgagccggctctgtccatgtcggccctcactacccccgcgggtccctgagaccttcctcccgttgtgcacgtcctcgttgggttcaccgtcagtagcaagtacatgagcgtggccgcaggctcgaggggagggcgtggaggtggactcgacgtacgtttattaagtctgggtacggttaaacacgtactaacttaccgacgtacgaacgttcccggtaggggaacgggtcccgaatttcccgaacctacgttccgtacccgaaggtaactaccgtaaacttacccgaaaacgaacccggtaacggggttactaattcctttaaacgaaaacgttacgtaaaccgttacgcccgttaacggaggaaaccggtacccgtaaggtccgtaaccgtaccgggaccgtttacggttaacttaaccgttgttacggtaggtaacggtaagtaaccgtaaaacttaccgtaacgaccggtaccggggttaccaaccgtaaacgttagaacccgttacgggtacgggtacccggaacggtacccgttacgacccggtccgtacccgtcgttacccacgtcccgtaccgaacccggtaccggacccgtcccggttacccgttccccgtttacccccgggccgtacccggtaccccgtccggtacccggtcccgtaacccgg

SEQ ID NO: 155474 - DNA, 799 bp, Homo sapiens
  misc_feature: GYAE6OF02GC5HB.22.11.A11.1.454.CMB.1.raw
  modified_base (117)..(117): a, c, t, g, unknown or other
  misc_feature (117)..(117): n is a, c, g, or t
tcagacatacgcgtcacgaccggtgctcgatttagctacgactgcagggggaggaggagcccagcactggattccgaggtgtttcctattcggtgatcagcactgaacacagagacncaccatgagtttgctgagctggtttccttgttgtctatttacaaaaggtgtacctagtgttgaggtgcagctggtggagactggaggagccttgatccagtccgtgggggtccctgagactcgtcctgtcgacacgtccgttcgttcgggttaccaaccgttcgaagtacggcctaaagtacgtataggacgtacgtcgggtcccgaccgagtccgtaccgaaggggtacgggactcggggtaagtgggaacttcgtccgttaaggtttaattttaggtacctttgggttaaggtaaaacctacgtaaccgttaaacgttaaccgtacccggaagttaaacccgtacgttacgggggtaacgggtacccggtaaccgtttaaccgaactaaccgttaaccccgttaacccggaaccgttaaaccgggaaacctaaacggttaaaccctaaaaccggtaaaccgtaaaccggtaacggttaacgttaccttaacttaaactacgtaaacgtaaccgtacgtacgaacgacgtaccaacgtacgaactaccggaacgtacgttacgtaagtacgtacgttagaacgtaactaaacgttaaacgttaaacccgtaaggttaccccggaccgggggtaaccctaaacccgtaaacgtttaccggaaccgttaaccggtaacccggg

SEQ ID NO: 155475 - DNA, 783 bp, Homo sapiens
  misc_feature: GYAE6OF02F85U2.22.11.A11.1.454.CMB.1.raw
  modified_base (404)..(404): a, c, t, g, unknown or other
  misc_feature (404)..(404): n is a, c, g, or t
tcagacatacgcgtcacgaccggtgctcgatttagctacgactgcaggggtgtacacctgtggttctcggggctgccctgtagggacagaggttggcacagcggtcactcccagggcagagggtgggccgagccggcctctgtccatgtggccctcactaccccgcgggtccctgacgactctcctgtgcacgcctcgtgggttccaccgtcagtacgcaagtacatgagcgtcgggtccgcaggcctccgaggggaagggctagggagtggattcctgtagtttatttatcgtacgggtaggtaaaccacgtatacctacgcaagccgttccggtggacgggcctattccaaccgtatcctacgaaggtacgaactaacttaccgaaacgtaacgacgggttnttaactcttaacaaagtcgaaacacgtcctagacggacggcccgtaagtacgaaccggaccgggtaccgttacgttaacgttaaccggttggttaggtaggtaagttaacttaaacgtaaaaaccgttaccggaaaccgggcccgggggtaccgggggttaaccctaaacccgttaaaaggttacggtaaaccgttacgggtaccggggacccgtaaccggggtaaccccgtttagggtacccgtaacccggttccgtacccgtaccggaccgtcccgtaccggtaacccggaacccggtacccgtaacccggttcccggtttaccccgttcccccggtacggccccgttaccccgtcgtaccccgtacggtacccggg

SEQ ID NO: 155476 - DNA, 696 bp, Homo sapiens
  misc_feature: GYAE6OF02F24AG.22.11.A11.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatggagcctgggtccnccaggctccgagggagggctggagtggatctcagtttatttatctcggtggtaacacatactacgcaagactccgtggaggccattcaccatctcagagacaatccaagaacgacgtgtatcttanaatgaaacnctccgtagagacgtacgatcgaccacggtcgtgtacttacgtggtagtagagtaatactaaacgttaccgaacggtcccggaccggggttacccaacccgtaaacgttcggaaaccgttacccgggtacggggacccgtaaccggggtaacccgtttaccgggtacccgttaaccccggttcttaccccgttacgtacccgaccccgtacccggaaaccccggtaaccgggtaccccctaaccggtttacccgggtttaccccgtttacccccgggtaccggggtccccgtaccccccggtacggtccccgttaccccggacccggg

SEQ ID NO: 155477 - DNA, 778 bp, Homo sapiens
  misc_feature: GYAE6OF02JLGHJ.22.11.A11.1.454.CMB.1.raw
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactaccccgcgggtccctgagactctcctgtgcagcctgtggttcaccgtcagtagcaagtacagtgagcgtcgggtcccaccaggcctccgaggggaaggggctggagtggactctcgagtttactttactcgtcggtaggtaaccacgtattaacctaggctaacgaccgtccggtaggaccggtccgacttccgaccgtatccgtccgaagacgaaccctaattacccgaaaaggtaaccgttcggtagtttactcttaacgtaaaancgaaaacncgttacccgtagaacgtacgtcccggtaattacggaacctacgggcccgtttagtaacgtttcgtaggttcgtaggaagttaaccgtaacctaaaacgttaccggaaaccggtcccggggttaaaccggtaccgtaaaccccgttaaagtccgtaaacccggttacgggtaccggggtaaccgttaaaccggggtacccgttccggtaacccgtaccggttaacccgcttaccccgtacgtacccctaccccgaacccgggtaagaccccgttaagttccccggtttaccccgtacccccggttcgggcccccgtccttacccgggtccttacccggaaccggg

SEQ ID NO: 155478 - DNA, 540 bp, Homo sapiens
  misc_feature: GYAE6OF02GEYWF.22.11.A11.1.454.CMB.1.raw
  modified_base (371)..(371): a, c, t, g, unknown or other
  misc_feature (371)..(371): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccgccaggctccgagggaaggggctggagtggatcgtcagtttatttatctggtcggtaacacatactacgcagactccggtggagggcctatcacatctccagagacattccaagaacacggtgtatcttacaaatgaacngcctgagagccgaatcgacacggcgtagtatacgtgtgtgagatacaaattccgaacgccggcgggtacacctaaagtgactacgcgggaccgacgggacctgcaccgtctccncgcncctccgacgacggcccagtccgtcctcccgcggccgccctcgcctcgacgg

SEQ ID NO: 155479 - DNA, 670 bp, Homo sapiens
  misc_feature: GYAE6OF02GYECW.22.11.A11.1.454.CMB.1.raw
  modified_base (173)..(173): a, c, t, g, unknown or other
  misc_feature (173)..(173): n is a, c, g, or t
  modified_base (278)..(278): a, c, t, g, unknown or other
  misc_feature (278)..(278): n is a, c, g, or t
  modified_base (327)..(327): a, c, t, g, unknown or other
  misc_feature (327)..(327): n is a, c, g, or t
tcagacatacgcgtcacgaccggtgctcgatttagctacgactgcaggggggagaggagcccagcactgggattccgaggtgttccattcggtgatcagcactgaacacagaggactcaccatggagttttggctgagcttgggttttccttgttgcttatttacaaaaggtntccagtgtgaggtgcagcgtggtgacgacgtggaggagccttgatccagccgtgggggtccctgagctctctgacgcagcctcgtggtcacgtcaagtcacaagnagtgacgcgtccggtcgccgtaggcctaccggaagggacggctgggagnggtatctgtagttattagtcgtggtacgaaactcagtaactcgaccgataccgtcgggaggacggtaccgtattccgaccgtaccttacgtacctaacgtacgtaaactaactaaccgtaaacgtaaccgtaacgttacgttactaacttaaactaaacgtaacaacgtaccgtaccgtacggtaacgacgtaccggtaactaccggaaccgtaccggtccgtaagttaccgttagttcgttaggtgaacgttaacgtaacttaaaaccgtaccggtaacggacccgggtaccggggtaccctaaccgttaacggtaccgtaaccgttaccggtaacccgggg

SEQ ID NO: 155480 - DNA, 734 bp, Homo sapiens
  misc_feature: GYAE6OF02FWB8T.22.11.A11.1.454.CMB.1.raw
tcagacatacgcgtcacgaccggtgctcgatttagctacgactgcagggtgtacacctgtggttctcgggctgccctgtagggacagaggttggcacagcggtcactcccagggcagaggtggccgagccggcctctgtccatgtgccctcataccccgcgggtccctgagactctcctgtcgcagcctctgggttcaccgtcagtagcaagtacatgagctgggtccgccgaaggcctaccgagggaacggggctggaggtggatcctacgagtttactttatacgttcggtacggtaactacgaattactacgctacgaccgttccggtgggacgggaccgtagtccaccgtatcctccagacgacaattaccaaagaacacggttagtacttcgttaacaaatagtaaaccgagtcccgtagaacgacgacccgatacgaacgtaccgggaccgttacgtaatttacgttggtacggttagacggtaactaaacgtaaacttaccgaacgtcccggtaccgggggttaccctaacccgtaaacgttacgaaccgttaaccgggtacggggtacccgaaacgggtaaccccgttaaggttacccgtacgttacccgttaccccttacccgacgtaccccgtacccgtaaccggaaccggaccccgttacttcccggttacccgttcccccgtcgggtcccctaccccggtcgtacccgtaccggtacccggg

SEQ ID NO: 155481 - DNA, 806 bp, Homo sapiens
  misc_feature: GYAE6OF02IWLPR.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactaccccgcgggtccctgagactctcctgtgcagcctcgtgggttccaccgtcagtagcaagtacatgagcgtgggtccgccaggcctccgaggggaagggctggagtggatctcgtagtttatttacgtcgtacggtacggtaaccactattaaccgtaccgctaacggtacccgttccgggtggggaaccggggtcccgtaatttccgaaccctagttccctcccgaagaacgaacctaacttacccgaaaggtaaccgtacggggttatttaacgttacctttaaccaaaagttacggaaaacctacggtacccgttaggaacggaaccggtacccgtaagttacgggaaaccgtacccggggtaccgttagttaacgtttacgttggttaggtacgaacgtaactaaccgtaaaacgttaccgaacggtacccgggtacggggtaaccctaacccgtaaagttacggaaacccttacgggtaccgggtaacccgtaacgggtaaccccgttcgggttaacccgtaccggttccctaccgttaccgtaccgtccccgtaacccgaacccgtaaccgggtaccctacggttaccccgttacccgttccccgtcggtacccgtcccggtccgtaccgtaccgtaaccgg

SEQ ID NO: 155482 - DNA, 707 bp, Homo sapiens
  misc_feature: GYAE6OF02G8UXT.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagacgtgggaggagcctttggactccgagccgtcggggggtccctgacgactctccgtgtgcacgtcctcgttcgggttccaccggtccaagtagcgaagtacagtgagcgtcgggtcccgccgaggccgtaccgaggggaacggggtcgtaggacggttggattcgtacgtagtttaagtttatcgttcggttaggtaaactaacgtataccgtacggactaacggtaccgtcccggtagggaacgggtcccgtacttaccgaaccgtacttccgtaccgaacggtaacgtaaccgtaaacttaaccgaaacgtaaaccgtacggttacgttaaacgttcctttaacgaaacgttagaaacgtaaccgtccgtaggaaacgtaggacccgtaagtcggaaccgtaccggtaccgttagtactttacgtgtaggtagtaagtactaaactaaacgtaccgaacggtccggtaccgggtaccaacccgtaattaccgacgtaccgtaccggg

SEQ ID NO: 155483 - DNA, 746 bp, Homo sapiens
  misc_feature: GYAE6OF02GI1F0.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagtttggctgagctgggtttcctgttgctattcaaaggtgtccagtgtgaggtgcagctggtggagactggaggagccttgatccagccgtgggggtccctgacgactcgtcctgtgcacgccgttcgtgggttccaccgttcagttacgacaagtacagtgacgtcgtgggtcccgccgaggtcctaccggaagggggtaacggggcttagggacggtggaacttccgttacgtaggttttaactttacgtccggttaccggttacggtaaacctaaccgtacgttaaaccgtacggaccgtaacggtaaccgttccgggtaggggaacgggtcccggtatttacccacctacgtccgtacccgaagtacggaacctaacgttacccgaaacgtaaccgtaaccggtaggttaaccttaccgttaacgtaaacgtaccgtaaacgtaccgtaccgtaggtaacggacgtcccgaacgtacggaaccgtaccgggtccgtagttacgttacgtggttagtacggtaagtaagtacctaaaacgtcccgtaaaccggccgggtacccggggtaacctaacccgttaaacggttacggtacccgtacgggttaacccgggg

SEQ ID NO: 155484 - DNA, 735 bp, Homo sapiens
  misc_feature: GYAE6OF02JFDAJ.22.11.A11.1.454.CMB.1.raw
  modified_base (164)..(164): a, c, t, g, unknown or other
  misc_feature (164)..(164): n is a, c, g, or t
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (287)..(287): a, c, t, g, unknown or other
  misc_feature (287)..(287): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggtccgagccggctctgtccatgtgccctcactaccccgngggtccctgacgactctcctgtgcagcctntgggttccaccgtnagtagcaagtacatgagcgtgggtccnccaggcctccgaaggggacgggtctggagtggtatctacgtaggtttacttntccgtacgggtcggtaaacacgtactacgtacgcaggtacctccggtgggacgggtcccgtaattccgaaccgtactcctccgaagaacgtaacctaattaccgaaagtaaccacgggttagtacttaccttacgaaaattcggaaactacgcctagacggacgaccgatacgacgtacgtcgtagttacgtactgtgtgaagtactactaaacgttaccaacgggtcccggtaccgggtacctaaccgtaagttaccggtaacttacgggtaccgggtacccggtaaccgggtacccggttacgtaccgtacccgttccgttacccgttaccggtaccgtacccgtacccgtaaccggtaacccgggtaccctaccgttccccgggttacccgttaccccccggttcggaccccgtccccgttacggtcccgtacccggtaaccggg

SEQ ID NO: 155485 - DNA, 774 bp, Homo sapiens
  misc_feature: GYAE6OF02JHTRB.22.11.A11.1.454.CMB.1.raw
  modified_base (292)..(292): a, c, t, g, unknown or other
  misc_feature (292)..(292): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggagagccttgatccagcctggggggtccctggagactctcctgtgcagcctctgggttcaccgtcagtagcaagtacatgagctggtccncaggctccgaggaagggctaggagtgggatctacgtagttaatttatcgtacggtggtaaaccacgtaataccttacggacaaggaccgttcccggttagggaacggggtccccgtaaattttcccgaaacccgtaacgttacccgttacccgtaaacgggtaaacggtaacccgtaaaaccgtttacccgtaaaacggtaaaaccgtaaccgggttacggttaaacgttaccgtttaacctaaaacgttacggaaaccgtaacggtacccgttaacggaacggtaacggacccgtaacgtacggaaccgtaacccgggtaccccggttacggttaaaccgtttaaccgttacgttacggttacggtaacggtaacgttaaccgtaaaaccgtttacccgtaaaccggtacccgggtaccgggggttaccctaaccccggtaaacggtttaccggtaaccgttaacccggttaacccggggg

SEQ ID NO: 155486 - DNA, 567 bp, Homo sapiens
  misc_feature: GYAE6OF02H218C.22.11.A11.1.454.CMB.1.raw
  modified_base (292)..(292): a, c, t, g, unknown or other
  misc_feature (292)..(292): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccgccaggctccgaggggaaggggctggagtggatctcagttatttatctcggtggtaacanatactacgcagactccgtggaggccattcacatcncaganacaatccaagaacacggtntatcttacaaatgaaacngcctgagagccgaatcgacacggccgtagtattactgtgtgagatacaaaattcaagccgacggggtacaaccaaattgactacgtcgggaccaacgggaaccctggtccacgtctcctcacgccctaccgaaccgaaccggacccacgttccggtccttcccccgtcggtcccgtccccgtcgtcctccgtaaccgg

SEQ ID NO: 155487 - DNA, 643 bp, Homo sapiens
  misc_feature: GYAE6OF02FY6B5.22.11.A11.1.454.CMB.1.raw
  modified_base (154)..(154): a, c, t, g, unknown or other
  misc_feature (154)..(154): n is a, c, g, or t
  modified_base (231)..(231): a, c, t, g, unknown or other
  misc_feature (231)..(231): n is a, c, g, or t
  modified_base (411)..(411): a, c, t, g, unknown or other
  misc_feature (411)..(411): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctnataccccgcgggtccctgagactctcctgtgcagcctctgggttcaccgtcagtagcaagtacatgagctgggtccnccaggctccgagggagggctggagtggatctacagtttatttagtcctcggtagtaaccagataccgtacgcaagccgtccggtaggacgggccgtatttccgaacctagttcctaccgaagacgaactaacttaccaaaagaaccgtacggttataacttccttaacaaaatcgaaacncgtcctaggacggacgccgaagtcgacgacggccgtagtattacgtgtgtagagtataactaaacttcgaacgtccggcggggtaccaaccgtaacgttacgaacgtacggtacgggaccgaacgggtacccgttacggtacctaccgtctacctacgacgccgtaccgaaccgacggtaccctaccgtccgtacccttcccgtcggtccgtacccgtcgtccctacgacgg

SEQ ID NO: 155488 - DNA, 907 bp, Homo sapiens
  misc_feature: GYAE6OF02GB1R6.22.11.A11.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcataccccgcgggtccctgagactctcctgtgcagcctntgggttcaccgtcagtagcaagtacatgagcgtcgggtaccnccgaggtcctaccgaagggggaacggggcgttggaaggtggactctcgtaagtttaattttatcgttcggtaggtaaaccactaattacctacgcgaacgacgttccggtagggacggggtcccgtatttacccgaaccgtacttacccgtaccgaaaggtaacgtaactaaaaccgttacccgaaaaacggtaaccggtaaccgggttaggtttaaacttccggtttaaactaaaaacggttcggaaaaccgtacgttaacccgtagggaaacgtaccggtaacccgggtaagttaacgggaacccggtacccgggtacccggttaggttttaaacgtttaaccgtttacggttaggtacggtaaacggtaactttaaacgtaaaaaccgttttacccgaaaccgggtccccggggtaaccgggggttaacccgtaaaaccccgttaaaggttaaccgtaaaccggttaaccgggttacggggtaaccccggtaaccgggttaaccccggtttacggtaccccgttaacccggttaccctacccgttaccgacccgtacccgttaccccgaacccgggtaaaccggtccccggtaacccgttacccggttccccgtttaccccccgcgggttacccccgtcccgtacccggttacccgtacccggtaacccgg

SEQ ID NO: 155489 - DNA, 783 bp, Homo sapiens
  misc_feature: GYAE6OF02ISWOG.22.11.A11.1.454.CMB.1.raw
  modified_base (104)..(104): a, c, t, g, unknown or other
  misc_feature (104)..(104): n is a, c, g, or t
  modified_base (669)..(669): a, c, t, g, unknown or other
  misc_feature (669)..(669): n is a, c, g, or t
tcagacatacgcgtcacgaccggtgctcgatttagctacgactgcagggggggggagaggagcccagcactgggattccgaggtgtttccattcggtgatcagnactgaacacagagactcaccatggtagttttggctaagcgttgggtttttccttgttgcttatttacaaaaggtgtccagtgtgaggtgcagcgtggtaggagacgtggaggagccttgatccagccgtgggggtcctgagactctctgtgcacgcctcgtcggttccgaccgtcaggtagacaagtacagtgagcgtacgggtcccgacggacggccgtaccggaagggggaacgggggtccgtaggggaggtagggtacttccgtacttaaggtttaagtttagtccggttacgggttaaggttaaacccgaactaaacgtaaccgtaacggacgtaacggtaccgttaccgggtaggggaccggggtaccgtacgttacccgaacctaccgttacctacccgaaggtaaactaaacctaaacgttaccgaaaacggaacgaacggtttagttaaacttaaccggttaactaaaacgtcggtaaacctaccgtaccctaagggaacgttaacggacccgtagtaaccggtaaccgacggggttacctttaggtacctttaagngtttaggagaacgtaacgtaaacgttaaaacgttcccggaaaccgggtcccgggtacggggtaaacccctaacctttaaggttcgtaaacccgtccggggacggggtaacccgg

SEQ ID NO: 155490 - DNA, 608 bp, Homo sapiens
  misc_feature: GYAE6OF02FJYQA.22.11.A11.1.454.CMB.1.raw
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctgggtccncaggctccgagggagggctggagtggatctcagttattancttcggtgtaacacatactacgcagactccggnggacggccattcaaccatcctaccagacgaactaattccaaagaacacgggttntactccttacaaatcgaaacngcctagacgacgccgatcgacacggcgtagtactacgtgtgtgagtactactaaacttccgaacggtccggacgggtaccaaccgtaagttacgaccgtacggtacgggaccgtaacgggtacccgttggtaccgtaccgtcctaccctcgacgtccctaccgaaccgaccgggaccctacgttcccggtcccttccccgtcggcccgtcccgtcgccgtaccgacgg

SEQ ID NO: 155491 - DNA, 943 bp, Homo sapiens
  misc_feature: GYAE6OF02IOLZP.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtggccctcactacccccggcgggtccctggacgacctctcctgtgcacgcctcgtggttccaccgtcagtagacaagtaccatgacgtcgtacggggtcccaccgaacgggcctaccgggaagggggaacggggtcttaggggacggttggaacttccgttaccgtaaggttttaccgtttaacgtccgttacggggtacggttaaaccacgtaacgttaacctaccgggacctaacggtacccggttacccggggttagggggacccggggtcccgttaacgttacccgaaccgtacttccctacccgtaaagacggaaaccttaaccgttaacccgaaacgaaacgttaccgggttaactttaacttacccgtttaaaccaaaagttacgaaaccgtacggtacccttaggaaaccgggtacccgaccggtaacgtaccggtaacccggacccgggtacccggtttagtttaaaccgtttacgtacggttacggtaccgtaaaggtaaccttaaaccgttaaaacgttacccggaaaccgggtcccggggttaaccgggggttaaccctaaaacccgttaacggttaccggaaaccgttaccggggtaacggggtaccccggtaaacggggtacccggtttacgggtaaccccgtacccggtttaccctaccgttaccgacccggttacccctaaccccggtaacccgggtaacccgggtcccgttacccgtacccggtttccccgttaccccggtcggtaccccgtacccggtaccggtcccgtacccgtacggg

SEQ ID NO: 155492 - DNA, 569 bp, Homo sapiens
  misc_feature: GYAE6OF02GH492.22.11.A11.1.454.CMB.1.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttcaccgtcagtagcaagtacatgagctcgggtccnccaggctccgaggggaagggctggagtggatctcagttattanctcggtgtaacanatactacgcagactccgtggaggccgattccaccatcctaccagagacaattccaaagaacacggtntactcttanaaatgaacagtcctagacgtagccgatacgacgacggccgtgtattacgtgtgtgagtatactaaacttccaacgccgcggggtaccaccgtaattcgactacgtcgggacgacggtaccgtgtaccaccgtctcctcacgtacctaccgaccgacggccctacgtccgttcctccccgtcggtcccgccctcgcctccgacgg

SEQ ID NO: 155493 - DNA, 628 bp, Homo sapiens
  misc_feature: GYAE6OF02FYDDM.22.11.A11.1.454.CMB.1.raw
  modified_base (211)..(211): a, c, t, g, unknown or other
  misc_feature (211)..(211): n is a, c, g, or t
  modified_base (232)..(232): a, c, t, g, unknown or other
  misc_feature (232)..(232): n is a, c, g, or t
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcatacccccgcgggtccctgagactctcctgtgcagcctctgggttcaccgtcagtancaagtacatgagctgggtccnccaggctcgagggagggctggagtgatctcagtttatttanctcggtgtaacanatactacgcagactccggtggaggccattcacgtatcctccaagatacaattaccaagaacacggtntatcttanaaatgaaacagctagaagacnccgatgacacggcgtatacttactgtacgtagaagtactactaaacttaccgaagtccggcggggtaacccaaccgtaaattacgaacgtaaccggttacgggaccgaacgggtaacccgtcgggtacccgacccgttcccttacctccgtacgccctaaccgacccaaacgggaccccctaagttcccggttaccctttaccccccggtggtaccccgtcccgtaccgtacccgtcgaacccggg

SEQ ID NO: 155494 - DNA, 751 bp, Homo sapiens
  misc_feature: GYAE6OF02IEBOW.22.11.A11.1.454.CMB.1.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
  modified_base (732)..(732): a, c, t, g, unknown or other
  misc_feature (732)..(732): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttacaccgtnagtagcaagtacatgagtcgtggggtccnccgaggcctccggaaggggagggctgggagtggatctactagtttatttagtcgtacggtagtaaaccactactacgtacacgacgtaccgttccggtagggaacggggcctacttccgacctactcctacaagactaactaacttaccgaaaagaacgtacggttagttaaactccgttaacaaattcggaaacctacgaccgtaggaacgtacggaccgtaagtcgaaccgtaccgggtccgtttaagttaacttacgtggttagtaggtaaactaacttaaacgtaaaacgtttcccggaaacgggtccgggtacccggggttaacaaacccgtaaacgtttacggaaccgttacggggtacggggaacccgtaacgggtacccgtcgggttacccacccggttctcccgtacgaccgtacccgtacccgaaccggaacccgggtaccctaaccggttccgttccccttcccggacggtccccggtaccccnggtccccgtacgtaccggg

SEQ ID NO: 155495 - DNA, 895 bp, Homo sapiens
  misc_feature: GYAE6OF02G0FU6.22.11.A11.1.454.CMB.1.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagactctcctgtgcagcctctgggttcaccgtcagtagcaagtacatgagctgggtccncaggctccgagggagggctggagtgatctcagttatttancgtcggtagtaacanatactacgcaagtacctccggtgggacgggtcccgtaattccgaacccacttcctacccgaaggaacgtaacctaaaacgtttaccccgaaaaggaaacccgtacggggttactttaacttacccgttttaaccaaaaaagttcggaaaaaccctacggtccccgtttagggaaacggttaacggaccccggtaaagttaccggaacccgtaaccggggtaccccggtttagggtttaaactttaccggttaggttaggtacggtaacgtaaacgttaacctaaaaacgtttacccggaaaccgggtaccggggtacccggggggttaaccctaaaccccggttaaaagtttacggtaaaccgttaaccgggttaccgggggaacccgtaaaccgggggtaaaccccggttaccgggttaacccggttaaaccccggttcccgttaacccctaacccgttacccgtaacccccggttaccccgaaaccccggtaaacccgggtacccccgttaacccggttaccccggtttaccccccgtttacccccgggtacccgggtacccccgttcccccggttcccggttccccgttacccggtaacccggg

SEQ ID NO: 155496 - DNA, 762 bp, Homo sapiens
  misc_feature: GYAE6OF02F47JF.22.11.A11.1.454.CMB.1.raw
tcagacatacgcgtcacgaccggtgctcgatttagctacgactgcagggggggagaggagcccagcactgggattctgaggtgtttccattcggtgatcagcactgaacacagaggactcaccatggagttttggctgagcttgggttttccttgttgctatttcaaaggtgtccagtgtgaggtgcagcgtggtggagacgtgggaggacgtccgttgatccgacgccggtcgggggtccctggacgaccttctccgtgtgccagcctgtcggttccaccgtcaagtagacgaagtacatagacgtcgtacgggtcccgcgacggccgtcggaaggggaacggggtcgtgggtagtacggattcgtacgtagtttagtttacgtcgtacggtaggtaaccactattaccgtacgtcgacgtccgtccggtacgggtacggaccgtacttaccaaccctatccctaacgtagaacgtaaacctagttaaccgaacgaaccgtacgggttaattaacctcgtaaaaccttagtaaccgtaccgaccggttactacgggacgaaccgtcggtaacgcggtaacccggtacggttacttacgtttaaaccgtttggtaagtttccgggaaaggtaaacgtttaaccggttaaaacccgttaaaacgttacccgggtaacccggggtacccccggggttaacggtttaaaccccccgtaaacggtttaaaaccggtttcccgggaaacccggtttaaccccggggg

SEQ ID NO: 155497 - DNA, 640 bp, Homo sapiens
  misc_feature: GYAE6OF02GSJCY.22.11.A11.1.454.CMB.1.raw
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctcgtgggttcaccgtcagtagcaagtacatgagctgggtccgccaggcctccgaggggaaggggctgggagtggatctctagtttatttatcgttcggtaggtaacactataccgtacgcaagctccggnggacgggctatcacctntctcagagacactacaagacaggtntactctaacaatacgaacgacgtcgtagacgacgacgatacggaacgtaccgggtacgttagttaacttcggttagttacggtagtagtaaacttaaccgtaaaacttccgaaacgggtccgggtaccgggtacccaaaccgtaatacgtaacgtacggtcgggaccgaaccgggtacctcggtacctacccgtacgtcctacgtacctaccaccgtaaccgtacggcccgttacgtcccgttccctcccgcggtccgccctcgtccgacgtaccgg

SEQ ID NO: 155498 - DNA, 925 bp, Homo sapiens
  misc_feature: GYAE6OF02JG9RN.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtggccgagcccggcctctgtccatgtcggccctcgactacccccggcgggtccctgacgacctctcctgtgcagtccctcgtggttccaccgtcagtagcaagtcatgagctgggccacaggcctccgagggaggctggagttggtttcatacgagttagtggttacgttaggttaatttttaaagcgactaggaccttcgtaggtacggaacgggtccgtattaccaaccgtattcccgtaccggtaaggggaaacctaaaccggtacccgaaaacggtaaccgttacctaaccgtagtttaacgtacctttagggaaccgttaaaacgtacgaaaaccgtaacgtcccgttaaggaacgtaacgggtaccggaacgggttaacccgggacccgggttaccggtttacggtttaaacgttttaacggtttaccggggtacggggtaaacccggggtaaagggtaacgggttaacggggttacccggggtaacctttaacgggggtttaacttacccgggtttacccggtttaccccgggttaaacccccgggtacgggggtaaccccgggtaaacccggggttaaccccgggttaccgggttaccccgtaaccccgggtttcccgtacccgttaccggtacccggttacccgttaacccgggtaaccccggtaacccgggtacccgttccggttaccccggttaccccggtttccccggaccgggtcccccggttaccgtcccggttaccccgtaccgggtaacggtacccggtcccgtaaccggttcccgggtaaccgggg

SEQ ID NO: 155499 - DNA, 786 bp, Homo sapiens
  misc_feature: GYAE6OF02HWPCQ.22.11.A11.1.454.CMB.1.raw
  modified_base (211)..(211): a, c, t, g, unknown or other
  misc_feature (211)..(211): n is a, c, g, or t
tcagacatacgcgtcacgaccggtgctcgatttagctacgactgcagggtgtacacctgtggttctcgggctgccctgtagggacagaggttggcacagcggtcactcccagggcagagggtgggccgagccggcctctgtccatgtcggccctcacgtaccccgcgggtccctgacgactctcctgtgcagcctcgtgggttccaccgtnagtagactaagtacatgagtcgtcgggtccgccagggtcctaccggaaggggaacggggtctagggaggtacggtacttccgtacgttaaggtttttactttaacgttccggttacggttaacggtaaacctaccgtaacgttaccgtaccgacgtaacgtaccgttcccggggtaggggtacggaccgttaactttaccaaccgtaacttcctaacccgaaggtaacctaacctaacggttaacccgaaagtaaccgtacgggttataacttaccgtaacgtaaaagtcggaaaccgtcgtacctaggaacggaccgtaccgtagtacgaaccgccggtacgtttacgttacttacgtggtacgtagacgtactaaacctaaacttacccgacggccgggtacggtaaccaccgtaaagtcgtaacgtacggtcgggaccgaacggtaccgtacgttccaccgtaccttaccgccgtaccgtacccgtaccgaaccggaaccggttccctaccgtttcccggtacccctttccccggccggtacccctacccggttcgtacccgccgaaccggg

SEQ ID NO: 155500 - DNA, 835 bp, Homo sapiens
  misc_feature: GYAE6OF02HK19H.22.11.A11.1.454.CMB.1.raw
tcagacatacgcgtcacgaccggtgctcgatttagctacgactgcagggggggagaggagcccagcactgggattccggaggtgtttccattcggtgatcagcactgaacacagaggacctcaccatggtagttttggctgagcgttgggttttccttgttgcttatttacgaaaaggtgtccagtgtgaggtgcagcgtgggtggagtacgtgggagggacgtccgttgaacgtccgaggtcccggttcggggggtcccctaggtacgtaccttcctcccgtggtcgaccgcgtcccttcgttcggggttaccacccggttacgaaggtacgactaaaacgtaaccagtaggtacgtccggttccggggtaccccggccggaacgggtcccggtaccgggaaggggggtaacggggcggtagggtagggtacggacgttcttacgttaagttttaactttacgtccggttacggttacggtaaaccactagtaccgtacgacgaggtaccgtacggtacgggacgggtaccctacgtaccaccgtacttccgtaacaggtaacgtaactaaaccttacgaaaacggtaaccgtacggttaacgttaactacgttaaccgtaaaagttaccgaaacgccgtaaccgtaggtaacgaaccggtaccggtaacgtaccggaaccgtccgggtaccgttagttaacgttaccgttggttacggagtaacggttaacttaaaccgtaaaacgtttaacccggaacgggtaccccggggtaccgggttaccctaaaaccccgttaaggtttaacgtacccggttaccggtaacccggggg

SEQ ID NO: 155501 - DNA, 825 bp, Homo sapiens
  misc_feature: GYAE6OF02JM7JB.22.11.A11.1.454.CMB.1.raw
  modified_base (235)..(235): a, c, t, g, unknown or other
  misc_feature (235)..(235): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggctctgtccatgtggccctcataccccgcgggtccctgagactctcctgtgcagcctcgtgggttccaccgtcagtacgcaagtacatgagcgtgggtccnccgaggcctccgaggggagggtctagggacgtggattctcgtaagtttatttacgtcgtcggggttacggtaaaccacctaagttaacctaccgccgtaaggaacccgtttcccgggtaggggaaccgggtcccgtaactttccaaccccgtatccctaccggaaagacgtaactaaacgtttaccccgaaaagtaaaccgtaccggggttacttaacttacccgtttaacaaaacgttcgaaaaacctacggtacccttaagggaaacggacggtacccggtaacgtaccgtaaccggaaccgggtaccggtttacgttaacgtttaccgttacgggtagttacggaaggtactaaaccgtaaaaccgtttaccgaaccggtacccgggtaccggggttacctaaacccgtaaagttacgaccgttaccggtacggggacccgtaaacggggtaacccgttcggtaccgtacccgttacctccgtaccaccgtcccgtaccgaaccccggtaacggacccctaaccggttcccggttacccttacccccggtccggtcccgtccccgtcgacccgtaccggtaaccggg

SEQ ID NO: 155502 - DNA, 709 bp, Homo sapiens
  misc_feature: GYAE6OF02H9WSB.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccgaggcaggagggtgggccgagccggcctctgtccatgtcggccctcactaccccggcgggtccctgacgacctctcctgtcgcacgtcctcgtgggttccaccgtcagtagacaagtacatgagcgtcgggtccgcgaggctacggaggggagggctggaggtggagtcgtactagttatttatcgtcggtacgtaacactactaacgtacgacgacgtaccgtaccggtacgggacggacgtacttaccacctactacgtacgacgaacgtacgtaactaaccgaacgaacgtacgtacgtactacttacggggggggggggggggtaaactacgaacgacgacgtacgacggacgacgtacgtacgacgacggtaccggttacgttacgtacgtgtacgtagtacgtactaactaaacgtaccgtaacgtacggtacgggtacgtaaccgtaacgtacgtacgtacggtacgggaccgaaccggtaccgtacgtaccgtaccgtccgtaccgtacgaccgtaccgtacccgaaccgaccggtaccgtccgtaccgtcccgtcccgtccggccgtcccgtccgtccgtaccgtacgg

SEQ ID NO: 155503 - DNA, 692 bp, Homo sapiens
  misc_feature: GYAE6OF02JCYSL.22.11.A11.1.454.CMB.1.raw
  modified_base (165)..(165): a, c, t, g, unknown or other
  misc_feature (165)..(165): n is a, c, g, or t
  modified_base (248)..(248): a, c, t, g, unknown or other
  misc_feature (248)..(248): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggctctgtccatgtcggccctcactaccccggngggtccctgagctctcctgtcgcagtcctcgtggttccaccgtcagtagtacgaaagtacagtgaggtccgtggggtaccccncgaacgggcctaccgggaaggggtaacggggtcctggggtaaggttgggactttccgattaggttaatttccgtcggttcggtacggtaaacctaacgtaacgttaccgacgttacgtacgtaccggttcccgggagggaccggtcccctaattccaccgtactctaccgaagacgtactagtaccagtaacgtgtnacgtctanaacgtagaacgtntcgtagaacncgaacgtgcacgacgcgtagtactagtgtgnganactactaacgtcgtacggccggtcgtactacgaaatcgaacgtcggaccggacgtaaccggtaccgtacgtcccgtacgttcccgaccgttacgaccgtcccgtaccggtaacccgtaccggtacctaacggtccccgttaccgtcccgtaccgggtacctaccccgtcgtaccgccgtacg

SEQ ID NO: 155504 - DNA, 766 bp, Homo sapiens
  misc_feature: GYAE6OF02HGFBX.22.11.A11.1.454.CMB.1.raw
  modified_base (209)..(209): a, c, t, g, unknown or other
  misc_feature (209)..(209): n is a, c, g, or t
  modified_base (435)..(435): a, c, t, g, unknown or other
  misc_feature (435)..(435): n is a, c, g, or t
tcagacatacgcgtcacgaccggtgctcgatttagctacgactgcagggtgtacacctgtggttctcgggctgccctgtagggacagaggttggcacagcggtcactcccaggcagaggtggccgagccggcctctgtccatgtggccctcataccccgcgggtccctgacgactctcctgtgcacgcctgtgggttcaccgtcagtanctaacttacatgagctcgggtcccgccaggcctccgaggggaacggggtctgggagtcggattcctcgtaagtttattacgtcgttacggtaggtaacactatacctacgactaggaccttcggtagggcggccgtattaccacgtactcctacgagtacgactaacgttccaaagtaaccgtcgggttattactccgttaacaaatcgtaaacagtcctaggganccggactaacgtacgaccgtacggtaccggttagttaacttacgttgtacggtagtaacgtaacgtactaaacgttaccgaacgggcccggtaccggggtaccctaaaccgtaaacggttacgtaaccgtaccgggtacgggtaccggtaacccgggtaccgttacgggtaccctaccggttacccttccgttaaccggacccgttaccccgtaccccgtaacccggtaacccggtaccccgttaacggttccccggtttacccccgttaccccggttaccggttccccggtacccccggttaccggttccccgtaacccgggttacccgg

SEQ ID NO: 155505 - DNA, 1041 bp, Homo sapiens
  misc_feature: GYAE6OF02HT9C6.22.11.A11.1.454.CMB.1.raw
tcagacatacgcgtcacgaccggtgctcgatttagctacgactgcagggggggagaggagcccagcactgggattccgaggtgttccattcggtgatcagcactgaacacagaggactcgaccatggtaagtttgcgtgagcgttgggttttccttgtgctacttacgaaaggtgtccaggtgtgaggtgcgagctgggtaggacgacgtagggaacggagtccgttaggacttaccgacggtcccggtcggggggttacccctgggaaccgtacccgttccgttaccgttacggtaccgtaccgtacggttcccgttaccggttaacgggggtttccccgtaaaccccgttccggtaaacgggtttaaccgggaaccgtttaaacgttaaaacccggtaagttaccgggttaacgggtaacccgggtttacccggggggttaaccccggtaccccggtaaaacggggtccccgttaaccggggggaaacggggggtaaaccggggggcgttttaaccggggtacggggtttacggtaacgtttaaccgttacggtttaacggttttaaagttccggttacggtttaccgggacgtttaaaccaacgttaactaccgtaacggactaacggtaccgtcgggtaaggggtccggaaccgttacttaccgaacctacgttacgacgtaaaggaactaaccgaacgttaacctaaacgggtaaccgttacggtaacgttaaccgttaacgttaaaccgtaaacggtaaaccggtacccgttaaacggtacccggtaaaggttaaaccggaaccgggtacccgttaaacggttaaccggggaaacccgggtacccgggttaaccggtttaccgggttttaaaaccttcgggttaccggtttaacggacgttaaaccgttaaccggtttaaaaccgttaaaacccggttacccggttaaacccggtcccgggttaacccggggtaaacccctttaaaccgtaaaacggtttaccccgggttaacgtacccgggtaaaccccggggg

SEQ ID NO: 155506 - DNA, 682 bp, Homo sapiens
  misc_feature: GYAE6OF02HTKL7.22.11.A11.1.454.CMB.1.raw
  modified_base (137)..(137): a, c, t, g, unknown or other
  misc_feature (137)..(137): n is a, c, g, or t
  modified_base (193)..(193): a, c, t, g, unknown or other
  misc_feature (193)..(193): n is a, c, g, or t
  modified_base (332)..(332): a, c, t, g, unknown or other
  misc_feature (332)..(332): n is a, c, g, or t
  modified_base (629)..(629): a, c, t, g, unknown or other
  misc_feature (629)..(629): n is a, c, g, or t
tcagacatacgcgtcacgaccggtgctcgatttagctacgactgcgagggggggagaggagcccagcactgggattccgaggtgtttccattcggtgatcagcactgaacacagaggactcaccagtggagtttggntgagcttggttttccttgttgctatttacgaaaggtgtccagtgtgaggtgcgagngtggtggagacgtggaggagccttagactccgaggtccggtcggggggtccctaggaacgacctcgttccgtgtagccgacgtcgtcgtcggttccacgtcgagtagacgaacgtacagtgaggtacgtcgggtacccnccgacggacctcggaagggtacggcgtaggtacgtaggacgtacgtacgtagtttaattacgttcggtacggttaaggtaaacctagaacgttaccgtaacggacaacggtacgtccgggaaggacggtaccgtagtaacccactacgtaccgaacgacgacgaaacttacgtaaccgaaagtaccggtacgtacgttataacgtaacaaacgtcgaaatacgacgtagacgacgtaccgacgtacgaccgtccgtacgtagttaagttcgagttcgagtaagaactacggtaaacncgaaccggtccggtacggaacccaagttaacgtaggtaccctaggtaaccggg

SEQ ID NO: 155507 - DNA, 655 bp, Homo sapiens
  misc_feature: GYAE6OF02JOFLI.22.11.A11.1.454.CMB.1.raw
  modified_base (140)..(140): a, c, t, g, unknown or other
  misc_feature (140)..(140): n is a, c, g, or t
  modified_base (156)..(156): a, c, t, g, unknown or other
  misc_feature (156)..(156): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (321)..(321): a, c, t, g, unknown or other
  misc_feature (321)..(321): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (571)..(571): a, c, t, g, unknown or other
  misc_feature (571)..(571): n is a, c, g, or t
tcagacatacgcgtcacgaccggtgctcgatttagctacgactgcagggtgtacacctgtggttctcgggctgccctgtagggacagaggttcggcacagcggtcacctcccagggcagagggtgggccgagccggcctntgtccatgtggccctnatccccgcgggtccctgagctctccgtgtgcagcctctgggttaccnccgtcaggtacncgaacgtanatgagcgtgggtacccncgtagcctcggagggacgggtctgagttggattctctagttttattacgtcggtcggtcgaactacctataccgtaccgngtaacggaccttccggtagggaaccgggcaatttccaacgtctacctccgaagtacaacccgaattccgaacgtaaacgtgggtaacttacgtcttaacgaatacggaaccttaggcctaggacgaccgtnacgtcggaacnccggtactggtacctagtctagtcgatagtactaattcgacggccggccgggttacaaccgttatcgtactaccggtagggcctaaacgggaccgttcgtctaccgtnccccgttagacgttccgacccgacggaccgtccggaccttccggttaaccctcccgcgggttcgccccttcggtccacgggccg

SEQ ID NO: 155508 - DNA, 715 bp, Homo sapiens
  misc_feature: GYAE6OF02GDLQM.22.11.A11.1.454.CMB.1.raw
  modified_base (250)..(250): a, c, t, g, unknown or other
  misc_feature (250)..(250): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctatttcaaaaggtgtccagtgtgaggtgcagctggtggagactggaggagccttgatccagccgtgggggtccctgacgactctcctgtgcngcctcgtcggttcaccgtcagtacgacaagtacatgagcgtggtccgcgacggctaccggaggggacgggcgtagggagtggactcgtacgtagtttaactttagtcgtcggttaggtaaacctacgtaactaacgtacgacgaacgtaccgtccggtagggacgggaccgtacttaccgacctactaccgtaccaggtaacgaactaaaccgttaccgaaaacgtaaccgtaaccgggttacgttaattaccgttaactaaagtaccgaaactacggtacctaacggacggaacgtaccggtaagtccgaaccgaccgggttaccgttaggttaaccgtttacgtggtttacgtacggtaacggtaaccgttaaactaaaaccggtttcccgaaacgggtcccgggtaccggggttaaccaaacccgtttaaggtaccccggtaaccgtacgggtacccggggg

SEQ ID NO: 155509 - DNA, 840 bp, Homo sapiens
  misc_feature: GYAE6OF02G5XU1.22.11.A11.1.454.CMB.1.raw
  modified_base (163)..(163): a, c, t, g, unknown or other
  misc_feature (163)..(163): n is a, c, g, or t
  modified_base (239)..(239): a, c, t, g, unknown or other
  misc_feature (239)..(239): n is a, c, g, or t
  modified_base (430)..(430): a, c, t, g, unknown or other
  misc_feature (430)..(430): n is a, c, g, or t
tcagacatacgcgtcacgaccggtgctcgatttagctacgactgcagggtgtacacctgtggttctcggggctgccctgtagggacagaggttggcacagcggtcactcccagggcagaggtggccgagccggactctgtccatgtggccctacataccccgngggtccctgagactctcctgtgcacgcctcgtgggttacaccgtcagtagccaagtacagtcgagtctcgggtccnccgaggcctcgaggggagggctggagtggattcctacgtagttttacttagtccgtggtacggtaaccatacttaccgtacgcaaggaccgttccgggtaggacggggcccgtaacttccggaaccgtctccgtacccgagacggaactaacttaccgaaagtaaccgtcgggttagtaacttcggttaanaaaacgtcgaaaccgtcgtccgtaaggtagaaccggtccggtaatacggtaaccggtaccgggtaccgttaggttaacgttaccgttaggttacggtacggtaacggttaacgtaaaccgttaaaaccgtttaccggaaaccgggtacccgggtaccgggggttaacccaacccgtttaaagttaccggtaaaccggtaccgggtaccggggacccggtaacgggtaaccccggttcgggtaaccccgtacccgttcccgttacccgtaccgtaccggtaccccgtaccggtaaccccggtaaccggggtaccccctaaccggtttcccggttacccccgttttacccccgggtccgggttacccccggtaccccggttcccggttaccccgttacccggtaaccccggg

SEQ ID NO: 155510 - DNA, 759 bp, Homo sapiens
  misc_feature: GYAE6OF02FQ3BX.22.11.A11.1.454.CMB.1.raw
  modified_base (309)..(309): a, c, t, g, unknown or other
  misc_feature (309)..(309): n is a, c, g, or t
  modified_base (642)..(642): a, c, t, g, unknown or other
  misc_feature (642)..(642): n is a, c, g, or t
tcagacatacgcgtcacgaccggtgctcgatttagctacgactgcagggggggagaggagcccagcactgggattccgaggtgtttccattcggtgatcagcactgaacacagaggactcaccatggagtttgctgagcttgggttttccttgttgcttatttacaaaaggtgtccagtgtgaggtgcagcgtgggtggagacgtggaggtagcttgactccaggccggtcgggggtcctggacgacctcctccgtgtcgaccgacgtccttcgttcgggttcctaccgtagtagacgtaacgaactanagtacggcggtccggtccggtccgaccggcggtaccgaacggggaggggtccgtagggtagggtgggtagtacgttacgttaagttaagttttaacgttcggttccgggttaacggtaaaccgtaactaaacgttaccgtaaccggtacgtaacgtaacccggtcggtaacggggtaccggtccgggtacctacgtaccactccgtacacgtacgaactaactaaccggaacaaacgttcgggtactaacgttacttaaacgagtaactacgtacggtcctaaggactaacggacgtacgtagaccgtaccgggtacttgttaaccgtttcgnggtttacgtgaaggttaacgtaactaaacccggttaacgtaaccggggtacccggtaccggggtaacccttacgtaaacccggttaggtccgttaaccggtcgggggtaacccccgg

SEQ ID NO: 155511 - DNA, 885 bp, Homo sapiens
  misc_feature: GYAE6OF02HUB23.22.11.A11.1.454.CMB.1.raw
  modified_base (162)..(162): a, c, t, g, unknown or other
  misc_feature (162)..(162): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (477)..(477): a, c, t, g, unknown or other
  misc_feature (477)..(477): n is a, c, g, or t
tcagacatacgcgtcacgaccggtgctcgatttagctacgactgcagggtgtacacctgtggttctcggggctgccctgtagggacagaggttggcacagcggtcacctcccagggcagagggtggccgagccggctctgtccatgtgccctcactccccgngggtccctgacgctctcctgtgcagtcctgtggtcaccgtnagtncaagtnatgagcgtgggtaccncgaggtcctaccggaggggtacggggctagggaggttaggacttcctgtaagttttattacggttcggtacggttacgtaacccagtaccttaaccgtacgaccgtaggtacccgttaccggggtgggaccgggtaccctactttaaccacccggttacttacctaccgaaggtacgaaccttaaacgttacgaaaaacgtaccggtaggttactttactaaccgttaacgtaaagtacgtaaaccgngtaccggtagaaacggtacgaaccgtacggtaacgaccggttacccggggtactttaacggtttaacttacggtggtttacggacgttaaacgtaacgttaaacctaaacccggtaccgtaaccggggcccgggtttaaccggggaaacccttaaaaccccgggtaattaaccgggttaaccgtaacgggggtcccgggtaaacccgggtaaacccgggtaccgtttaacccgggttcccgtacccggttacccgttaacccggttcctaccccgggtacccctaacccggtaaaccgggtaacccgggttacccgttacccggttaccccgggttttccccctaccccccgggtcggggttaaccccgttaccccggtcccgtttaccccgggtccgtaaaccgggg

SEQ ID NO: 155512 - DNA, 734 bp, Homo sapiens
  misc_feature: GYAE6OF02JV2XD.22.11.A11.1.454.CMB.1.raw
tcagacatacgcgtcacgaccggtgctcgatttagctacgactgcagggtgtacacctgtggttctcggggctgccctgtagggacagaggttggcgacagcggtcactcccagggcagagggtgggccggagccggcctctgtccatgtggccctcataacccgcgggtccctgagactctcctgtgcacgcctctgggttccaccgtcagtagcaagtacatgagctgggtccgcacggctccgagggagggctggagtggatctcgtagttatttatctccggtagtaacactacgtactacgcaagctccggtaggacggacgtacttccaccgaattccgtaccgagtaagaaccaacttacgaaacgaccgtaagggtatttaactacctttaacaaacgttacgaaacgtaaggtacccttaggaacgacggaacccgtaatacggaacgtacccgggtcccggtaagtttacgttaaccgtgtacggtagaacggttaaactacgttaaaacgttccctaagggtacccgggaacgggttacctaaaccgtaacgttataacccgacggttacgggtaaccgacgggttaaccggccgtaacccgttcccgccgttaccgttaccgacgtcccgtacccgtaaccggaaccgtacccggtacggtcccgttaccgttacccccggttaccgcccgggttaccccgcttaccgggtacccccacggg

SEQ ID NO: 155513 - DNA, 905 bp, Homo sapiens
  misc_feature: GYAE6OF02GJF5T.22.11.A11.1.454.CMB.1.raw
  modified_base (237)..(237): a, c, t, g, unknown or other
  misc_feature (237)..(237): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagactctcctgtgcagcctctgggttccaccgtcagtagacaagtacatggagcgtgggtcccnccaggctccgaggggagggctggagtggatctctagtttatttacgtccgtcggtagtaaaccactagtaccgtacgacaggtaccgttccggtaggggaccgggtaccctaagtttcccgaacccgtagttccctaaccgaaggtaaccgtaaccttaaactttacccggaaaaggtaaacccgtacggggttactttaacgtttcccttaaacgaaaaacgttacggaaaccctaggttaccccgtaggggtaaccggaccggaacccgtaagttacgggtaacccggtaaccgggttacccggtttaacggtttaaccgtttaaccggttggttacgggttacgggtaacggtaacgttaaaccgtaaaaccgtttaacccggaaaccggggtacccggggtaacccggggggttaccctaaaccccggttaaacggtttaccggtaacccggttaacgggttaccgggggaaccccggtaaccggggtaaccccggttccgggttaacccgtaccccggttcccttacccgttaccgtaccgtccccgtaacccggtaacccggtaacccggtccccgtaacccggttcccggtttacccccgttcccccgggtaccggtaccccggttaccccggtccggtaccccggtaccggtaacccggg

SEQ ID NO: 155514 - DNA, 882 bp, Homo sapiens
  misc_feature: GYAE6OF02HA5EF.22.11.A11.1.454.CMB.1.raw
  modified_base (787)..(787): a, c, t, g, unknown or other
  misc_feature (787)..(787): n is a, c, g, or t
tcagacatacgcgtcacgaccggtgctcgatttagctacgactgcaggggggggagaggagcccagcactgggattccgaggtgtttccattcggtgatcagcactgaacacagaggactcaccatggagttttggctgagcttgggttttccttgttgctatttacaaagtgtccagtgtgaggtgcagctggtggagacgtggaggagtccgttgactccgaggccggtcggggggtccctaggacgtacctccgttccgttggtcgactacgtcccgttcgtttccggggttccgtaaccccggttacgaaggttaacggaccgtaaaaggtacctaaggtcggtaacggtccggttaccgggggtccccggacccggtaaccgggtcccgttaccccgggaaacgggggggtaaccggggtccggttacggggtaacgggttacggggaacttccgttaacggttaacggtttttaagttttaacggttccggtttacgggttaaccggtaaacctaaaccgtaacgttaaaccgtaccgtacgtaaacggtaacccgttaccggggtacggggtaaccggggtaccggtaactttacccgaaccttacctacccgacccgtaaaagggtacccgtaaaccgttaaaccgttacccgaaaaaggtaaaccggtacccgggtttataacctttaccgtaaactaaagtaaccggaaccgtacctaccgaggtaacggaccgtaccgtacgtacggaaccgtacggttccgttagtaactttcgnggttacgaacgtagtaaacgttaacctaataccccggtaaggcccgggtacccggtactaaaccccgtagttaccggtacgaccgggtaccgggg

SEQ ID NO: 155515 - DNA, 933 bp, Homo sapiens
  misc_feature: GYAE6OF02F82EE.22.11.A11.1.454.CMB.1.raw
tcagacatacgcgtcacgaccggtgctcgatttagctacgactgctgggggggagaggagcccagcactgggattccgaggtgtttccattcggtgatcagcactgaacacagaggactcaccatggtagttttggctgagtcgttgggttttccttgttgtcttatttacgaaaaggtcgtccgagtggtggaggtgcagtcgtgggtggagtacgtgggaggagtccgtttgaacttccgaggcccggttacgggggggtccctggacgaccttccgtcctgtgcacgtccttccgttgggttccaccgtacgagtagaccgtaagtacagtggacgtcggttcggggtcccgacgacggtccgtacgggagggggaaggggcgtacgggtaggtcgggtaacttccttacggttaagttttacgttttacggttccggttacgggttaaggtaaacctacgttaacgtaacgttacggaacgtacggtacccgtttcggggtacggggaacccggggtacccgttaacgtttaccccgaacccttacccgttaacccgtttacccgaaagggttaacccgtaaaacttaaaaccgttaaacccggtaaaaaccggttaaaccgggttaaccccggtttaagggtttaacctttaaacccttaaaggttaaaccgttaaaacccgggtaaacctccggtaaccggttaacggacggtaaccgggacccgtacgggttaccggaacccgggtaaccgggttaccgtttaggttaaccgttttaaccgggtgggtttcgggaacgttaacgttaaacgttaaaccgttaaaaacccggttccccggtaacgggggaccccggggttaccgggttaacccgttaaacccgtttaacggttaccggtaacccggggttacggttaacccgggggg

SEQ ID NO: 155516 - DNA, 645 bp, Homo sapiens
  misc_feature: GYAE6OF02FL9OP.22.11.A11.1.454.CMB.1.raw
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcatacccccgcgggtccctgagctctcctgtgcacgcctcgtgggttccaccgtcagtagcgaagtacatgagtcgtgggtccgccaggcctccggagggaacgggctggagtggtctcgagtcttggttagtggtggtgtagtgggtgcaacgatacgtacgcagacctccggaggaacgggtccttcgacactccgacaagacgtacaactaccaaagacccacctatanatcganaaacgtgaacngtccgtagacgacgaccgaagacgaccgtactactaacgtcgtaggtcggacgaagggtcgtagaacgtcgacgtagactacgtcttacgttacgtcgttaacgttaccgttaccgtacggttccgtacggggaccgacgggtacctacccgttcggtaccgtcccggtcctcccggtacaccggtacccgtaccggaacccgtaccgggtacccgtacgtcccggttccccttacccccgg

SEQ ID NO: 155517 - DNA, 597 bp, Homo sapiens
  misc_feature: GYAE6OF02HR7WJ.22.11.A11.1.454.CMB.1.raw
  modified_base (231)..(231): a, c, t, g, unknown or other
  misc_feature (231)..(231): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcgggtccctgagactctcctgtgcagcctctgggttcaccgtcagtagcaagtacatgagctgggtccnccaggcctccgagggagggctggagtggatctcagttatttatcgtcggtgtaacacatactacgcagactccggtggagggccgattccaccntcctccagacacaattccaaagaacacggtntatcttacaaatcgaaacngcctgagtagccgatcgacgacggtccgtgttaatacgtgtgtgagatacaaaattccgaagccggacgggtccaaaccgtaattcgtactacggtcggggaccaacgggtaacccgtcggttaccaccgtctcctacgacgccctacccgaccgaaccggcccaacgttcccggttcccttcccccggtcggcccgtccccgtcgccccgtccgaaccggg

SEQ ID NO: 155518 - DNA, 787 bp, Homo sapiens
  misc_feature: GYAE6OF02G8T5M.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagtttggctgagtcgttgggttttcctgttgctatttacgaaaaggtgtccagtgtgaggtgcagtcgtggtggagacgtgggacggacgtccgttgactccgacggtccggttcggggggtaccctaggtacgaccttctaccgtgtcgccgtacgtcccgttcggttcggttacctaccggtacgtaaggtacgacgtaacgttaccgagtacggtacggtccggttaccggggtaccccgtaccggtaccgggtacccggtaccgggaacgggggtaaccgggtcggtagggtacggtacggtacgttacgttacgttaacgttttacgtttacgtccggttacggtacgtaacctacgtaacgttaccgtacgcgtaacgtaccggtcggtacgggtacggtaccgtacttacgacctacgtaccgtacgacgtaactaaccgtaacgtaaccgaacgtaccgtacggtacgttacgttacgttaactaacgtacgtaaccgtcgtaccgacggtacgaccgtaccgtacgtacgaccgtaccggtacgttacgttaacgttcgttacgtacgtagtacgtaactaaccgtaaccgtaccgtaaccgggtccggtaccggtacctaccgtaacgtacgtaccggtaccggtaccgg

SEQ ID NO: 155519 - DNA, 745 bp, Homo sapiens
  misc_feature: GYAE6OF02GFL1I.22.11.A11.1.454.CMB.1.raw
  modified_base (244)..(244): a, c, t, g, unknown or other
  misc_feature (244)..(244): n is a, c, g, or t
  modified_base (397)..(397): a, c, t, g, unknown or other
  misc_feature (397)..(397): n is a, c, g, or t
tcagacatacgcgtcacgaccggtgctcgatttagctacgactgcagggtgtacacctgtggttctcggggctgccctgtagggacagaggttggcaccagcggtcactcccgaggcagagggtggccgagccggcctctgtccatgtcggccctcactaccccgcgggtccctgagacttcctccgtgtgcacgtcctgtcggttcaccgtcgagtacgactaagtacatgagcgtggtaccncgagcctacggagggagggctggagtggatcgtacgtattatttacgtcgttcggtaggtacactataccgtacgcaacgtacgtcggtggtacggccctaatccacctcgtactccgagacgtacacttacgaacgaacgttcggtaacgtnttaccgttactaaagtacgaacgtaacgtccgtaaggacggtaaccgaccgtaagtaacggaccggtacggtaccggttagttacgtttaccggttggtagacggtaaaggtctaaccttaaacccgttaggtaaccggaccgggttaccgggtaacccgtaaccttaaacgttaccgtaaccggttacgggtaccgggtccgggttaaaccggacccgttaccgggtaccgtacccggttaccttaccggacctacctaccggtaaccaaccccggtacggtaccccgacggttcccgggtaccctccccggtacggtcccgtaccgtcccgttgtacccggtaccg

SEQ ID NO: 155520 - DNA, 1036 bp, Homo sapiens
  misc_feature: GYAE6OF02FSOP3.22.11.A11.1.454.CMB.1.raw
tcagacatacgcgtcacgaccggtgctcgatttagctacgactgcagggtgtacacctgtggttctcgggctgcctgtaggacagagttgcacagcggtcactcccagggcagtagggtggccgagccggtcctctgtccatgtcggccctcactaaccccgcgggtccctgtacgacttccgtcctggtcgacctacgtccgttcgttgggttccaacccggttcgaaggttacgactaaacggttaccagttcggacgccgttcggggtacccgacgtacgggtcccttacccggaaaggggggtaacggggtcctaggggtaccgggttaggtaacgttccgttaaccggttaagtttttaaccggtttttaacgtcccggttaaccggggtttaacggttaaaacccacgtttaacggttaaccccgttaccaacgggtaccggttacccggtttaacgggtacgggggtaaccggtcccgttaaacttaacccggtaacccgtccgttacccttaacccgggaaagttaacccggtaaaccctttaaaccgggtttacccgaaaaaacggggttaccggtaacccggtttagttaaccttttacccggaactaaaacggttacgaacgtacgggtacctaggggaaccgtacgtaccgtaagtccgaccgtaacggtccgtttaacgttagttaccggtaggtttacgtaacggacgttaacctaaaccgttaaacgtaccgggtaaaccgttcccgggggaacccggtttaaccgaaaccccgtttaaggttacccgtaacgggtttaacccgggtccggggtaaccccgttaaaccgggttaccccggttaccgttaaaccccggttcccggttacccgttaacccgtcccggtacccgttaccccggtaaccgggtaaccccggttaaaccggtccccgtaacccggttttaccccggtcccccgtttaccccgggttaaccgcccggttaaacccggttcccccggaaccgtttacccggaaccggg

SEQ ID NO: 155521 - DNA, 929 bp, Homo sapiens
  misc_feature: GYAE6OF02GDAZL.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagttttggctgagctgggttttccttgttgctattcaaaaggtgtccagtgtgaggtgcgagctgggtggagactggaggagaccttgatccagccgtcggggggttcccctggacgtaccgtcttccgtagtcgtcacggccctcgtgggttaccacccggtcgaacggttaacgacctaaagttaccagttaggaacgtccggttacggggtaccccgcccggaacgggtcccgttaacccgggaacgggggaacggggggtaccgttaagggggtacggtacggggtacgttaccgttaccgtaaacgtttttaacttttacgttacccggtttacggggtttaacggttaaaccgtaaccttaacgttaaccctttaaccggaccgtaaaccggttacccggttaaccccggtttagggggaaccggggttaccccgtaacgtttaccccgtaaacccgttaaccgtttacccgtaacccggtaaacgggaaacgtaaacccgtaaacgttaaaccccgaaaacggtaaacccggttaaccggggtttacgtaaaccgttttacgttaaacccgttaaaggttaaccgtaaaccggtaaccgtaccggttacgtaacgggaaaccggtaccgtaacggttaccggaaccggttaccggggtacccttaagggtttaacttacgttcggttacggttagaacgttaacctaagtaaaaccctaccggtaacggtcccgggtaaccggggtaaccctaacccggttaaacgttcggtaacccggtacgggtacccggggg

SEQ ID NO: 155522 - DNA, 717 bp, Homo sapiens
  misc_feature: GYAE6OF02JNYEL.22.11.A11.1.454.CMB.1.raw
  modified_base (140)..(140): a, c, t, g, unknown or other
  misc_feature (140)..(140): n is a, c, g, or t
  modified_base (258)..(258): a, c, t, g, unknown or other
  misc_feature (258)..(258): n is a, c, g, or t
  modified_base (696)..(696): a, c, t, g, unknown or other
  misc_feature (696)..(696): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagcccggcctntcgtccatgtcggccctcaccgtaccccggcgggtccctggacgacctctccgtgtcgcacgtcctcgtcgggtccaccgtcagtacgacgtaactacagtcgagtcgtcgggtcccncgaggtcctaccgaggggagggctagggacgtgtaactctacgtagtttattacgtcgtcggtagtaacactaacgtacacgcacgtaaccgtcggtgggacgggtaccctatcccgacctctacgtccgtaacggaacggtaacctaacctaccgggtaaactaaaccggtaaccggttggttaaacccctagtttaacgaaagttaccggaacctacggtaccgtagtaacggactacggtacgtaacggacgtaccggtacgtagtaacgttacgtggtagtagacgtaagtactaaaccgttcgaacgtccggacgtaccgactaagtcgtactagtccggacgacggtacgtaccgaccgtccgtaccgcctccgtaccgaacctcccggtaaccgaggtaccctcgttcccggtccctacccggccggtccncccggttacgcctacggccgg

SEQ ID NO: 155523 - DNA, 744 bp, Homo sapiens
  misc_feature: GYAE6OF02HDK9Y.22.11.A11.1.454.CMB.1.raw
  modified_base (240)..(240): a, c, t, g, unknown or other
  misc_feature (240)..(240): n is a, c, g, or t
  modified_base (404)..(404): a, c, t, g, unknown or other
  misc_feature (404)..(404): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtcggccctcataccccgcgggtccctgagactctccgtgtgcagcctcgtgggttcaccgtcagtagcgaagtacatgagcgtcggggtcccnccgaggtcctccggaagggggaacggggtctggggaagttggggatccgtcgtagtttatttacgtctcggtacggtaacactatacctagcacgtactccggtggacgggcctattccactatcaccgagagaactacgttaccgaaagtaaacgtaccggtntaacttaccttaacgaaacgtacgaaacacgtaccgtagacgaaggtcccagtacgaaccgtacgggtccgttaagttaacgttacgtggtagtacgtaacgtaacgtactaaaacgttccgtaacgggtccggtaccggggtactaaacccgtaagttaccgaacggttacgtccggggaaccctaacgggtaacccgtaggttacccggaacccgttccgtaccgtacctaccgtacccggtaacccaccgggaaacccggcccgtaccggtacccggtttccccgttacccccggtccggaccccggtcccgtccggtacccgttacccggaccggg

SEQ ID NO: 155524 - DNA, 739 bp, Homo sapiens
  misc_feature: GYAE6OF02FW1CJ.22.11.A11.1.454.CMB.1.raw
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcactaccccggcgggtccctgagactctcctgtgcagcctcgtgggttcaccgtcagtagcaagtacatgagctgggtcccaccaggctccgaggggagggctggagtggatctcgtagtttatttanccttcgggtagtaaaccacgtataacctacgcagacctccggtgggacgggcctattccaacctatcctaccgagaacgaactaacctccgaaagaactacgggttntaacttcttaacaaacgtacgaaacacgtccttaaggaacgtaacggcccgtaagtacggtaaccggaccgggtaccggttagtttaacgtttacgttggtaggttaggtaagtaactaaacgtaaaacgttacccgaaacgggtcccgggtaccgggggtaaccaacccgtaaagttaccgtaacgtaaccggtacggggacccgtaacgggtaacccgttcggtacccgtaccgtaccttaccgtaccaccgtccctaacccgaacccggaaccgggtcccctaccggttcccggttaccccgttaccccgtcccggtcccgccccgtcgtcccgtaccggtaccggg

SEQ ID NO: 155525 - DNA, 781 bp, Homo sapiens
  misc_feature: GYAE6OF02F257Y.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggtagttttggctgagcgttgggttttccttgttgtcttatttacaaaaggttgtccagttgtgaggtgcagcgtggtggagacgtgggaggagccttagatccgacggtccggtcgggggtcctgacgacttcgtcctgtcgcgacgccttcgttcggtccaccgtacgtaagtacggtactaaacgtcgtagtggaacgtcggttcggtccccggaccgtacggccgtaccgggaacggggtaacggggtcgtagggtacggtggtacgtacgttacgttaggttttaactttacggttcgtttacggttaacggtaacctaaacgttacgttaacgtaccgaccgtaacggtacccgttacggggtaacgggacgggttacccgttacgttaccgacccttacgttcccgtaccgaacggaaacgttaacctaaaccgtttaacccgaaacggtaaacgtacggttaacgttttaacgtaccttaaacgaaacgtacgaaacccgtagaccgtggaacgacggtacctagtacgtaaccggacggttacgtttacgttacgttacgttgtacgttagaattaacggtaactaaccggtacgaccggaccggtacggtaaccctaacgtacgtcgtaaccggtaggtacccggg

SEQ ID NO: 155526 - DNA, 723 bp, Homo sapiens
  misc_feature: GYAE6OF02GQK9M.22.11.A11.1.454.CMB.1.raw
  modified_base (208)..(208): a, c, t, g, unknown or other
  misc_feature (208)..(208): n is a, c, g, or t
  modified_base (462)..(462): a, c, t, g, unknown or other
  misc_feature (462)..(462): n is a, c, g, or t
  modified_base (474)..(474): a, c, t, g, unknown or other
  misc_feature (474)..(474): n is a, c, g, or t
tcagacatacgcgtcacgaccggtgctcgatttagctacgactgcagggtgtacacctgtggttctcgggctgccctgtaggacagaggttgcacagcggtcactcccagggcagagggtggccgagccggcctctgtccatgtcgccctcactaccccgcggtccctgacgctcctcgtgtgacacgtcctcgtggttaccaccgtntaaggtgaccaagtacagtggacgtccgtcgggtcccgacctacgggtccctaccgggaagggggaacgggtcgttagggtacggtaggtacttccgttacgtaaggttttactttaacgtcggttacggggtactaaacacgtaagtaccgtacgacgtacggtaccgttccggagggaccggtacctacttacaccgttactccgtaccaagacgtaactaacgttaccaagaccgtggtagtactacttanaaagtcgaaacncgtcctaagacgaccgacgtatacgacgtcggtacgttgtacgttacgtgtagtacgtactacgtaacctaaatccgtaaggacccggtacggacctaaccgtaagtacgacgtacgacgggacctacggtaaccgtcgtacctccgtcctaccgtcacccgtccgacccgtaaccgaccggtaccctaacgttcccggtccccgtcccggtaccgtcccgtacccggtcgtacccgtccggtaaccgg

SEQ ID NO: 155527 - DNA, 789 bp, Homo sapiens
  misc_feature: GYAE6OF02H0JNK.22.11.A11.1.454.CMB.1.raw
  modified_base (443)..(443): a, c, t, g, unknown or other
  misc_feature (443)..(443): n is a, c, g, or t
tcagacatacgcgtcacgaccggtgctcgatttagctacgactgcagggtgtacacctgtggttctcgggctgccctgtagggacagaggttggcacagcggtcactcccagggcagagggtggccgagccggctctgtccatgtggccctcactaccccgcgggtccctgacgactctcctgtcgcacgcctcgtgggttcaccgtcagtacgcaagtacatgagtccgtcggtcccgcaggcctaccgaggggtaacgggctacgggagtcggattccgtactaagtttattacgtcgtcggtagtaacacattacctacgcaacgtacctcggtaggacgggcctactttccgaacccgtattcctaccgaaggtaccgaacctaacgttaccgaaaagtaaccgtcgttagttactttactaacaaacgtcggaaaccncgtacgttaggacgtaacggccgtaagtacgaacccgaccgggtacccgttaagttaacgtttacgtaggttcggtaaggacgtaacttaaacgtaaaacgtttacccgaaacgggtccccgggtaaccgggggtaccctaaacccgtaaacgtttacggaacccttaacgggtacccggggtaaccgtaaaccggggtacccttaccgggtcccgtaaaccgttcccgtaccgttaccgtaccgacccctaccgaacccgggaacccggtcctaaccggttccccgtacccggtttcccccggtcggtccccgtaccccggtccgttcccgtacccggtaaccgg

SEQ ID NO: 155528 - DNA, 722 bp, Homo sapiens
  misc_feature: GYAE6OF02IOT0T.22.11.A11.1.454.CMB.1.raw
  modified_base (242)..(242): a, c, t, g, unknown or other
  misc_feature (242)..(242): n is a, c, g, or t
tcagacatacgcgtcacgaccggtgctcgatttagctacgactgcagggtgtacacctgtggttctcggggctgccctgtagggacagaggttggcacagcggtcactcccagggcagagggtggccgagccggcctctgtccatgtggccctcataccccgcggtccctgacgacctctcctgtcgcacgtcctcgtgggttccaccgtcgagtacgcaaagtacatgagcgttgggtccnccgagggtcctaccggaaggggaacgggctagggacgttggactcgtctagtttattagtcgtcggtaagtaacactattaacgtcgacgtagaccttcggagggacggacctattccaccgtatcctaccgaaggagtaacctaacgttaccgaaagaacctcgggttattaactaccttaacaaaacggttcgaaaccgtacgtcccttaaggaacgccgtaccgtagtaccgaaccgtacggtacgtacgttacttacgtgttcgtagtaacgtaataactaaacgttacgaaccgtccggtaccgggtaactaaaccgtaacgtacgtaacgtacggtacggaccgtaacggtaccgtagtcccgtacgtccgtacctcgaccgtaccgtaccgaacccggtacccggaccgtaccgttccccggttacccgttccccggtacggtcccgcccgtaccgtcccgtaccgtaaccgg

SEQ ID NO: 155529 - DNA, 671 bp, Homo sapiens
  misc_feature: GYAE6OF02H54CB.22.11.A11.1.454.CMB.1.raw
  modified_base (180)..(180): a, c, t, g, unknown or other
  misc_feature (180)..(180): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (551)..(551): a, c, t, g, unknown or other
  misc_feature (551)..(551): n is a, c, g, or t
tcagacatacgcgtcacgaccggtgctcgatttagctacgactgcgaggggggagaggagcccagcactggattccgaggtgtttccattcggtgatcagcactgaacacagagactcaccagtggtagtttggcgtgagtcgttcgggttttccttgttgtcttagtttacgaaaggtntccagtggtgaggtgcagtcgtggtgacgtacgtgggagcgtccttgtactccgacggtccggttgggggtcctggacgtctcctacgtcgtagcgtacgcttcggtacggtccaccgtnagtanacaagttacntgacgtcgtacggtcccgcgtacgccgtaggacgggacgggtctaggacgtgacgtcgttagtaggtttattcggtcgtacggtaacggtaccacgtataacccgtacggcgttaacgtaccgtcggtacggtaccggccctaacgtccgtaaccctcttaccgaccgaagtaacgtaacctacgttaaccgaaaccggaacgttcgttacaactttcgtaaactaagtacgaccngtccgagacgcggacagcgaccgtccgttacgcttagttctggaccgtatacgtacttaacggtaactaccggaccggtccggtacggtaaccacgttaacgtgtaccgttacggaccgg

SEQ ID NO: 155530 - DNA, 753 bp, Homo sapiens
  misc_feature: GYAE6OF02GZ48D.22.11.A11.1.454.CMB.1.raw
tcagacatacgcgtcacgaccggtgctcgatttagctacgactgcagggtgtacacctgtggttctcggggctgccctgtagggacagaggttggcacagcggtcactcccagggcagagggtgggccgagccggcctctgtccatgtggccctcataccccgcgggtccctgagacttctcctgtgcagcctcgtgggttccaccgtcagtagcaagtacatgagtcgtcgggtccgccgagggcctccggaggggaaggggctgggagtggatctcagtttatttatcgtcggtgtaacatatactacgcagaccgtcggtggacggccattccaccatcaccagacgacaacttaccgaaagtaccgtacggtatacttctaacaaagtcgaaacacgtccctaggaacgacggaccgtaagtcgaaccgaccgggtacccgttagttaactttacgttagttcggtagaacgttaacttaactaaaacgttaccgaaaccgggtccggggtaccggggtaaccctaacccgttaaagttacggtaaccgttaaccgggtcgggggaacccggtaaccggggttaaacccggttccgggttacccgtaccccggtttccgttacccgtaccctacggtacccccgttaccccgaaacccgggtacccggtaccctaaccggttccccggtttacccctttcccccggaccgggttcccgtacccccggtcggttcccgacccggtaacgg

SEQ ID NO: 155531 - DNA, 756 bp, Homo sapiens
  misc_feature: GYAE6OF02JYPGB.22.11.A11.1.454.CMB.1.raw
  modified_base (193)..(193): a, c, t, g, unknown or other
  misc_feature (193)..(193): n is a, c, g, or t
  modified_base (363)..(363): a, c, t, g, unknown or other
  misc_feature (363)..(363): n is a, c, g, or t
tcagacatacgcgtcacgaccggtgctcgatttagctacgactgcgagggggggagaggagcccagcactgggattccgaggtgtttccattcggtgatcagcactgaacacagaggactcaccatggtagtttgctgagcgttgggttttccttgttagtcttattactaaaaggtgtcgagtgtcgaggtncgagctggtaggagacgtgggaggacggtccgttgacgtccgacggtcccggttcggggggttccctgggtaacgtaccgttccgttcccggttagcggcgtaccgtcccgttacggtccggttacgtacccgtacgtaaggtacgaaccgtaacgtaccgtagtacggnggtccggttacgggaccccgcggacggtcctaccgggaacggggacgggtacgtgggtaacgtgggaaactcgtcgtaaagtttacgttacgtcggttacggtaccgtaacgtaaccgtagttaacgtacggacctggtaaccgttccgggagggtacgggtacccgtactacccgacgtacgaccgtaacgacgaacggtaactaaccgttactaaacgtaacgtacggtagtacttacgtataaacgtacgaccgaagtccacgacgtagacgtaacggcgtaccggtaaccgtacgttacgttaacgttacgtgtacgtgaacgtaactaaacgtaacgtaacgacccggtacgacgggtaccacgtaacgtacgtacgtaggtaccggg

SEQ ID NO: 155532 - DNA, 793 bp, Homo sapiens
  misc_feature: GYAE6OF02F7S93.22.11.A11.1.454.CMB.1.raw
tcagacatacgcgtcacgaccggtgctcgatttagctacgactgcaggggggagaggagcccagcactgggattccgaggtgtttccagttcggtgatcagcactgaacacagaggactcaccagtggtaggttttggctgagccgttgggttttccttgttgctatttacgaaaggtgtcgagtgtgaggtgcagcgtggtggagacgtgggaggagtccttgactccgacggtccggttcgggggtccctgacgtacttcgtaccgtgtcgctacgtccttcgttggttccgaccgtacgaggttacgaacgaaggtaccagtggacgtcggttcgggtacccgccgtagggtccgtacccgggaaggggaaggggtccgtagggaggtagggtacttaccgttgtaaggttttactttacgtacgttacgggttaggtaaacccttaacgtaacttaacggtacgtaccgtaaggtaccccgttaccgggtacggggtaccggggtacccttacgtttacccgaaccttacggttaccctaacccgggaaagtaaccgtaaccttaggttaaacccaacgtaaaccggtcggtagttaaccttcctaaagtaaattaccgaaccgacgtaccgtagggtaacggacggacctacgtaccggaaccgtaccggttacgtacgttaacttcggtcgtaggacgtacgtaactaacttaaaccgtccgtaaagggtcccgggtacgggttaacccaacggttaaggttacccgacgggttcccggaaccgggg

SEQ ID NO: 155533 - DNA, 709 bp, Homo sapiens
  misc_feature: GYAE6OF02HTL7M.22.11.A11.1.454.CMB.1.raw
  modified_base (697)..(697): a, c, t, g, unknown or other
  misc_feature (697)..(697): n is a, c, g, or t
tcagacatacgcgtcacgaccggtgctcgatttagctacgactgctggggggggagaggagcccagcactgggattccgaggtgtttccattcggtgatcagcactgaacacagaggactcaccatggagttttggctgagcttgggttttcctgttgctatttcaaaggtgtccagtgtgaggtgcagctggtggagacgtgggaggagtccttgatccagccggtcgggggtccctgagacctctcctgtgcacgtcctcgtcggttacaccgtcaggtacgacgtaacgtacgaagtcggagtaccgttcgggaccccgtaccgaggtacccgtacggaagggggaacggggtccgtagggagttggacgttcctagttacgtttatttacgtacgttcggttaggtaacctaactctaaccgtacgacgtacggtcgtacccggtagggaccggtcgtacttccgaccgtacgtcctaccgagaacgtaacaaccgttaaccgaaagtaccgtaacggtgtaacttactaacgtaaagttccgaaaactcccggtcgtaaaggtccggaccgtacgtaagtccggaccggtaccgggtaaccgttgttaaccgttcgtgtaggtacgtagtaacctaaccgtaaagtcccggtaacgggcccggtacgggtacctaaaccgacggttcgtacncgggtacccggg

SEQ ID NO: 155534 - DNA, 811 bp, Homo sapiens
  misc_feature: GYAE6OF02FVMC6.22.11.A11.1.454.CMB.1.raw
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
tcagacatacgcgtcacgaccggtgctcgatttagctacgactgcagggtgtacacctgtggttctcgggctgccctgtagggacagaggttggcacagcggtcactcccagggcagagggtgggccgagccggcctctgtccatgtggccctcactaccccgcgggtccctgacgactctcctgtcgcagtcctcgtgggttccaccgtcagtacncaagtacagtgagtcgtgggtcccnccgaggctaccgaggggaaggggctaggagtggactctacgtagtttatttactcgtacggtacggtaacactatacgtacgctacgtaccgtccggtgggaacgggtccgtacttaccgacctagtcctaccgaagaacgtactaacttccgaaacgaaccgtacggttagtacttaccgttaacaaacgtggaaactacgtaccgtaggaacgtacgaccggtagtaccgacccgaccgggtccttaagttacgtttacgtggttacgtacgtaagtactaaacgttaaacgttaccgaacgggtaccggggtacccggggtaacctaacccgtaaacggttacgtaaccggttaccgggtaccggggtaaccggtaaacccggggttaaccccggttacgggttacccctacccggtttacctaccccgttacgaccccggtaccccgtaacccggaacccgggtaacccgggtacccccttaccgggtttacccccggttcccccgtttaccccggtcccggttacccccggtacccgtcccggtccccggttaaccgacccggg

SEQ ID NO: 155535 - DNA, 783 bp, Homo sapiens
  misc_feature: GYAE6OF02IWYFL.22.11.A11.1.454.CMB.1.raw
  modified_base (247)..(247): a, c, t, g, unknown or other
  misc_feature (247)..(247): n is a, c, g, or t
  modified_base (411)..(411): a, c, t, g, unknown or other
  misc_feature (411)..(411): n is a, c, g, or t
tcagacatacgcgtcacgaccggtgctcgatttagctacgactgcagggtgtacacctgtggttctcggggctgccctgtagggacagaggttggcacagcggtcactcccgagggccagagggtgggccgaggccggcctctgtccatgtcggccctcagtaccccgcgggtccctgagacttctcctgtgcacgtcctcgtgggttccaccgtcagtacgacaagtacatgagtcgtcgggtccnccaggcctccgagggaggctggagtggatcgtatagtttacttacgtccgtgggtacgtaacactacttacgtacgctaacgccgtccggtagggaccggtccgtacttaccaacctactccgtaccgaagtaaccactaacttaccgaaagaacgtaacggtnttaactccttaagaaagtacgaaacctagaccgtaggaacgacgtccgaatacggaaccgtaccgggtacctttaggttaacgtttaaccgtggttacggtagtaaacgtacctaaacgttaaaccgttacccggaacgtcccggggaaccgggtaccctaaacccgtaagttccgtaaacgttacccgggtacgggaaccccgtaaggtaaccccgggtaccgttaccgtaccccgttcgtacccgtacgtacccgtacccccgttaaccggaaccccgtaaccgggtacccctaacggtttaccccggttcccccctttaaccccggtcgggtcccccggtacccgtccggtaccccgtacgtaaccggg

SEQ ID NO: 155536 - DNA, 621 bp, Homo sapiens
  misc_feature: GYAE6OF02IGCLZ.22.11.A11.1.454.CMB.1.raw
tcagacatacgcgtcacgaccggtgctcgatttagctacgactgcagggggggagaggagcccagcactgggattccgaggtgtttccattcggtgatcagcactgaacacagaggactcaccatggagtttttggctgagctgggttttccttgttgctatttcaaaaggtgtcagtgtgaggtgcagctggtggagactggaggagccttgactccagccgtcgggggtcctgagactctctgtgcacgcctgtcggttccaccgtcagtagacaagtacagtgacgtcgtacgggtcccgccgacggcctaccggaggggacggggtcgtgggacgtggactctcgtagttatttactcgtggtacgtaactacatactacgtacagtaccgtacgtgggacggtaccgtacttccactactctaccgagtacgaactaacgtacaacgacgtacggtataattacttacgaaagttacgaacgtacgaccgtaaggtacgaacgtccgagtaccggacgtaccgggtctagtacttcgtgtacgtagacgtaataccgtaaacgtcccaaggtcccggtacggtacaacccgttaagtacgtaccgtacggaccggg

SEQ ID NO: 155537 - DNA, 639 bp, Homo sapiens
  misc_feature: GYAE6OF02FR1CG.22.11.A11.1.454.CMB.1.raw
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
tcagacatacgcgtcacgaccggtgctcgatttagctacgactgcagggtgtacacctgtggttctcggggctgccctgtagggacagaggttggcacagcggtcactcccagggcagagggtgggccagccggcctctgtccatgtggccctcataccccgcgggtccctgagactctcctgtgcagcctctgggttcaccgtcagtagcaagtacatgagctgggtccgccaggctccgaggggaaggggctggagtggatctcagtttatttatcgtcggtagtaacactatacctacggcagacgtccggtggacggtccgattcaccatctaccgaganactaacttccaaagaactacggtntatctacaaatcgaacagcctgaagagccgatgacgacggacgtgtattacgtgtgtagagtactaactaaacttcaacggaccggccggggtacaacccgtaaagttcgaacgtacggtacgggtaccgaacggtaacccgttcggtaccgacccgttctacccgtccgaccgtacccgtacccgaacccggaaccgggtcccctaacgttcccggttacccgtttacccccgtcggtaccccgtcccgtcgtcccgtaccgtaaccggg

SEQ ID NO: 155538 - DNA, 736 bp, Homo sapiens
  misc_feature: GYAE6OF02FNS5D.22.11.A11.1.454.CMB.1.raw
  modified_base (166)..(166): a, c, t, g, unknown or other
  misc_feature (166)..(166): n is a, c, g, or t
  modified_base (442)..(442): a, c, t, g, unknown or other
  misc_feature (442)..(442): n is a, c, g, or t
  modified_base (492)..(492): a, c, t, g, unknown or other
  misc_feature (492)..(492): n is a, c, g, or t
  modified_base (521)..(521): a, c, t, g, unknown or other
  misc_feature (521)..(521): n is a, c, g, or t
tcagacatacgcgtcacgaccggtgctcgatttagctacgactgcaggggggggagaggagcccagcactagggacttccgaggtgtttccattcggtgatcagcactgaacacagaggactcacctatggtagtttggctgagcgttgggttttccgttgttcgngttatttaccgaaaagggtcgtacctaggttggtggacgggtgcgaggtcgtgggtaggacgacggtgggaggtacgtccttgataccgtacggtccggtcggggggtccctaggacgtaccgttccgtcgtggtcgacgtaccgtccgttcgttcggtaccctaccgtcgtaacggtacgacgtaacggtactagtggacgtcggtaccgtcccggccgtacggtaccgtcgggtaagggacgggtcgtagggtacgtgtactcgtattagtttnttcgtcgtacggtacgtactagtacttaccgcgtacgtacgtacgtcggnggaaccggttcgactaccgactcgtaccncgacgactaaccgactacgaacgtacggtacgtagtacttaacggaatacgtaagaccgtacgtcgaaggtacgaccgtagtaccgaccggtaacggtccgtaccgtgttacgtacgtttaggcgtacgtagtaacctaacgttaaccgtaccgtacgggaccggttaccgggaaccttaacgtagggtaccgttaccggtaccgggtacccggg

SEQ ID NO: 155539 - DNA, 425 bp, Homo sapiens
  misc_feature: GYAE6OF01AJ3RO.8.21.B10.1.454.CMB.1.raw
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (378)..(379): a, c, t, g, unknown or other
  misc_feature (378)..(379): n is a, c, g, or t
  modified_base (382)..(425): a, c, t, g, unknown or other
  misc_feature (382)..(425): n is a, c, g, or t
tcagctcgcgtgtccacgaccggtgctcgatttagtgtcgtcgcaagaggagggagggggtgaggtcgaaagatgagctggaggaccgtcaataggggtaggtcccctgtggaaaaaggtcagagggatagaagttattcagcaggctacgacaacagaggcgtagttccagttttcacttctcacaatcagcagtctcgaacctgaagattttgcaacgttactactgtcaacagacttacaactataccgaggacgtttcggtcaagggaccaaggtcggagatcaaaacgaactgtaggctgcaccatctgtcttcagtctcccgcatcctgagacgacgcgagctgagcgggtctggcaaaggcncataggntnntannnnnnnnnnnnnnnnnnnnnnnnnnnnnnnnnnnnnnnnnnnn

SEQ ID NO: 155540 - DNA, 624 bp, Homo sapiens
  misc_feature: GYAE6OF01C65IS.8.21.B10.1.454.CMB.1.raw
  modified_base (543)..(543): a, c, t, g, unknown or other
  misc_feature (543)..(543): n is a, c, g, or t
tcagctcgcgtgtccacgaccggtgctcgatttagtgtcgtcgcaagagaggaggggggagtcagtctcagtcaggacacagcatggacatgagggtccccgctcagctcctggggctcctgctcctctggctccgaggtgccagttgtgacatccagttgacccagtctccctctctctgtctgcttctggtggagacagcgtcaccatcacttgccgggcagtcagtccattaacaactaatttaaattggtatacaaaacaaaaaccagggaaacgacccctaaaatacctggtactatactgcatccactttgcaaagtgggtcccatcaagttcagtggcagtggatttggactagttttcactctcacaatcagcagtctacgaacctgtaagtattttcgactaaactttactaacttgtacaactagtaacttacaaattacgtaaccggaagggtacgtttacgggtacgaaacggggtaccctaaagggtcggaagtaacgtaccgaaaacgtaaaccgttggacgggttacncggtaaccacctaacttccgttggtttacccttacgtaacctttacccgtttcccccggaaccctaagttccgtaaacggg

SEQ ID NO: 155541 - DNA, 600 bp, Homo sapiens
  misc_feature: GYAE6OF01B8UU7.8.21.B10.1.454.CMB.1.raw
  modified_base (276)..(276): a, c, t, g, unknown or other
  misc_feature (276)..(276): n is a, c, g, or t
tcagctcgcgtgtccacgaccggtgctcgatttagtgtcgtcgcaagagaggagggggggagtcagtctcagtcaggacacagcatggacatgagggtccccgctcagctcctggggctcctgctcctctggctccgaggtgccagttgtgacatccagttgacccagtcctccctcctctctgtctgcttctggtgggagacagcgtcaccatcacttgccgggcgagtcagtccattaacaactatttaaatgtatcaacaaaacagggaaacnccctaaatacctggtactatactgcatcctactttgacaaaggtcgggtacccatcgtaaggttcaggtggcaggtggtagtttgggactagtttcactctcactaatcagcagtctacgaacctgtaagtattttagactaaactttactactacgtacaactacgtaacttaacaatactaccggaggtacgttcggtacgaacgggtaaccgtaagggtaggaagacgtacgaaacgtacgtaggtcggtacgtacgacctaccctagttccgttacgttacttacctacgttcccttaccccgcctacgttccgtaacgg

SEQ ID NO: 155542 - DNA, 835 bp, Homo sapiens
  misc_feature: GYAE6OF01C783W.8.21.B10.1.454.CMB.1.raw
  modified_base (152)..(152): a, c, t, g, unknown or other
  misc_feature (152)..(152): n is a, c, g, or t
  modified_base (160)..(160): a, c, t, g, unknown or other
  misc_feature (160)..(160): n is a, c, g, or t
  modified_base (178)..(178): a, c, t, g, unknown or other
  misc_feature (178)..(178): n is a, c, g, or t
tcagctcgcgtgtccacgaccggtgctcgatttagtgtcgtcgcaagtaggtaggaggggggagtcagtctcagtcaggtacacagcatggacatggaacgggtcccccgctcacgctccgtgggggctcctgctctctggcctccgaggtnccagttgngacatccagttcgacccngtcctccctcctctctgtctcgcttcgtggtgggacacacgtcgtccaacatccacgttcggacccgggtacgagttaccgaacgttaccctaaattaaaacctaaactttaattttaaaacgttgggtaactaacgaaaaaaccaaaaaaaccgtagggggtaaaactacccccttaaaaagtcccgtaggtactaactacgtagactagtaccctactttacggactaaagggtcgggtacccctaagtacctaaaggttacacggtacggtcctaaggttacggttaacgtttcggggaacttacggtttttaccaccgttaccgtactaaacgtaaccgttgtaacggaccgtaggttacccgtacggtaaacccgtaggtaaacgttacgttttacgggtaaaccttaaaccttttaccgtaactcgggttaaaccaaacgtaacggtaacctttaaaccgaaagttaacctacccgggtaaaggtaccgggttttacccggaaacggtaaaccgggggaaacccgtaaaggggttacggtaaacgaacgtaaccgtaaaaaaccggtccgttaggtacggacttacggaccctaacacttcggttactaccgtttataccttacccgttccccgacttaagtcctaacggg

SEQ ID NO: 155543 - DNA, 815 bp, Homo sapiens
  misc_feature: GYAE6OF01ENMH1.8.21.B10.1.454.CMB.1.raw
  modified_base (151)..(151): a, c, t, g, unknown or other
  misc_feature (151)..(151): n is a, c, g, or t
tcagctcgcgtgtccacgaccggtgctcgatttagtgtcgtcgcaagagaggaggggggagtcagtctcagtcaggacacagcatggacatgacgggtccccgctcagccttccgtggggcctcctgccttcctctggcctccggaggtcncctagtttgtagactactaccgtagttccgaccctagttccctcccctccttctcgtgtctcgtcttcgtggtaggggaacacacggtccgtaccaaccgtattaccgtaccgggttccgggacccggggtacgtacgttacgtaaccgttaaccttaaactttaaaaccttaaactttttaagttttaaacggttaggtaaaccttaaaccgaaaaaccgaaaaaccggtaacgggtaaaaccctaacccttaaaacgttaccggttcgtaacttaactcacgtactaccgttaccttacgttacgaacggtaacgggttccggtacctaaggtacgtaacgtcgtaaggcgtacgtaggttaggttagttacggtactttacgttccacttcaacactatacgagtcgtactacgaagtaaccgtagttaagtttcttaagactttaaaccttactacgttaacgtaactaaagtacgttaaacctaatacgttaacgggtaccgtaggttaacccgggttagaaacggtaacgggtaaccgtaaggtaccgtaaagaacctaaacggtagtaccggttggtacgtacgaccgtaacccgtattacgttcgttaactttcccgacttaacccggttcccctacgaacttcgtaacgtaccgg

SEQ ID NO: 155544 - DNA, 902 bp, Homo sapiens
  misc_feature: GYAE6OF01CNOB8.8.21.B10.1.454.CMB.1.raw
tcagctcgcgtgtccacgaccggtgctcgatttagtgtcgtcgcaagagaggaggggggagtcagtctcagtcaggacacagcatggacatgagggtccccgctcagctcctggggctcctgctcctctggctccgaggtgcctagttgtgacatccagttcgacccagtcctccctcctctctgtctgtcttcgtggtagggacgacgagtccgtccaacctactcctacgttcggccgggacgtacgtcacgtacctacttaaactaactttaattttaaagttagtaactaacaaaaacgaaaaaccggaacggtaaacctaccctaaaactaccgttagtactaactacgtacgactactaccttacgtttacgaaccggtaaagggtccgggtacctaagtacgtaaggttcgaaggtcgacgtaggtacggtagtttacgggactttagtttccaacgttctaacgtactaacgttccgaagtccgtaacgttaccgtaccggtaaaccctaggttaacgtttacgttttaacgaacctttaaaccgtttaactaccgttacggttaaccaaaacgttaacgttaaacccgttaaaactaacggtttaaaccccggttaaccggggttaaacggggttttaaccccgggttttaacggggaaaacccgggtaaaacggggggttaaaccccgttaaaggggggtaaccggtaaaaaccgtttaaccggaaaaccccggttaaaaaacgggttcccgggtttacggggtaacccggtacgttaaccccggaaccgttaaacccggtttactttaccgggttacccgttaacccttttaacccgtaccggttttaaccccccggtccccgaaaccttttggtccccggtaaaacgggg

SEQ ID NO: 155545 - DNA, 571 bp, Homo sapiens
  misc_feature: GYAE6OF01BM5WZ.8.21.B10.1.454.CMB.1.raw
  modified_base (427)..(427): a, c, t, g, unknown or other
  misc_feature (427)..(427): n is a, c, g, or t
tcagctcgcgtgtccacgaccggtgctcgatttagtgtcgtcgcaagaggagaggggggagtcagtctcagtcaggacacagcatggacatgagggtccccgctcagctcctggggctcctgctcctctggctccggaggttgccagttgtgacatccagttgacccagtctccctctctctgtctgtcttcgtggtgggagacagcgtcaccatcacgttcgccgggcagtcagtccattaacacttatttaatgtatacaaacaaaacgaggaacaccctaaatctggtctatactgcatcctagtttgacgtaaggtcgggtaccagtcgtaaggttcaggttcggctaggtggtattgggacttagttttcactctacactatcagctacgtctacgaactgatatttacgactaacttactntagtacaatacgtacttaacaatactacggtagtaccgttcggaacgaacgggacctaagggtgacgaacttacgaaacgtgttgtcgtactcgactacctagttcgtacgttcttactactttccacccgtctgttcgtacgg

SEQ ID NO: 155546 - DNA, 277 bp, Homo sapiens
  misc_feature: GYAE6OF01C4P31.8.21.B10.1.454.CMB.1.raw
  modified_base (252)..(252): a, c, t, g, unknown or other
  misc_feature (252)..(252): n is a, c, g, or t
  modified_base (258)..(277): a, c, t, g, unknown or other
  misc_feature (258)..(277): n is a, c, g, or t
tcagctcgcgtgtccacgaccggtgctcgatttagtgtcgtcgcaagaggaggaggggggggtggttttgataccgtggggccaagggacaaaggtcaccgtctcttcagcctccacaagggcccatcggtccttcccctggcgccctgcctccgaggagccacctccgagagcacaggccggccctgggctgcctggtacaaggtactacttccgacacgcgagctgacggcgggctgggacaagggccgnaatagnnnnnnnnnnnnnnnnnnnn

SEQ ID NO: 155547 - DNA, 632 bp, Homo sapiens
  misc_feature: GYAE6OF02HTNP1.8.21.B10.1.454.CMB.1.raw
  modified_base (129)..(129): a, c, t, g, unknown or other
  misc_feature (129)..(129): n is a, c, g, or t
  modified_base (149)..(149): a, c, t, g, unknown or other
  misc_feature (149)..(149): n is a, c, g, or t
  modified_base (237)..(237): a, c, t, g, unknown or other
  misc_feature (237)..(237): n is a, c, g, or t
  modified_base (275)..(275): a, c, t, g, unknown or other
  misc_feature (275)..(275): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
  modified_base (470)..(470): a, c, t, g, unknown or other
  misc_feature (470)..(470): n is a, c, g, or t
  modified_base (540)..(540): a, c, t, g, unknown or other
  misc_feature (540)..(540): n is a, c, g, or t
  modified_base (552)..(552): a, c, t, g, unknown or other
  misc_feature (552)..(552): n is a, c, g, or t
  modified_base (616)..(616): a, c, t, g, unknown or other
  misc_feature (616)..(616): n is a, c, g, or t
tcagctcgcgtgtccacgaccggtgctcgatttagtgtcgtcgcaagagaggagggggggagtcagtctcagtcaggacacagcatggacatggagggtccccgctcagctcctggggctcctgctctntggctcgaggtgccagttgngacatccagttcgacccagtcctccctcctctcgtgtctgtcctttgtggtagggatacaggcgtcaccattcgacttcggccggganagtcagtccaattaaacatttaagtttaaatcggtaanacaaaacaaaacgagggtaaactacctaaatcgtggtactaanacgtnacaatcctaagttnacaaggtcggtacctnagtaggtcagcganagtgtagttggacttatttcaacgttcatacatcggganctagtccacgtactagaagtttnttacgataaacggtttnaacctgttaaacaacaactttaanaaccgggttaatacgtactaaagggtcgtttagaaaccgacggggtaaacagggttaggactaaccaaanaaaaccggtttncggttacggacttcctaaccggaatcgttacgtaccgtaatttccgaacttcccggtaaccccnttccgtaagtaaccgg

SEQ ID NO: 155548 - DNA, 864 bp, Homo sapiens
  misc_feature: GYAE6OF02HZPXF.8.21.B10.1.454.CMB.1.raw
  modified_base (147)..(147): a, c, t, g, unknown or other
  misc_feature (147)..(147): n is a, c, g, or t
tcagctcgcgtgtccacgaccggtgctcgatttagtgtcgtcgcaagagaggaggggggagtcagtctcagtcaggacacagcatggacatgagggtccccgctcagctccgtggggcctcctgcctcctcgtggctccggaggtcncctagttgtagacactccagttcgaccctagtcctccctcctctctcgtctgtccttcgtgggtggacgacgaggtccgtacaccgtactccgtacgttcgggccggggtacgtaacgtccgtaacgttacctaactttaaaccaaacttttaatttaaaagttcggtaaactaaccgaaaaaaccgtaaaaaccggaacgggtaaacctaaccccttaaaaggtccgttaggttaacttacgtaacctgaccctaacttacctagttttacgaacggtaacggttaccgggtaccctaagttaccggtaaggttccgtaggtacgtcggtaagttcgggtttaacgttccggggtatttaacgtttttcccgaacctttacggttaaccaacgttaaacgtccggtaacggtacttaccggtttaaccgtaaccgtaaacgtagttaacggtttacttaacgtactttaaaccgttacttaaccggttacgtaaccgtaaccgtaacttaaccgttaacaacgttaaacgttaccggtacggttaacgtttaccgggaaacggtaaccggtaacggtaagggtacgtaacgtaacgtaaaccggttaaacgtaccgggttggaccgttaccgtacggaacctccgttacgttaccggtttaccgtccgttaccgtttaccctacccggttccccgtataccggttaccgtaaccgg

SEQ ID NO: 155549 - DNA, 759 bp, Homo sapiens
  misc_feature: GYAE6OF02JZZU6.8.21.B10.1.454.CMB.1.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
tcagctcgcgtgtccacgaccggtgctcgatttagtgtcgtcgcaagagaggagggggagtcagtctcagtcaggacacagcatggacatgagggtcccgctcagctcctgggctcctgctctctggctccgaggtgccagttgtagacagtccagttcgacccagtcctccctcctctctgtctgcttctggtgganacngcgtacacctatcctacgttggccgggtcacgttacacggtcctaattaaacctaaacttatttaaacgttaggtaactactaaaactaaaaccgaaggtaaaccgtacccctaaataccgttcggtacttaactacgtcgtacctaacgtacctagtttacgtaacgtaaaggttcggggtacctagttacgtaaggttacacggtgtaccgtagttcggttacttgggtacttacgttttacacgttactacactaactcgtacgtctacgtcgtacgtactagtaacgttatttacgacttaacttacgtaacgtcgtaaacgtaagtaacgttaaccttaacgtaaattctaaaccgggtacgttaacggttccggttaaacgtaaacgggtaccgtaaagggtacgtaaacggttaactaaacggtaaaccgttaacggttacggtacgtaacggtttaccggaaccttaaccgggtaactttccgttaggttttaaccgtacccgtttaaccgttacccgttacccggtaacccttagtacccggttaacgg

SEQ ID NO: 155550 - DNA, 535 bp, Homo sapiens
  misc_feature: GYAE6OF01C5VE6.8.64.F09.1.454.CMB.1.raw
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagccgccctcagtgtctggggccccagggcagagggtcaccatctcctgcactggggacaactccaacatcggggcaggttataatgtttactggtatcaacaacttccagggacacgcccccaaactcctcttgtatggtgacaactatcggccctcaggtcgtccctgaccggatctctggctccaagtctggcacctcacgccctccctggccatcactgggcctccgaggctgaagatgaggctgtattattactgcctagttcttatgaccagcccgtcctgagtggctagtgtgtcgtttcgggcggggaccaggctcgaccgtccgtacgtcacgcccgaaggcctccggtccccctcggtccaccttccgtccgttccccc

SEQ ID NO: 155551 - DNA, 551 bp, Homo sapiens
  misc_feature: GYAE6OF01AV3S2.8.64.F09.1.454.CMB.1.raw
  modified_base (530)..(530): a, c, t, g, unknown or other
  misc_feature (530)..(530): n is a, c, g, or t
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagccgccctcagtgtctggggccccagggcagagggtcaccatctcctgcactggggacaactccaacatcggggcaggttataatgtttactggtatcaacaacttccagggacagcccccaaatcctcttgtatggtgacaactatcggccctcaggtgtccctgaccggatctctggctccaagtctggccacctcacgccctcccgtggccatccacgtcgggtctccgaggcctgaagatgaggtctagtatttacttactgcctagttcttagtcgacacggccgccgtgacgtggtctagtgtgtcgtttcgggcgggggacagcgtcgtaccgtccgtacgtcacgcccgaggtcctccgtcccccgtcggtaccncttccgttccgttaccccccg

SEQ ID NO: 155552 - DNA, 791 bp, Homo sapiens
  misc_feature: GYAE6OF01EZQDG.8.64.F09.1.454.CMB.1.raw
  modified_base (603)..(603): a, c, t, g, unknown or other
  misc_feature (603)..(603): n is a, c, g, or t
  modified_base (749)..(749): a, c, t, g, unknown or other
  misc_feature (749)..(749): n is a, c, g, or t
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcacgccgcctcagtgtcgtcgggcccagggcaggaggtcacctatctcctgaccacgtaggggaacaacctaccaacgcggttacggggacttaaggttaataagttcgtttacgtaggtaactacctaaaccgtaacttaccggaacgggaacctaacccggaaccccctaaaacgttcctacttagtacggtggtacaacgtaacttaccggcccggtaccctacggacggttcccgtacccgacgggtaaccgtactaccgttacgtcggtacctaaccgtaaagtccgtaccggacctaccgtacgtaccgccctcccgtacggtcaacttcgacggtcggacctacggacgtacgtagtaagtactagggactgtattaacgttacgtatcgtaaccgttagtacgttacgtacgaccggtaccgaccgtacgtggtacggtagtaccggttnttacgggtttccggttccgggtttaaccgggggggaccgggtaaaccgttaggtaccggttacccggttaacccggttaccccgtaacgggttaccaacccgggtcccgtaaccggttcccgtccccccgttaaccccggggtttnaacccccgttccgttacccccgggttcctaaaccccccccgg

SEQ ID NO: 155553 - DNA, 873 bp, Homo sapiens
  misc_feature: GYAE6OF01DGOBP.8.64.F09.1.454.CMB.1.raw
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcacgcccgccctcagtggtccgtcggggccccgagggcgacggacggtccaaccacttccgtcctcgaccgacggtacgggaacctaacctaccgaacgacggtcgggacgttaacggttaattaagttcgtttactacgtaactaaccgtaactaaccgtaccgacggtaacccaacccgtaccccctaacttccgttacgttacggttacggtacgtaacgtaacctacgtccgtacccgtacgtcggtacggttccctacggtaccggtactctacgtcgtaccgtacctacgtacgtcgtacctaccgtaccgtaccgtcccgtccgtaccgaccgtaactaccgtaccggtccggttacgaccgtacgggtcgtaacggtaacggtaaggttaccggtacggtacgttaacgtttaactttaaaccgttcgtaccggtttaaccgtaccgtttaacgttacgtaaaccggtcggtaacccggaccgttaccgggttacgttagggttaaccgtaccgttaggtttccggttaaacgggtttcccggggttaacggggtaacccggggtaacgtcccggtaaccgttacccgggttaaccgtcccggttaaccgaccggttaaccccggtaaaccggcccggttaaccccgggtccccgttccccggtttaacccgaccggtttaacccctcccgggttaacccgttccccgttaaacccccgg

SEQ ID NO: 155554 - DNA, 788 bp, Homo sapiens
  misc_feature: GYAE6OF01ELMYA.8.64.F09.1.454.CMB.1.raw
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagcccgccctcagtgtcgtcggggccccgagggcaggaggtcaccatctctgcacgtggggaccaacctccaacagtcgggctaggttataattgtttacgtggtatacaactacttcgacggacaccgaccccaactcctacgttgtagtgtacgactaacgtacgtccgaccgtccgtacggtccgtcccgtacgaccggtacttccgtcgtcggacctaccgtaacgtccgtacggacctaccgtaccgaccggtcccctcccgtccggaccctacgtacccgtaccggtacggtccctaccggaacgggtaccttaaggaacgtacggttacggggaccgttacgttaagttaaacgttttaaccgttaaccggtaccggtaccttaacggtttaccttaacgtacggacccgtaacggtccccggtacgttaaggtaccgggttcgtacggttacgttccgggtttacgggttaccggggtttacccggggggaccggggttaaaccacgggttacccggttaccgaccccgggtttaaccgtcccgggtaacccggaccggttaaccccggaaccggtcccgtacccccggttcccgtaccgtaccctacccgtttccgtaccccggttacccccc

SEQ ID NO: 155555 - DNA, 825 bp, Homo sapiens
  misc_feature: GYAE6OF01BL3OL.8.64.F09.1.454.CMB.1.raw
tcagctcgcgtgtccacgaccggtgctcgatttagcgcgtatacaagggcagcactcaggacaatctccagcatggcctggtctcctctcctcctcactctcctcgctcactgcacagggtcctgggcccagtctgagctgacgcagccgccctcagtgtcgtggggcccccagggcaggagggtcaccatctcctgcacgtgggacaactccaacgagtcggggctaggttatgtattgttacagttcggtacccgccgacgggttccagggccaaccgaccgaccccaagaccttccctactaactttaaatagaaacttaaaccaaacgaaacgttcccgggtaccccttacggacgggggttaccctcgtccggtaaccgtacgtttcctacgttccgtcccgtaccgtaacgttcgtacggtcctaaccgtttccgtccgtcccctttcccggtcggttacctaacgttcgttccggttccggttaccgttacccggttaggggtacggtaacggtagttacgggtacggttacgttaggttaaacttttacgtttaacccgtccgtaccctacctttacctacgtacgaacctaaaccgtcggtacccgttaggttacggtttacgttttcggtcgtttacggggtttaccggggcccgggtaacggggtaacccgttaacgggtttacccggtacccgtttaacccggtccggttaaccgacccgggtacccggtaaacccggttcccgtacccccgggtaccccccgtttcgggtaaccccttacccgttcccgtttcccccggttaaccccccccg

SEQ ID NO: 155556 - DNA, 642 bp, Homo sapiens
  misc_feature: GYAE6OF02G7SO3.8.64.F09.1.454.CMB.1.raw
  modified_base (307)..(307): a, c, t, g, unknown or other
  misc_feature (307)..(307): n is a, c, g, or t
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagccgccctcagtgtctggggcccccagggcagagggtcaccatctcctgcacgtgggacaactccaacatcggggcaggttataatgttactgtatcaacaacttccagggacacgcccccaaactcctacttgtatggtgaactaactatccggccctnaggttctcccctggaccggtatcctcgtggcctaccaagtcgtggcctacctcaccgcccttcccgtggccagtccacgttcgggccttccgagggtctagaacgagttacggaggtcctagtaatttacttacgtcgactagttctttagtacgaccgagtcccggccttaggacggttcgtacgttagttcggttcggttaccggttttccgggggacgggggtaaccctacgggtcctaccggaccgttcccgttacgtaccgtacggaccccgtaacggccgttcccggtcccccttcgggttaccaccgtttccgtaccggttccccccg

SEQ ID NO: 155557 - DNA, 747 bp, Homo sapiens
  misc_feature: GYAE6OF02JY2IE.8.64.F09.1.454.CMB.1.raw
  modified_base (629)..(629): a, c, t, g, unknown or other
  misc_feature (629)..(629): n is a, c, g, or t
  modified_base (682)..(682): a, c, t, g, unknown or other
  misc_feature (682)..(682): n is a, c, g, or t
  modified_base (702)..(702): a, c, t, g, unknown or other
  misc_feature (702)..(702): n is a, c, g, or t
tcagctcgcgtgtccacgaccggtgctcgatttagcgcgtatacaaggggcagcactcaggacaatctccagcatggcctggtctcctctcctcctccactctcctcgctcactgcacaggtcctgggcccagtctgagctgacgcagccgctctccagtgtctggggccccagggccaggagggtcaccatctccctgccacgtgggggacaactcccgaacacgtcggggcaagggttataagtgttttaactagggttaatcctaaactaacctttccgaagggtaccaacggacccccctaaaaccttcccgttacctttacggttaacttgggtacggtaaccaaccgttactacccgggtccctaacgtcgggttacgtccccgtaccgggtacccggtaacgtaccgttccgtgggtacccgtaccgtaaacggtcgttccgggtaacccgtacctaaccggttccaccccgttccccgttccggtcccgtaaacctccgtaacccgtggggtacccgtcgtaaccggcggttacgaaggtacggtcgtaagggccttaggtaattactttaccgttaacgcgttaccgtttacgtttaacgttagtaccgtacgtacccgngtaccggttagtcggtaccgttatcgttgtcggttcggtacgggggactacgngtacggtcccgtacttcganccggacctaaggcctaccggccctcggtccgtactacggttcccg

SEQ ID NO: 155558 - DNA, 687 bp, Homo sapiens
  misc_feature: GYAE6OF02IM71G.8.64.F09.1.454.CMB.1.raw
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagccgccctcagtgtctggggccccagggcagaggtcaccatctctgcacgtgggacaactccaacagtcgggcaggttataatgttactgtatacaacaacttccgaggacacgacccccaaactcctcttgtatggtcgacaactacgtccggcctcgaggttcgtccctacggaccggtatccgtcgtcggcctaccgtaacgtcctcggaccacccgttcgaccgtcccttcccgtacggaccctactaccgtaccggtcgggtcccttacccgagggtccgtaaggtaaacggagttacgggacggtcttcggtaaatttacttacgtcgtacctagtttacttaagtcgaacctacgtcccgtctaggtacgttggtacttaggtcgttcggttccgggttttacgggggaccggggtaaacctacggtccgtcggtacccggttaccgtaccggttaccaccggtacccgtaacggtcccgtacccgtacccccggttcggtaccctaccgtttaccgttcccgttaccccccg

SEQ ID NO: 155559 - DNA, 680 bp, Homo sapiens
  misc_feature: GYAE6OF02HU8PH.8.64.F09.1.454.CMB.1.raw
tcagctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagccgccctcagtgtcgtcggggccccagggcaggagggtcaccatctctgcacgtgggacaactccaacagtcggggctaaggttaattaagttgtttactggtactacaactaaccttcgaacgggacacgaccccctaaactccttcttagtacgttggtacgaacctaactcgtaccggccctagacggttccgtccgtcggaccgtatctcgtcggtcctacgacgtcgtacgcctaccgtcgacgtccctcccgtcggaccctagtccgtacgtcgggtcctacggacgggtactaggaagtacggtcggtacggctttaggtaactttacgtaccgtcggtacctagttactttagacgtacgacgtccgtcgtaggtaggtcgtacgtacgttcgttaccgggttcggtttaccgggggacggtaactacggccgtacgtcccgttaccgtacgtaccggcgtaacccggtacggtcccgtcccggtacccgtcgttaccctacgttccggttccccgttaccccg

SEQ ID NO: 155560 - DNA, 904 bp, Homo sapiens
  misc_feature: GYAE6OF02F57U4.8.64.F09.1.454.CMB.1.raw
tcagctcgcgtgtccacgaccggtgctcgatttagcgcgtatacaaggggcagcactcaggacaatctccagcatggcctggtctcctctcctcctcacctctcctcgctcactgcacagggtccgtcgggcccagtcctgacgctgacgcgacgtcccgaccctcagtcgttcgtcggggaccccgagggcaggtacgggtcccacccgtaactccgttccgtacgccgtaccggttacggggaacctaaccgtacccgaaacgtaccgggtaccggggtaccgtaaggtttaacgttaaaccgttttgtttaacccggttaggtttaaacctaccgttaaaacccgttaaccgtttaaccccggacggggttaaacccaaaccccggtaaaccccccgttaaaaccttccgtttaccgttaacggtttacgttaccgggtaacgtaaaccgttaaccgttacggtacccggtcccgtcgtaccggtttccgtacccgtacgggtacctacgtccgttcgtcgtaccggtacctaccggttcgtcgacctcctcgtccgtcccttcccggtcgtacccgtagtccggtaaccggtccggtcccgtacgacgggtacgtaacggtacgtacgtacggtaacggttcgtacgttaaacgtttacgtacccgttccggtaaccccttcggttaaccttaaccgtacgtaacctaaccgcggttaccgtaacgtttacggtttaacggtttccggttccggtacgggttcccgggtaccggggttacccggtacggtaccgttaccggtaccgttaccgtaccgtaccgggacctaccggtaccgtcccggtacccgttacccggtacgttcccgttacgtccgtttacccgtcccttaccgtcccg

SEQ ID NO: 155561 - DNA, 130 bp, Homo sapiens
  misc_feature: GYAE6OF01DA0EH.29.67.G01.1.454.CMB.1.raw
  modified_base (130)..(130): a, c, t, g, unknown or other
  misc_feature (130)..(130): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagn

SEQ ID NO: 155562 - DNA, 128 bp, Homo sapiens
  misc_feature: GYAE6OF01DM0RY.29.67.G01.1.454.CMB.1.raw
  modified_base (128)..(128): a, c, t, g, unknown or other
  misc_feature (128)..(128): n is a, c, g, or t
tcagatagagtactcacgaccggtgctcgatttagagtatacatattgggtttggcacagcggccctggctgcctggtcaaggactacttccagtactctatctgagcgggctggcaaggcgcatagn

SEQ ID NO: 155563 - DNA, 130 bp, Homo sapiens; identical to SEQ ID NO: 155561
  misc_feature: GYAE6OF01EC6Q1.29.67.G01.1.454.CMB.1.raw
  modified_base (130)..(130): a, c, t, g, unknown or other
  misc_feature (130)..(130): n is a, c, g, or t

SEQ ID NO: 155564 - DNA, 130 bp, Homo sapiens; identical to SEQ ID NO: 155561
  misc_feature: GYAE6OF01BGY2G.29.67.G01.1.454.CMB.1.raw
  modified_base (130)..(130): a, c, t, g, unknown or other
  misc_feature (130)..(130): n is a, c, g, or t

SEQ ID NO: 155565 - DNA, 144 bp, Homo sapiens
  misc_feature: GYAE6OF01A8REP.29.67.G01.1.454.CMB.1.raw
  modified_base (111)..(111): a, c, t, g, unknown or other
  misc_feature (111)..(111): n is a, c, g, or t
  modified_base (132)..(144): a, c, t, g, unknown or other
  misc_feature (132)..(144): n is a, c, g, or t
tcagatagagtactcacgaccggtgctcgatttagagtatacatagttgggtttgggcacagcggccctgggctgcctggtcaaggactacttccagtactctatctcgancgggctggcaaggcgcatagnnnnnnnnnnnnn

SEQ ID NO: 155566 - DNA, 130 bp, Homo sapiens; identical to SEQ ID NO: 155561
  misc_feature: GYAE6OF01EV57V.29.67.G01.1.454.CMB.1.raw
  modified_base (130)..(130): a, c, t, g, unknown or other
  misc_feature (130)..(130): n is a, c, g, or t

SEQ ID NO: 155567 - DNA, 130 bp, Homo sapiens; identical to SEQ ID NO: 155561
  misc_feature: GYAE6OF01D26ND.29.67.G01.1.454.CMB.1.raw
  modified_base (130)..(130): a, c, t, g, unknown or other
  misc_feature (130)..(130): n is a, c, g, or t

SEQ ID NO: 155568 - DNA, 130 bp, Homo sapiens; identical to SEQ ID NO: 155561
  misc_feature: GYAE6OF01CC40J.29.67.G01.1.454.CMB.1.raw
  modified_base (130)..(130): a, c, t, g, unknown or other
  misc_feature (130)..(130): n is a, c, g, or t

SEQ ID NO: 155569 - DNA, 133 bp, Homo sapiens
  misc_feature: GYAE6OF01D95DA.29.67.G01.1.454.CMB.1.raw
  modified_base (130)..(133): a, c, t, g, unknown or other
  misc_feature (130)..(133): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnn

SEQ ID NO: 155570 - DNA, 140 bp, Homo sapiens
  misc_feature: GYAE6OF01D11WN.29.67.G01.1.454.CMB.1.raw
  modified_base (130)..(140): a, c, t, g, unknown or other
  misc_feature (130)..(140): n is a, c, g, or t
tcagatagagtactcacgaccggtgctcgatttagagtatacatagttgggtttgggcacagcggccctgggctgcctggtcaaggactattccagtactctatctgagcgggctggcaaggcgcatagnnnnnnnnnnn

SEQ ID NO: 155571 - DNA, 263 bp, Homo sapiens
  misc_feature: GYAE6OF01BRCRN.29.67.G01.1.454.CMB.1.raw
  modified_base (260)..(263): a, c, t, g, unknown or other
  misc_feature (260)..(263): n is a, c, g, or t
tcagatagagtactcacgaccggtgctcgatttagagtatacatattgggtatatagtgcctaggattgaccgttactacggaatggacgtctggggccaagggaccgcggtcactgtctcctcagcttccaccaaggacccatcggtcttcccctggcgccctgctccaggagcacctccgagagcacagccgccctgggctgcctggtcaaggactacttccacgtagcgtgctgagcgggctggcaaggcgcatagnnnn

SEQ ID NO: 155572 - DNA, 130 bp, Homo sapiens; identical to SEQ ID NO: 155561
  misc_feature: GYAE6OF01CVSL8.29.67.G01.1.454.CMB.1.raw
  modified_base (130)..(130): a, c, t, g, unknown or other
  misc_feature (130)..(130): n is a, c, g, or t

SEQ ID NO: 155573 - DNA, 614 bp, Homo sapiens
  misc_feature: GYAE6OF01BJIFA.29.67.G01.1.454.CMB.1.raw
  modified_base (262)..(262): a, c, t, g, unknown or other
  misc_feature (262)..(262): n is a, c, g, or t
  modified_base (354)..(354): a, c, t, g, unknown or other
  misc_feature (354)..(354): n is a, c, g, or t
  modified_base (460)..(460): a, c, t, g, unknown or other
  misc_feature (460)..(460): n is a, c, g, or t
tcagatagagtactcacgaccggtgctcgatttagagtatacataagtttggggtttggggagctacaacaggcaggcagggcagcaaggatggtgttggccagacccaggtcttcagtttctctgttgctctggatctctggtgcctaacggggacatcgtgactggacccagtcctccagacctccctcggccttggtgtttctgggcgtagagggccaccatcgaactgaccaagtccagtccacggaattaattttanatagctacctaacaataacgaatttaacttagactttggaaccagacaacgaaaccgaggaacaccgactacctaagctagctcgatttacnggacattcgtaacccgggaagtccggggtccctagaccgtagttcgaggtggcaggcgggtctgggacgagtatttcactactctagtattagcaagtctgcaggntacgaagtatgtgacctatttatactgtcaagtactaagttattactaccgtaccgtacccggtagttccggaccgaacgggtaaccgaacgggtaggaagacgtaaccgaaacgtaaccgtaggtacggtaccgtaggccaacccgtataccg

SEQ ID NO: 155574 - DNA, 130 bp, Homo sapiens; identical to SEQ ID NO: 155561
  misc_feature: GYAE6OF01B0WJL.29.67.G01.1.454.CMB.1.raw
  modified_base (130)..(130): a, c, t, g, unknown or other
  misc_feature (130)..(130): n is a, c, g, or t

SEQ ID NO: 155575 - DNA, 612 bp, Homo sapiens
  misc_feature: GYAE6OF01A1I8G.29.67.G01.1.454.CMB.1.raw
  modified_base (439)..(439): a, c, t, g, unknown or other
  misc_feature (439)..(439): n is a, c, g, or t
tcagatagagtactcacgaccggtgctcgatttagagtatacatattggggtttgggggaggctacaacacggcaggcagggggcagccaagtatggtgttgcagacccaggtcttcatttctctgttgctctggatcttcgtggtgcctacggggactatcgtgatgtacccagtctccagactccctggctgtgtttctgggcgagaggggccaccagtcaactgcaagtcccagccagaacttattttatatagctccaacaataagtaattacttagcttggtaccagtcagaacagacagcctcctaagcctgctcgatttacgtgggctatctaccgggaatccggggtcctagaccgattcgaagtagcagcggtctgggacagagtttcactactacagtacttacgcagcctagacaaggctagtaagtntgtggcctaagtttactacgttcgtcaagtactaattacttaataaccgttaaccttccccgggaacgtttccggtaccgtaaacgggtaacctaagggtcggtaaggaacgtaaccgaaacggtaaaccttacggttacgggacgttacggaccgtaccgtaacgttacccg

SEQ ID NO: 155576 - DNA, 150 bp, Homo sapiens
  misc_feature: GYAE6OF01C8FPZ.29.67.G01.1.454.CMB.1.raw
  modified_base (131)..(150): a, c, t, g, unknown or other
  misc_feature (131)..(150): n is a, c, g, or t
tcagatagagtactcacgaccggtgctcgatttagagtatacatattgggtttgggcgacagcggccctgggctgcctggtcaaggactacttccagtactctatctgagcgggctggcaaggcgcatagnnnnnnnnnnnnnnnnnnnn

SEQ ID NO: 155577 - DNA, 551 bp, Homo sapiens
  misc_feature: GYAE6OF01AD0UF.29.67.G01.1.454.CMB.1.raw
tcagatagagtactcacgaccggtgctcgatttagagtatacataagttgggtttggggagctacaacaggcaggcaggggcagccaagatggtgttgcagacccaggtcttcatttctctgttgcttctggatctctggtgcctacggggacatcgtgatcgacccagtctccagactccctggctcgtgtttcgtgggcgagagggccaccatcaactgacaagtccagccagaatattttatatagcctccaacaataagaattacttacgcttggtaccagcagaaaccaggacagcctcctaagctgctcatttactgggtcagtcctaccgggaatccggggtcctgaccgattcagtgcaggcggtctgggacagatttcacactcgagtattagcagcctgcaggtctagtaagtatggtgtcctagttttattacgtgtcagtctaattattatacttactccccggagttcggccaacggaccgtaacggtcggagtacgtcgaaaccgaactcggtcggctacgcctaccgtacgttccg

SEQ ID NO: 155578 - DNA, 130 bp, Homo sapiens; identical to SEQ ID NO: 155561
  misc_feature: GYAE6OF01BOT7S.29.67.G01.1.454.CMB.1.raw
  modified_base (130)..(130): a, c, t, g, unknown or other
  misc_feature (130)..(130): n is a, c, g, or t

SEQ ID NO: 155579 - DNA, 504 bp, Homo sapiens
  misc_feature: GYAE6OF01EAC0I.29.67.G01.1.454.CMB.1.raw
  modified_base (238)..(238): a, c, t, g, unknown or other
  misc_feature (238)..(238): n is a, c, g, or t
  modified_base (501)..(501): a, c, t, g, unknown or other
  misc_feature (501)..(501): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctaccgggaatccgggtcctgaccgattcagtggcagcgggtctgggacagatttcacactcagtattagcagccctgcaggctgaagatgtggcctatttatactgtcagcaatattatactactcccggagttcggccaagggaccaaggtcggagatacaaacgacagtggctagcacntcg

SEQ ID NO: 155580 - DNA, 270 bp, Homo sapiens
  misc_feature: GYAE6OF01DKE8B.29.67.G01.1.454.CMB.1.raw
  modified_base (261)..(270): a, c, t, g, unknown or other
  misc_feature (261)..(270): n is a, c, g, or t
tcagatagagtactcacgaccggtgctcgatttagagtatacatattgggtatatagtgcctaggattgaccgttactacggaatggacgtctggggccaagggaccgcggtcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnn

SEQ ID NO: 155581 - DNA, 539 bp, Homo sapiens
  misc_feature: GYAE6OF01EJ3S0.29.67.G01.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
  modified_base (346)..(346): a, c, t, g, unknown or other
  misc_feature (346)..(346): n is a, c, g, or t
  modified_base (416)..(416): a, c, t, g, unknown or other
  misc_feature (416)..(416): n is a, c, g, or t
  modified_base (532)..(532): a, c, t, g, unknown or other
  misc_feature (532)..(532): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctcaacaataagaattactagcttaggtaccagcaagaaaccaggacagcctacctaagctgctcatttacnggcatcctaccgggaatccgggtcctgaccgnttcgagtgcaggcggtctgggacagtatttccatactcagttacttagcagccgtgcgaggctagaagtntgtgcctaatttactactgtacagactaattaattactaacttacctcccggtacgttcgaccgaacgggtaccgaacggtcggtagactacgaaacgtaactagtcggactgacnccatacg

SEQ ID NO: 155582 - DNA, 149 bp, Homo sapiens
  misc_feature: GYAE6OF01BWXN5.29.67.G01.1.454.CMB.1.raw
  modified_base (123)..(123): a, c, t, g, unknown or other
  misc_feature (123)..(123): n is a, c, g, or t
  modified_base (129)..(149): a, c, t, g, unknown or other
  misc_feature (129)..(149): n is a, c, g, or t
tcagatagagtactcacgaccggtgctcgatttagagtatacatattgggtttgggcacagcggccctggctgcctggtcaaggactacttccagtactctatctcgagcggctggcaaggcncatagnnnnnnnnnnnnnnnnnnnnn

SEQ ID NO: 155583 - DNA, 499 bp, Homo sapiens
  misc_feature: GYAE6OF01BD2Q5.29.67.G01.1.454.CMB.1.raw
  modified_base (238)..(238): a, c, t, g, unknown or other
  misc_feature (238)..(238): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttaagcttggtaccagcagaaaccaggacagcctcctaagctgctcatttactggcatctacccgggaatccggggtcctgaccgattcagtggcagcggtctgggacagatttcacactcagtattagcagccctgcaggctgaagatgtggccagtttatactgtcagcaatattatactactcccgagttcgcaaggaccaaggtgagatcaaacgtaanagtggctgcncatcg

SEQ ID NO: 155584 - DNA, 505 bp, Homo sapiens
  misc_feature: GYAE6OF01BNSAN.29.67.G01.1.454.CMB.1.raw
  modified_base (238)..(238): a, c, t, g, unknown or other
  misc_feature (238)..(238): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcgggtctgggacagatttcacactcagtatagcagcctgcagctgaagatgtggcctatttatactgtcagcaatattatactactcccggacgtcgaccgaaggaccgaaggtcggagagtcaaacgaactagtgctgcncntcg

SEQ ID NO: 155585 - DNA, 129 bp, Homo sapiens
  misc_feature: GYAE6OF01DAINM.29.67.G01.1.454.CMB.1.raw
tcagatagagtactcacgaccggtgctcgatttagagtatacatattgggtttgggcacagcggccctgggctgcctggtcaaggactacttccagtactctatctgagcgggctggcaaggcgcatag

SEQ ID NO: 155586 - DNA, 495 bp, Homo sapiens
  misc_feature: GYAE6OF01DTC4Z.29.67.G01.1.454.CMB.1.raw
  modified_base (238)..(238): a, c, t, g, unknown or other
  misc_feature (238)..(238): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (488)..(489): a, c, t, g, unknown or other
  misc_feature (488)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaccaggacagcctcctaagctgctcatttactgggcatctacccgggaatccggggtccctgaccgattcagtgcagcggtctgggacagatttcacactcagtattagcagcctgcaggctgaagatgtggcctatttattactgtcagcaatattattactactcccggacgtcgcgacggacacggtgagancaacgaangtgcnncncntc

SEQ ID NO: 155587 - DNA, 492 bp, Homo sapiens
  misc_feature: GYAE6OF01DU7JO.29.67.G01.1.454.CMB.1.raw
  modified_base (238)..(238): a, c, t, g, unknown or other
  misc_feature (238)..(238): n is a, c, g, or t
  modified_base (465)..(465): a, c, t, g, unknown or other
  misc_feature (465)..(465): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctctaagctgctcatttactgggcatctaccgggaatccggggtcctgaccgattcagtggcagcgggtctgggacagatttcacactcagtattagcagcctgcaggctgaagatgtggcctatttattactgtcagcaatattatactactcccgagtcgcaggacaaggngagatcaaacgaatgtgactgcncntc

SEQ ID NO: 155588 - DNA, 495 bp, Homo sapiens
  misc_feature: GYAE6OF01DDF7I.29.67.G01.1.454.CMB.1.raw
  modified_base (238)..(238): a, c, t, g, unknown or other
  misc_feature (238)..(238): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactggcatctaccgggaatccgggtcctgaccgattcagtgcagcggtctgggacagatttcactactcacgtattagcagcctgcaggctagaagatgtgcctatttatactgtcagcaatattatactactcccgagtcgcgacgacgaaggtgagagtcaaacgaatagtggcngcncntcg

SEQ ID NO: 155589 - DNA, 514 bp, Homo sapiens
  misc_feature: GYAE6OF01BEMCG.29.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttacnggcatctacccggaatcccgggtcctgaccgattcgagtggcagcggtctgggacagatttcacactcagtattagcagcctgcaggctgaagntgtggcctatttatactgtcagtcaatattatactactcccggtacgtcggccgaagggaccaagggtcggagagtcaaacgaactggtacggctagcgaccagtcg

SEQ ID NO: 155590 - DNA, 142 bp, Homo sapiens
  misc_feature: GYAE6OF01A9I4W.29.67.G01.1.454.CMB.1.raw
  modified_base (132)..(142): a, c, t, g, unknown or other
  misc_feature (132)..(142): n is a, c, g, or t
tcagatagagtactcacgaccggtgctcgatttagagtatacatagttgggtttgggcacagcggccctgggctgcctggtcaaggactacttccagtactctatctcgagcgggctggcaaggcgcatagnnnnnnnnnnn

SEQ ID NO: 155591 - DNA, 503 bp, Homo sapiens
  misc_feature: GYAE6OF01DBSP3.29.67.G01.1.454.CMB.1.raw
  modified_base (238)..(238): a, c, t, g, unknown or other
  misc_feature (238)..(238): n is a, c, g, or t
  modified_base (408)..(408): a, c, t, g, unknown or other
  misc_feature (408)..(408): n is a, c, g, or t
  modified_base (500)..(500): a, c, t, g, unknown or other
  misc_feature (500)..(500): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctacaacaataagaattacttagcttggtaccagcagaaaccaggacagcctcctaagctgctcatttactgggcatctaccgggaatccgggtcctgaccgattcagtgcagcggtctgggacagatttcacactcagtattagcagcctgcaggctgaagatgngccatttatactgtcagcaatatatactactcccgacgtcgtcgaacggaccgaaggtaggagatacaaacgaacgtgtacggactgcaccntac

SEQ ID NO: 155592 - DNA, 502 bp, Homo sapiens
  misc_feature: GYAE6OF01CV4YG.29.67.G01.1.454.CMB.1.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagagggccaccatcaactgcaagtccagccagaatatttanatagctcaacaataagaattacttagcttggtaccagcagaaaccaggacagcctctaagctgctcattactggcatctaccgggaatccggggtccctgaccgattcgagtggcagcggtctgggacagacttcacactcagtatagcagcctgcagggctagaagatgtcgctatttatacngtcagcaatatanactacncccggagtcgcaacggactaacggtaggagatcaaacgaacgtagtggactgaccgcaatcg

SEQ ID NO: 155593 - DNA, 494 bp, Homo sapiens
  misc_feature: GYAE6OF01C426R.29.67.G01.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (402)..(402): a, c, t, g, unknown or other
  misc_feature (402)..(402): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattactagcttggtaccagcagaaaccaggacagcctctaagctgctcatttacnggcatctaccgggatccgggtcctgaccgattcagtggcaggcggtctgggacagatttcacactcagtatagcagcctgcaggctgagntgtgctatttatctgtcagacaatattatactactccccggacgttcggccaaggaccaaggtgagatcaaacgactgtggctgacnccntc

SEQ ID NO: 155594 - DNA, 515 bp, Homo sapiens
  misc_feature: GYAE6OF01DA4VO.29.67.G01.1.454.CMB.1.raw
  modified_base (509)..(509): a, c, t, g, unknown or other
  misc_feature (509)..(509): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaacttcaagtccagccagaatattttatatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttatactgtcagcaatattatactactccccggagttcggccgtaagggacccaagggtcggagatacaaacgaactgtcggctagcacntctacg

SEQ ID NO: 155595 - DNA, 640 bp, Homo sapiens
  misc_feature: GYAE6OF01B0EFO.29.67.G01.1.454.CMB.1.raw
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (475)..(475): a, c, t, g, unknown or other
  misc_feature (475)..(475): n is a, c, g, or t
tcagatagagtactcacgaccggtgctcgatttagagtatacatagttgggtttggggagctacaacaggcaggcaggggcagcaagatggtgttgcagaacccaggtacttcacttttctctgttcgctctggatctctggtgccgtacggggacatcgtgatcgaccagtcgtcagctccngctgtgttcnggcngnggccacntcactcgcaacgtccacgccagtaacttacttttagactacgctaccaacaagtaagaactttaccttagcttggtaccagcaacggaaacccagggaccacgccctaccgtaagcgtcgtcctcattttaccgtcgggctacttccggtaacccgggaacgttcccggggtccctcggaaccggtacttccgaggtcggcgaggcggggtctggggactaggtactttcgacacttcaggttattagcacgccctgcaggctagaagntggtcgccttagttttactacgtgtactagactaagtttacttaacttaccgttacccgtacccccggtaacggtttcccggacccgaaacggggtaacccgtaagggtcgggaagtacgtaccgaaaacgtaaccgtggtacggactaggacctaccgattccg

SEQ ID NO: 155596 - DNA, 547 bp, Homo sapiens
  misc_feature: GYAE6OF01BY4S0.29.67.G01.1.454.CMB.1.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagatagagtactcacgaccggtgctcgatttagagtatacatattgggtttggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatatttanatagctacaacaataagaattacttagcttggtaccagacagaaaccaggacagcctacctaagctgctcatttacngggcatccgtaccgggaatccggggtccctgaccgattcagtggcgagcggtctgggacagtatttcactactcagtatagcagcctgcagctagaagatgtggcctatttattacgtgtcagtctaaattactaactactaccgtccccggtaacgttccggaccgaacggaaccgaaggtacggtagacgtaacgaaacgaacgtaggtacggactacgctacgacgttacg

SEQ ID NO: 155597 - DNA, 539 bp, Homo sapiens
  misc_feature: GYAE6OF01CASYG.29.67.G01.1.454.CMB.1.raw
  modified_base (190)..(190): a, c, t, g, unknown or other
  misc_feature (190)..(190): n is a, c, g, or t
  modified_base (236)..(236): a, c, t, g, unknown or other
  misc_feature (236)..(236): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttcngggcgagaggccaccatcaactgcaagtccagccagaatattttanatagctaccaacaataagaattacttagcttaggtaccagacagaaaccaggacagcctactaagctgctacatttactgggcatcgtacccgggaatccggggtcctagaccgattcagtgcagcggtctgggacagtattcacactcagtatagcagcctgcaggcagaagtagtgtggtacctaatttatactgtcaagctaaattattaactactacctacccggacgttcggtaccgaacggaccgaaagggtcggaaggacacgaaacgaaacgtcgtacggactagacaccgatcg

SEQ ID NO: 155598 - DNA, 504 bp, Homo sapiens
  misc_feature: GYAE6OF01DQ576.29.67.G01.1.454.CMB.1.raw
  modified_base (238)..(238): a, c, t, g, unknown or other
  misc_feature (238)..(238): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctcaacaataagaattacttagcttggtaccagcagaaccaggacagcctcctaagctgctcatttactggcatctacccgggaatcccgggtcctgaccgatcagtggcaggcggtctgggacagatttcacactcagtattagcagcctgcaggctgaagatgtgcctatttattactgtcagcaatattatactactcccggacgtcgaccgacggacgaaggtggagatcgaaacgacgtacgtggctgacncgntcg

SEQ ID NO: 155599 - DNA, 130 bp, Homo sapiens
  misc_feature: GYAE6OF01DFDRY.29.67.G01.1.454.CMB.1.raw
  modified_base (130)..(130): a, c, t, g, unknown or other
  misc_feature (130)..(130): n is a, c, g, or t
tcagatagagtactcacgaccggtgctcgatttagagtatacatattgggtttgggcacagcggccctgggctgtctggtcaaggactacttccagtactctatctgagcgggctggcaaggcgcatagn

SEQ ID NO: 155600 - DNA, 131 bp, Homo sapiens
  misc_feature: GYAE6OF01CKDV0.29.67.G01.1.454.CMB.1.raw
  modified_base (130)..(131): a, c, t, g, unknown or other
  misc_feature (130)..(131): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnn

SEQ ID NO: 155601 - DNA, 500 bp, Homo sapiens
  misc_feature: GYAE6OF01DQD8N.29.67.G01.1.454.CMB.1.raw
  modified_base (238)..(238): a, c, t, g, unknown or other
  misc_feature (238)..(238): n is a, c, g, or t
  modified_base (362)..(362): a, c, t, g, unknown or other
  misc_feature (362)..(362): n is a, c, g, or t
  modified_base (406)..(406): a, c, t, g, unknown or other
  misc_feature (406)..(406): n is a, c, g, or t
  modified_base (497)..(497): a, c, t, g, unknown or other
  misc_feature (497)..(497): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctcaacaataagaattacttagcttggtaccagcagaaaccaggacagcctctaagctgctcatttactgggcatctacccgggaatccgggtcctgaccgattcagtggcagcgggtcngggacagatttcacactcagtattagcagcctgcaggctgaagntgtggcctatttattactgtcagcaattattatactactcccggagttcgccaggacaaggtggagatacaaacgactagtgactgcaccntcg

SEQ ID NO: 155602 - DNA, 513 bp, Homo sapiens
  misc_feature: GYAE6OF01A4VTF.29.67.G01.1.454.CMB.1.raw
  modified_base (407)..(407): a, c, t, g, unknown or other
  misc_feature (407)..(407): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctaccgggaatcccggggtcctgaccgattcagtggcagcggtctgggacagatttcacactcagttatagcagcctgcagctgaagntgtggcctatttatactgtcagcaattattatactactaccccggacttcggccaagggaccaaagggtcggagatcaaacgaactgtagacgtagcaccgatccg

SEQ ID NO: 155603 - DNA, 523 bp, Homo sapiens
  misc_feature: GYAE6OF01CS124.29.67.G01.1.454.CMB.1.raw
  modified_base (238)..(238): a, c, t, g, unknown or other
  misc_feature (238)..(238): n is a, c, g, or t
  modified_base (411)..(411): a, c, t, g, unknown or other
  misc_feature (411)..(411): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggtgagagggccaccatcaactgcaagtccagccagaatattttanatagctccaacaataagaattacttagcttggtaccagcagaaaccaggacagcctcctaagctgctcatttactgggcatctacccgggaatccggggtcctgaccgattcagtggcaggcgggtctgggacagatttcacactcagtattagcagcctgcaggctagaagngtgtggcctatttatactgtcagctaatattatactacgtcccgtacgttccgaccgaacgggaccgaaggtcggagacgtacgaacgtaacgtgtcggctagcacctgtcg

SEQ ID NO: 155604 - DNA, 548 bp, Homo sapiens
  misc_feature: GYAE6OF01DQXO5.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaaccaggacagcctcctaagctgctcatttactgggcatctacccgggaatccgggtcctgaccgattcagtgcaggcgggtctggggacagatttcacactcagtattagcagcctgcaggctgaagatgtggcctatttacttacttgtacagtactaagttattaatacttaccgtaccccggtacgttccggtaccgaacgggaccgaaagggtcgggaagactaccgaaaacgaacgtacgtcggactgacaccgattaccg

SEQ ID NO: 155605 - DNA, 131 bp, Homo sapiens; identical to SEQ ID NO: 155600
  misc_feature: GYAE6OF01DY74U.29.67.G01.1.454.CMB.1.raw
  modified_base (130)..(131): a, c, t, g, unknown or other
  misc_feature (130)..(131): n is a, c, g, or t

SEQ ID NO: 155606 - DNA, 583 bp, Homo sapiens
  misc_feature: GYAE6OF01DJLRW.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaaccaggacagcctctaagctagctcatttacgtgggcatccgtaccgggaactcccgggtccctgaccgattcgagtggcgaggcgggtcgtgggacaggtactttcaactactactaagtattagcacgcctgcaggctagaagtagtcgtaggaccttagtttaacttacgtgtacaagtactaagttaattaactaacccttaccgtccccggtacggttaccgtaccgaaaccggtaccgtaagggtacggtagaagtacgaaacgtacgtaggtcgtacgacgactacgactaccg

SEQ ID NO: 155607 - DNA, 660 bp, Homo sapiens
  misc_feature: GYAE6OF01D1ZUY.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattactagcttggtaccagcaagaaaccaggacaacgcctactaagctgctctatttacgtggctatccgtaacccgggacgtcccgggtcctcgaccgtatcgaggtggcgacggtccgggtcgtacggggaacgagttactttaccgaactacctacgtaagttacgttacgcctaacgtccctagacgtaggccgtaggaagtacgttggtacggtacctttaattttaacgtttacgtcggtaacagtaaccttaaattaacgtttaacttacccgttaacccgtacccccgggttaacgttacccggaacccggtaaaccgggtaaacccgtaagggtacgggaagtactaaaccggaaaacgtacgtaggtcggacttagaccctacgtacttaccg

SEQ ID NO: 155608 - DNA, 160 bp, Homo sapiens
  misc_feature: GYAE6OF01AJEFX.29.67.G01.1.454.CMB.1.raw
  modified_base (130)..(160): a, c, t, g, unknown or other
  misc_feature (130)..(160): n is a, c, g, or t
tcagatagagtactcacgaccggtgctcgatttagagtatacatattgggtttgggcacagcggccctgggctgcctggtcaaggactaccttccagtactctatctgagcggctggcaaggcgcatagnnnnnnnnnnnnnnnnnnnnnnnnnnnnnnn

SEQ ID NO: 155609 - DNA, 515 bp, Homo sapiens
  misc_feature: GYAE6OF01CX7P8.29.67.G01.1.454.CMB.1.raw
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctctaagctgctcatttactgggcatctacccgggaatccgggtccctgaccgattcagtggcagcgggtctgggacagatttcacactcagtattagcagcctgcaggctgaagatgtggcctatttacttactgtcagtcaatattatactactcccggacgtcgccgacggacgaaggtaggagagtcgaaacgaacgtacgtaggcgtagcncngtacg

SEQ ID NO: 155610 - DNA, 552 bp, Homo sapiens
  misc_feature: GYAE6OF01CPTOY.29.67.G01.1.454.CMB.1.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
  modified_base (407)..(407): a, c, t, g, unknown or other
  misc_feature (407)..(407): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgcaagtccagccagaatatttanatagctacaacaataagaattactagcttggtaccagacagaaaccaggacacgcctactaagctagctcatttacnggcatctaccgggaactccgggtcctgaccgattcagtcggcacgcgggtctggacagtattcgacactcagtatagcagctgcagctagaagntgtgcctaatttatactgtacagtctaattattactaacctaccgtaccccggacgttacggaccgaacgggtaaccgtaacgggtaggaacgacgtaaccgaaacgaaacgttacggtacggactacgacaccgtacgttaccg

SEQ ID NO: 155611 - DNA, 659 bp, Homo sapiens
  misc_feature: GYAE6OF01DC9UA.29.67.G01.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (322)..(322): a, c, t, g, unknown or other
  misc_feature (322)..(322): n is a, c, g, or t
tcagatagagtactcacgaccggtgctcgatttagagtatacatattgggtttgggggagctacaacaggcaggcaggggcagcaagatggtgtgcagacccaggtcttcatttctctgttgctctggatctctggtgccgtacggggacatcgtgatgacccagtctccagactcccgtggctgtgttcgngggcgagacggccaccatcaactgcaagtccagccagaattatttanatagctaccaanaataagaattactagcttaggtaccagacaagaaaccaggacacgcctacctaagctgctactatttacgnggcacgtccgtaaccgggacgtcccggggtccctagaccgattcgaggtcggacgaggcgggtactagggactaaggtacttttaccacttacgtagttattagcgtacgcctaggacgagggtctaggaagtgtcggtacggtaccttaagttttacttaacgtgttaccgaagtaccttaaatttacttaacttaacccgttacccgttaaccccgggacggtttaccggaccgtaaacggggtaacccgtaaaggggtcggaaacgtaacgtaacgtaaaaccgtaacgtaggtacggtaccttacggaccgtaacccgtaagttccgttaccg

SEQ ID NO: 155612 - DNA, 653 bp, Homo sapiens
  misc_feature: GYAE6OF01CM0QR.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctacaacaataagaattactagcttggtaccagcagaaccaggacagcctactaagctagctactatttactgggacactccgtaacccggggaactccggggtaccctaggacccgtattcgaggtcggcaggtcgggtcgttggggaactaggtatttccactactactagtaattagccagtcccttgaccagggtcctaggaagtattaggtcggtacccttaagttttacttacgttggttaccaaggtactaaaattactttaaacttacccttaacccgtccccgggaacggttttccggaacccgtaaacggggaacccgtaaacgggtcgggaaggtaacttaacccggaaaaccggtaaacgttcggtacggtacgtacggtaccgaacctaacggttccg

SEQ ID NO: 155613 - DNA, 616 bp, Homo sapiens
  misc_feature: GYAE6OF01DEJAW.29.67.G01.1.454.CMB.1.raw
  modified_base (136)..(136): a, c, t, g, unknown or other
  misc_feature (136)..(136): n is a, c, g, or t
  modified_base (141)..(141): a, c, t, g, unknown or other
  misc_feature (141)..(141): n is a, c, g, or t
  modified_base (143)..(143): a, c, t, g, unknown or other
  misc_feature (143)..(143): n is a, c, g, or t
  modified_base (150)..(152): a, c, t, g, unknown or other
  misc_feature (150)..(152): n is a, c, g, or t
  modified_base (159)..(159): a, c, t, g, unknown or other
  misc_feature (159)..(159): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (173)..(174): a, c, t, g, unknown or other
  misc_feature (173)..(174): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
tcagatagagtactcacgaccggtgctcgatttagagtatacatattgggtttgggcgacagcggccctggggctcgtcctcggtcgaacggacctaacgttccctagtacttcgtatctgagcggctggcagcgnatagnantgatggnnnctgtctngtattnagtncatnncgtncngtgtgngngnggngngtgcgcggcgggtcgngagctctctgtgncgctcgtgtctcctacgtagtagtgtcgtgngtcgtcggtccgcgcgcgtacgtagggtagggtggtaggtcggtcgacgaacgaagtaagacgagagtaggagtaggaagagtacgtcgtacgtacgtcgtgtacggtcgggtcggtacgtacgtacgtacgtacgtacgacgacgaaccgaccgtaacgtacgtacgtacgtacgtacgtacgtacgtaacgtaacgtacgtacgtacgtacgtacgtacggacgacggacggacgtacgtacgttacgttacgttacgtacgtacgtacgtacggacggtacggtacggtacgggttacggttacggtacggtacggtaccgggtaccggaccggtaccggtacggtccgtccgtaccg

SEQ ID NO: 155614 - DNA, 487 bp, Homo sapiens
  misc_feature: GYAE6OF01B39MO.29.67.G01.1.454.CMB.1.raw
  modified_base (238)..(238): a, c, t, g, unknown or other
  misc_feature (238)..(238): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccgggtcctgaccgattcagtggcagcggtctgggacagatttcacactcagtattagcagcctgcaggctgaagatgtgcctatttatactgtcagcaatattatactactcccgagtcgcaggacaggtgagatcaacgangtgcngcncntcg

SEQ ID NO: 155615 - DNA, 591 bp, Homo sapiens
  misc_feature: GYAE6OF01C81PJ.29.67.G01.1.454.CMB.1.raw
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
  modified_base (416)..(416): a, c, t, g, unknown or other
  misc_feature (416)..(416): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgaggagggccaccatcaactgcaagtccagccagaattatttanatagctaccaaacaataaacgaattacttagcttggtaccagcagaaaccaggacagcctctaagctgctctatttacnggcatcctaccgggaactccgggtccncgaccgattcagtggcaggcggtcgtgggactagatttcacactcagtatagcagcctgcaggctgaacgtntcggtcggaccttaatttacttacgtgtacagtactaagttacttaactaaccttacccgtaccccggtaaccgttccggaccgtaaaccgggtaaccgtaaggggtacggtaaggaacgtaacgaaaccggtaaactcggtacggtacgtacgaccctaccgtacgtttacccg

SEQ ID NO: 155616 - DNA, 500 bp, Homo sapiens
  misc_feature: GYAE6OF01AZSXA.29.67.G01.1.454.CMB.1.raw
  modified_base (238)..(238): a, c, t, g, unknown or other
  misc_feature (238)..(238): n is a, c, g, or t
  modified_base (487)..(487): a, c, t, g, unknown or other
  misc_feature (487)..(487): n is a, c, g, or t
  modified_base (497)..(497): a, c, t, g, unknown or other
  misc_feature (497)..(497): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccgggtccctgaccgattcagtggcagcggtctgggacagatttcacactcagtattagcagccctgcaggctgaagatgtgccatttatactgtcagcaatattatactactcccgacgttcgccaaggaccaaggtgagatacaacgaactcgnggcagcaccntcg

SEQ ID NO: 155617 - DNA, 519 bp, Homo sapiens
  misc_feature: GYAE6OF01AXOL0.29.67.G01.1.454.CMB.1.raw
  modified_base (238)..(238): a, c, t, g, unknown or other
  misc_feature (238)..(238): n is a, c, g, or t
  modified_base (515)..(515): a, c, t, g, unknown or other
  misc_feature (515)..(515): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcaggcggtctgggacagatttcacactcagtattagcagcctgcaggctgaagatgtggcctatttattactgtcagctaatattatacttactcccggtacgttcggccgaacgggaccgaaggtcggagatcaaacgtaacgtgtaggctagccacnctcg

SEQ ID NO: 155618 - DNA, 512 bp, Homo sapiens
  misc_feature: GYAE6OF01B6PIG.29.67.G01.1.454.CMB.1.raw
  modified_base (239)..(239): a, c, t, g, unknown or other
  misc_feature (239)..(239): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccaagaatattttanatagctacaacaataagaattacttagcttggtaccagcagaaaccaggacagcctcctaagctgctcatttactgggcatcgtacccgggaatccgggtcctgacgattcagtgcagcgggtctgggacaggatttcacactcagtattagcagcctgcaggctagaagtatgtggcctatttacttactgtcagacaattattatactactcccggagtcgacgaacggacaaggtgagatacaaacgactagtgacgngacnccgntacg

SEQ ID NO: 155619 - DNA, 498 bp, Homo sapiens
  misc_feature: GYAE6OF01BIB6F.29.67.G01.1.454.CMB.1.raw
  modified_base (404)..(404): a, c, t, g, unknown or other
  misc_feature (404)..(404): n is a, c, g, or t
  modified_base (492)..(492): a, c, t, g, unknown or other
  misc_feature (492)..(492): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatatttatatagctccaacaataagaattacttagcttggtaccagcagaaaccaggacagcctcctaagctgctcatttactgggcatctacccgggaatccgggtcctgaccgatcagtggcagcggtctgggacagatttcacactcagtattagcagcctgcagctgaagntgtggccatttatactgtcagcaatattatactactcccggacgttcgccacgggaccagggtgagagtcaaacgaactgtgcgtgcnccatcg

SEQ ID NO: 155620 - DNA, 509 bp, Homo sapiens
  misc_feature: GYAE6OF01EWPLP.29.67.G01.1.454.CMB.1.raw
  modified_base (237)..(237): a, c, t, g, unknown or other
  misc_feature (237)..(237): n is a, c, g, or t
  modified_base (405)..(405): a, c, t, g, unknown or other
  misc_feature (405)..(405): n is a, c, g, or t
  modified_base (505)..(505): a, c, t, g, unknown or other
  misc_feature (505)..(505): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatatttanatagctccaacaataagaattactagcttggtaccagcagaaaccaggacagcctcctaagctgctcatttactggcatctacccgggaatccgggtcctgaccgattcagtggcagcgggtctgggacagatttcacactcagtattagcagcctgcaggctgaagntgtgcctatttatactgtcagcaatattatactacctccccggagtcgccaagggaccaacggtggaagatacgaaacgaacgtagtacggctagcaccntacg

SEQ ID NO: 155621 - DNA, 513 bp, Homo sapiens
  misc_feature: GYAE6OF01A33YQ.29.67.G01.1.454.CMB.1.raw
  modified_base (238)..(238): a, c, t, g, unknown or other
  misc_feature (238)..(238): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccgggtccctgaccgattcagtggcagcggtctgggacaggatttcacactcagtattagcagcctgcaggctgaagatgtggcctatttattactgtcagtcaattattatactacctccccggacgttcggaccagggaccaaggtggagactacaaacgaagtagtggacngcaccntc

SEQ ID NO: 155622 - DNA, 505 bp, Homo sapiens
  misc_feature: GYAE6OF01DX4U1.29.67.G01.1.454.CMB.1.raw
  modified_base (237)..(237): a, c, t, g, unknown or other
  misc_feature (237)..(237): n is a, c, g, or t
  modified_base (478)..(478): a, c, t, g, unknown or other
  misc_feature (478)..(478): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattccagtggcagcgggtctggggacagatttcacactcagtattagcagccctgacaggctgaagtatgtggcctattttatactgtcagctaatattatactactcccggatcgacaggaccgagcgganatcaaacgacaggtgacngcnccntcg

SEQ ID NO: 155623 - DNA, 512 bp, Homo sapiens
  misc_feature: GYAE6OF01AGUBM.29.67.G01.1.454.CMB.1.raw
  modified_base (238)..(238): a, c, t, g, unknown or other
  misc_feature (238)..(238): n is a, c, g, or t
  modified_base (509)..(509): a, c, t, g, unknown or other
  misc_feature (509)..(509): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccgggtcctgaccgattcagtggcagcgggtctgggacagatttcacactcagtattagcagcctgcaggctgaagatgtgcctatttatactgtcagactaatattatactacctcccggacgttcgccgaagggaccaaggtggagactcaaacgactcggtcggctagcaccgtntcg

SEQ ID NO: 155624 - DNA, 514 bp, Homo sapiens
  misc_feature: GYAE6OF01EYY1V.29.67.G01.1.454.CMB.1.raw
  modified_base (238)..(238): a, c, t, g, unknown or other
  misc_feature (238)..(238): n is a, c, g, or t
  modified_base (413)..(413): a, c, t, g, unknown or other
  misc_feature (413)..(413): n is a, c, g, or t
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcattactgggcatctaaccccgggaatcccggggtccctgaccgattcagtggcaggcgggtctgggacagatttcacactcagtattagcagcctgcaggctgaagntgtgccatttatactgcagcaatattatactactcccggacgttcgccaacggaccgaaggtcggaganacaaacgaactacgtggactagctaccntacg

SEQ ID NO: 155625 - DNA, 564 bp, Homo sapiens
  misc_feature: GYAE6OF01DBVL3.29.67.G01.1.454.CMB.1.raw
  modified_base (191)..(191): a, c, t, g, unknown or other
  misc_feature (191)..(191): n is a, c, g, or t
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
  modified_base (528)..(528): a, c, t, g, unknown or other
  misc_feature (528)..(528): n is a, c, g, or t
  modified_base (544)..(544): a, c, t, g, unknown or other
  misc_feature (544)..(544): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagaggccacatcaactgcaagtccacgccagtaattattttanatagcctacaaacaataagtaattacttagcttaggtaccagacaagaaaccaggacagcctactaagctgctctatttacgnggacagtccgtaaccgggactccgggtcctagaccgtattcgagtgcgaggcggtcgtagggactagtactttacactactacgagtagttagcagccctagcaaggtctagaaagtgtgtcgtacttagtttatacgttgtacagtactaagttacttactaccgttaccgtcccggtagtccgaacgacggtacgaagtagganaacacgaaacgtacgngtcgtatagacacgtatccg

SEQ ID NO: 155626 - DNA, 501 bp, Homo sapiens
  misc_feature: GYAE6OF01BQE0L.29.67.G01.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (402)..(402): a, c, t, g, unknown or other
  misc_feature (402)..(402): n is a, c, g, or t
  modified_base (497)..(497): a, c, t, g, unknown or other
  misc_feature (497)..(497): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctacaacaataagaattacttagcttggtaccagcagaaccaggacagcctctaagctgctcatttacnggcatctaccgggatccgggtcctgaccgatcgagtggcagcggtctgggacagatttcacactcagtattagcagcctgcaggctgaagntgtgcctatttatactgtcagctaatattatactactcccgacgttcgaccgacggacgaaggtggagagtcaaacgactagtgacgtagcaccntccg

SEQ ID NO: 155627 - DNA, 510 bp, Homo sapiens
  misc_feature: GYAE6OF01BW7KK.29.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (506)..(506): a, c, t, g, unknown or other
  misc_feature (506)..(506): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctacaacaataagaattacttagcttggtaccagcagaaaccaggacagcctcctaagctgctcatttacngggcatctaccgggaatccgggtcctgaccgattcagtgcagcgggtctgggacagatttcacactcagtattagcagctgcaggctagaagatgtcggacctatttatactgtcagctaatattatactactcccgagtcgacgaacggacgaaggtcgagactacaaacgtactagtcggactgacaccgntacg

SEQ ID NO: 155628 - DNA, 535 bp, Homo sapiens
  misc_feature: GYAE6OF01AD7RM.29.67.G01.1.454.CMB.1.raw
  modified_base (238)..(238): a, c, t, g, unknown or other
  misc_feature (238)..(238): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaaccaggacagcctcctaagctgctcattactgggcatctacccgggaatcccgggtcctgaccgattcagtggcagcggtctgggacagtntttcacactnagtattagcagcctgcaggctgaagtatgtggcctatttatactgtcagactaattattactactaaccgtcccggacgttcggaccaaacgggaccgaaacgggtcgaggaactacgaaacgaacgtaggtggactgactacccaagttcg

SEQ ID NO: 155629 - DNA, 130 bp, Homo sapiens; identical to SEQ ID NO: 155561
  misc_feature: GYAE6OF01CFRFO.29.67.G01.1.454.CMB.1.raw
  modified_base (130)..(130): a, c, t, g, unknown or other
  misc_feature (130)..(130): n is a, c, g, or t

SEQ ID NO: 155630 - DNA, 132 bp, Homo sapiens
  misc_feature: GYAE6OF01CW0WM.29.67.G01.1.454.CMB.1.raw
  modified_base (130)..(132): a, c, t, g, unknown or other
  misc_feature (130)..(132): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnn

SEQ ID NO: 155631 - DNA, 526 bp, Homo sapiens
  misc_feature: GYAE6OF01CTKE4.29.67.G01.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
  modified_base (520)..(520): a, c, t, g, unknown or other
  misc_feature (520)..(520): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctacaacaataagaattacttagcttggtaccagacaagaaaccaggacagcctactaagctgctcatttacngggcatctaccgggaatccgggtcctgaccgattcagtgcaggcggtcngggacagactttcacactcagtattagcagcctgcaggctagaagtntgtcgcctatttattatgtacagtacaattattactaactaccgtcccggtagttccggacgaacggaccgaaggtggagactaacaaacgaacgtcgtacgctgaccncattcg

SEQ ID NO: 155632 - DNA, 552 bp, Homo sapiens
  misc_feature: GYAE6OF01BJGEO.29.67.G01.1.454.CMB.1.raw
  modified_base (191)..(191): a, c, t, g, unknown or other
  misc_feature (191)..(191): n is a, c, g, or t
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (546)..(546): a, c, t, g, unknown or other
  misc_feature (546)..(546): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagagggccaccatcaactgcaagtccagccaagaatattttanatagctaccaacaataagaattacttagcttggtaccagcagaaaccaggacagcctcctaagctgctcatttacnggcatctacccgggaatcccgggcctgaccgattcagtgcagcggtctgggacagtattcactactcagtattagcagcctgcaggctaggaagtagtggtacggcctaattttacttacgtgtacagacaattattacttacctacccgtcccggtacgtcggtaccgaaagggaccgaagggtacggtagaacgtacgaaaaccgacgtagtacggactagcaaccgtnttaccg

SEQ ID NO: 155633 - DNA, 663 bp, Homo sapiens
  misc_feature: GYAE6OF01B289T.29.67.G01.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (324)..(324): a, c, t, g, unknown or other
  misc_feature (324)..(324): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtctccagactccctggctgtgttctgggcgagaggccaccatcaactgcaagtccagccaagaattatttanatagctaccaaanaataagaattactagcttaggtaaccagacaagaaaccaggaacacgcctacctaagctgctctaatttacgngggactagtccgtaacccgggaacgtcccggggtccctaggaccgtattcgaggtggcaggcgggtctgggactagtacttcgacactcagttatagcagcctgacgaggctaagaacgtagttcggtcggtaaccttaagtttttaactaacgttcgttacgaacgtactaaaatttacttaacttaacccgtacccgttacccccgggtacggtttacccggaccggtaaacccggggaaccgtaaaacggggtacggaaggtaacgtaaacccgaaaaccggtaaacgttacgggtacggtaccggttaccgaacctaaacccgtcgtttacccgg

SEQ ID NO: 155634 - DNA, 588 bp, Homo sapiens
  misc_feature: GYAE6OF01BIUOT.29.67.G01.1.454.CMB.1.raw
  modified_base (237)..(237): a, c, t, g, unknown or other
  misc_feature (237)..(237): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagaggccaccatcaactgcaagtccagccagaatattttanatagctaccaacaataagaattacttagcttggtaccagcagaaaccaggacagcctcctaagctgctcatttactgggcatctacccgggaatcccgggtcctcgaccgattcagtggcaggcggtctgggacaggatttcactactcagtattagcagcctgcgaggctaggaagtagtggtcggtacctaattttacttactgtacagtactaagttacttaattacctaccgtaccccggtacgttcccggaccgtaaacgggaacccgtaaggggtacggaaggtaacgtaccgaaaacgtaaccgtacggttacgggacgttacggacctacccgtagttacccg

SEQ ID NO: 155635 - DNA, 504 bp, Homo sapiens
  misc_feature: GYAE6OF01A1KH3.29.67.G01.1.454.CMB.1.raw
  modified_base (411)..(411): a, c, t, g, unknown or other
  misc_feature (411)..(411): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaaataagaattacttagcttggtaccagcagaaaccaggacagcctcctaagctgctcatttactggcatcctacccgggaatcccggggtcctgaccgattcagtggcagcggtctgggacagattcgacactcagtattagcagcctgcaggctgaagngtgtgcctatttattactgtcagcaatattatactactcccggagtcgaccgaggacgaaggtgagactacaacgatagtcgntagcncgntc

SEQ ID NO: 155636 - DNA, 574 bp, Homo sapiens
  misc_feature: GYAE6OF01D6O5O.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgcaagtccagccagaattattttatatagctaccaacaataagaattacttagcttggtaccagacaagaaaccaggacagcctcctaagctgctctatttacgtggcatccgtaccgggaacgtcccgggtcctcgaccgtattcgagtcggcgaggcgggtcgtagggacagtactttacactactcagttattagcagtcctgcgaggcgtagaagtagtggtcgtacctattttattactgtacagtactaatattaacttacctaccgtcccggtacgtcggaccgaacggaccgtaaggtacggagtaacgtacgaaacgtaacgtacggtacggtactagacctaccgtatacg

SEQ ID NO: 155637 - DNA, 523 bp, Homo sapiens
  misc_feature: GYAE6OF01DW7VM.29.67.G01.1.454.CMB.1.raw
  modified_base (238)..(238): a, c, t, g, unknown or other
  misc_feature (238)..(238): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctnatttacnggcatctacccgggaatccgggtcctgaccgattcagtgcagcggtctgggacagtattcacactnagtatagcagcctgcagctgagntgtgcctatttatactntctanctaatattactactaccgtaccccggacgttcggaccaagggtaccaaagggtcggagaacgtacgaaacgaacgtcgtacggactgcaccagttcccg

SEQ ID NO: 155638 - DNA, 187 bp, Homo sapiens
  misc_feature: GYAE6OF01CZCOC.29.67.G01.1.454.CMB.1.raw
  modified_base (132)..(187): a, c, t, g, unknown or other
  misc_feature (132)..(187): n is a, c, g, or t
tcagatagagtactcacgaccggtgctcgatttagagtatacatattgggtttgggcacgagcggccctgggctgcctggtcaaggactacttccagtacctctatctgagcgggctggcaaggcgcatagnnnnnnnnnnnnnnnnnnnnnnnnnnnnnnnnnnnnnnnnnnnnnnnnnnnnnnnn

SEQ ID NO: 155639 - DNA, 679 bp, Homo sapiens
  misc_feature: GYAE6OF01DPP09.29.67.G01.1.454.CMB.1.raw
  modified_base (243)..(243): a, c, t, g, unknown or other
  misc_feature (243)..(243): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtcctccagactccctggctgtgttcgtgggcgaggagggccaccatcaactgacaagtccagccaagtaattatttanatagctaccaacaataagtaattactagtcgttaggtaccagacaacgaaaccaggaacacgcctaccgtaagctacgtctactatttacgtgggactacgtaccgtacccgggaacgtcccgggtcctagaccgattcgagtggcaggcggtcgtaggacagtacttacactactctaagttagttacgcgatcccgtgcgaggtcgtaggaagagttcggtacggtaccttaagttttaacgttaccgtaggtacctaaggtaccttaaagttaacgtttaaccttaacccgtttaccccgacccccgggttaacgtttccgggaacccggtaaaccgggaaaccggtaacgggtacgggtaacgtaacggtaaaccgaaaccgtaaaccggtaggtaccgggttaccgacggacccttaaccgcgtttacccg

SEQ ID NO: 155640 - DNA, 530 bp, Homo sapiens
  misc_feature: GYAE6OF01EAK1O.29.67.G01.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (526)..(526): a, c, t, g, unknown or other
  misc_feature (526)..(526): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaccaggacagcctcctaagctgctcatttacnggcatctaccgggaatcccgggtcctgaccgattcagtggcaggcggtctggggacagatttcacactcagtatagcagcctgcaggctagaagatgtggcctattttattactgtacagcaattattaatacctactccccggtagttccggaccgaaagggaccgaagggtcggaagactacaaacgaactacggtacggacgtagcaccgntacg

SEQ ID NO: 155641 - DNA, 531 bp, Homo sapiens
  misc_feature: GYAE6OF01BHWG9.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcattactgggcatctacccgggaatccgggtcctgaccgattcagtggcaggcgggtctgggacagatttcacactcagtattagcagcctgcaggctgaagatgtggcctatttatactgtcagcaatattatactacctccccggtacgttcggccgaacgggaccgtaacggtggtagaacgtacgaaaccgaacgtacgtcggacgtgaccaccgcgttacg

SEQ ID NO: 155642 - DNA, 555 bp, Homo sapiens
  misc_feature: GYAE6OF01C4O3Q.29.67.G01.1.454.CMB.1.raw
  modified_base (191)..(191): a, c, t, g, unknown or other
  misc_feature (191)..(191): n is a, c, g, or t
  modified_base (371)..(371): a, c, t, g, unknown or other
  misc_feature (371)..(371): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagagggccaccatcaactgcaagtccagccagaatattttatatagctcaaacaataagaattaacttagcttggtaccagcaagaaaccaggacagcctaccaagctgctcatttactggcatcgtacccgggaactccggggtccctgaccgtatcagtggacaggcggtcgngggacaggtatttcacactacagtattacgcagcctgcaggtcagaagagtgcggtactagttttacttaacgtgtacagtactaattaacttataccttaccgtccccggtacgttccggtacgaccgggaacgacgggtaggacgaatacaaacgtaatacgtaggtacngacncctatacc

SEQ ID NO: 155643 - DNA, 511 bp, Homo sapiens
  misc_feature: GYAE6OF01CASBS.29.67.G01.1.454.CMB.1.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (508)..(508): a, c, t, g, unknown or other
  misc_feature (508)..(508): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacattgtgatgacccagtctccagactccctggctgtgtttctgggcgagagggccaccatcaactgcaagtccagccagaatattttanatagctccaacaanaagaattacttagcttggtaccagcagaaaccaggacagcctcctaagctgctcattactggcatctaccgggaatccgggtccctgaccgattccagtggcaggcggtctgggacagatttcacatcagtacttagcagcctgcaggctagaagatgtgcctaatttactactgtcagcaatacttaatactacctacccggacgttcggccaacggacgaaggtgagagtcaaacgaatacgtaggctagcacntcg

SEQ ID NO: 155644 - DNA, 526 bp, Homo sapiens
  misc_feature: GYAE6OF01C5H54.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaaccaggacagcctcctaagctgctctatttactgggcatctacccgggaatccgggtcctgaccgattcagtggcaggcggtctgggacaggatttcactactcagtatagcagcctgcagctgaagatgtggacctatttacttactgtcagactaatattatactacgtccccgtacgttaccgccgacggaccgaaggtaggagagtacgaaacgaacgtcgtaggactagccactctacg

SEQ ID NO: 155645 - DNA, 560 bp, Homo sapiens
  misc_feature: GYAE6OF01CC695.29.67.G01.1.454.CMB.1.raw
  modified_base (236)..(236): a, c, t, g, unknown or other
  misc_feature (236)..(236): n is a, c, g, or t
  modified_base (317)..(317): a, c, t, g, unknown or other
  misc_feature (317)..(317): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagaggccaccatcaactgcaagtccagccagaatattttanatagctacaacaataagaattacttagcttaggtaccagacaagaaaccaggacagcctacctaagctgctctatttacgnggcatccgtacccgggaatccgggtcctgaccgattcgagtgcaggcgggtctgggacagtacttcactactcattattagcagcctgcaaggctagaagtatgtcgactagtttatatgtacagtactaaattattaactacctaccgtccccggagttccggaccgaaacgggtaccgaaagggttacggagaacgtacgaaaacgtaacgttacggtgtacgtagaccacgtacgtaccg

SEQ ID NO: 155646 - DNA, 546 bp, Homo sapiens
  misc_feature: GYAE6OF01ARZO2.29.67.G01.1.454.CMB.1.raw
  modified_base (239)..(239): a, c, t, g, unknown or other
  misc_feature (239)..(239): n is a, c, g, or t
  modified_base (421)..(421): a, c, t, g, unknown or other
  misc_feature (421)..(421): n is a, c, g, or t
  modified_base (540)..(540): a, c, t, g, unknown or other
  misc_feature (540)..(540): n is a, c, g, or t
tcagatagagtactcacgaccggtgctcgatttagagtatacatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaaccaggacacgcctacctaagctgctacatttacgtgggcatcgtacccgggaatcccggggtcctgaccgattcagtggcagcggtctgggacagactttcacactcagtattagactagcctgcaggctagaagtntgtaggacctatttatacgtgtacagctaattattatactaccgtcccggacgttccgaccgaacgggaccgtaagggtcgagtactacgaaacgtaactacggtacgcgtagcctccncgtacg

SEQ ID NO: 155647 - DNA, 549 bp, Homo sapiens
  misc_feature: GYAE6OF01A0UIN.29.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (408)..(408): a, c, t, g, unknown or other
  misc_feature (408)..(408): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttacnggcatctacccgggaatcccggggtcctgaccgattcagtgcagcgggtctgggacagattcacactcagtatagcacgcctgcaggctagaagngtgtggcctaatttacttaacgtgtcagtactaattattataacctaccgtaccccggtacgttaccggaccgaacgggaaccgtaaagggtcggagaagtaccgaaacgaacgtagtacggactagcctccgtagtaccg

SEQ ID NO: 155648 - DNA, 541 bp, Homo sapiens
  misc_feature: GYAE6OF01B34E6.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctaccaacaataagaattacttagcttggtaccagcagaaccaggacagcctctaagctgctctatttactgggcatccgtacccgggaactcccggggtccctgaccgtattcaggtgcgaggcggtcgtgggacaggatttcacactcagtattagcagccctgcaggctgaagtgtgtcggacctattttattactgtcagtctaattattactacctaccgtcccggtacgttcggaccgacggaccgaaggtcggagactacgaaacgactaggtcggtctagccactgtccg

SEQ ID NO: 155649 - DNA, 569 bp, Homo sapiens
  misc_feature: GYAE6OF01A9LU9.29.67.G01.1.454.CMB.1.raw
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagatatttanatagctaccaacaataagaattactagcttggtaccagcagaaaccaggacagcctctaagctgctcattacnggcatcgtaccggatcccgggtcctgaccgtattcagtggcaggcggtctagggacagtactttcactactacagtacttagctagccctgcgaggtcgtagaagatgtcggacctaagttttacttacgtagttcaagtacgtaaattattactaacttaccgtaccccggtacgttaccggtaccgaagggtaacccgtaagggtcggaagacgtaaccgaaacgtaacgtaggtacgacgtagccaaccgtgtaccg

SEQ ID NO: 155650 - DNA, 534 bp, Homo sapiens
  misc_feature: GYAE6OF01CVBIA.29.67.G01.1.454.CMB.1.raw
  modified_base (237)..(237): a, c, t, g, unknown or other
  misc_feature (237)..(237): n is a, c, g, or t
  modified_base (520)..(520): a, c, t, g, unknown or other
  misc_feature (520)..(520): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatatttanatagctcaacaataagaattacttagcttggtaccagcaagaaaccaggacagcctcctaagctgctcatttactgggcatctacccgggaatccggggtcctgaccgatcagtggcagcggtctgggacagatttcacactcagtattagcagcctgcaagctgaagatgtcggcctagtttacttacgtgtcagctaaatattatactaacgtcccggtacgtcggtaccgaaacgggaccgaacggtggaagagtacaaacgaactacgtaggtacgtanaccgacacgttacg

SEQ ID NO: 155651 - DNA, 530 bp, Homo sapiens
  misc_feature: GYAE6OF01BDC1X.29.67.G01.1.454.CMB.1.raw
  modified_base (236)..(236): a, c, t, g, unknown or other
  misc_feature (236)..(236): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagaggccaccatcaactgcaagtccagccagaatattttanatagctccaacaataagaattacttagcttggtaccagcagaaaccaggacagcctcctaagctgctcatttactggacatcgtaccgggaatcccgggtcctgaccgattcagtggcaggcggtntggacagtactttcacgtactcaagtattagcagcctgcaggctagaagntgngcctatttatactgtcagcaattattactactacgtcccgagttcggacctaacgggaccgaagggtcgagaactacgaaacgaacgtcgttacggcgtagccaccgagttaccg

SEQ ID NO: 155652 - DNA, 542 bp, Homo sapiens
  misc_feature: GYAE6OF01A9XLS.29.67.G01.1.454.CMB.1.raw
  modified_base (237)..(237): a, c, t, g, unknown or other
  misc_feature (237)..(237): n is a, c, g, or t
  modified_base (410)..(410): a, c, t, g, unknown or other
  misc_feature (410)..(410): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgcaagtccagccagaatattttanatagctcaacaataagaattactagcttggtaccagcacgaaaccaggacagcctacctaagctgctcattactgggcatcgtacccgggaatcccggggtcctggaccgtacttcgagtggcagcggtctgggacagatttcactacgtcagttatacgcagccctgcaggntacgaagatcgtacggtcctaattttacgtactgtaccagactaattacgttaatactaccgtcccgacgttccgtacgaccggtacaaggtggtagactcaaacgtaccgtgtacggctacgcacgctacg

SEQ ID NO: 155653 - DNA, 504 bp, Homo sapiens
  misc_feature: GYAE6OF01C61RY.29.67.G01.1.454.CMB.1.raw
  modified_base (238)..(238): a, c, t, g, unknown or other
  misc_feature (238)..(238): n is a, c, g, or t
  modified_base (500)..(500): a, c, t, g, unknown or other
  misc_feature (500)..(500): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctcaacaataagaattacttagcttggtaccagcagaaaccaggacagcctctaagctgctcatttactgggcatctaccgggaatccggggtcctgaccgattcagtggcagcggtctgggacagatttcacactcagtattagcagcctgcaggctgaagtatgtgcctatttatactgtcagcaatatatactactcccggagttcgccgaacggacgaaggtggaagatcaaacgaactgtacggctgcacgtntacg

SEQ ID NO: 155654 - DNA, 544 bp, Homo sapiens
  misc_feature: GYAE6OF01CWJFL.29.67.G01.1.454.CMB.1.raw
  modified_base (241)..(241): a, c, t, g, unknown or other
  misc_feature (241)..(241): n is a, c, g, or t
  modified_base (538)..(538): a, c, t, g, unknown or other
  misc_feature (538)..(538): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgttgttcgtgggcgagagggccaccatcaactgcaagtccagccagtaattattttanatagctaccaacaataagaattacttagcttaggtaccagacagaaaccaggacagcctactaagctgctctatttactgggcatccgtacccgggacgtccgggtccctgaccgattcagtggcacggcgggtcgtcgggacaggtactttcactactacagtattagcagcctgacaggctagaagtagtgtcgtccttatttacttactgtacagactaatattattacctaccgtcccgtacgttcgacgaacggacgacggtagagtacgacgaacgtagacgtggacagcnctgtcg

SEQ ID NO: 155655 - DNA, 618 bp, Homo sapiens
  misc_feature: GYAE6OF01D1ZRQ.29.67.G01.1.454.CMB.1.raw
  modified_base (237)..(237): a, c, t, g, unknown or other
  misc_feature (237)..(237): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatatttanatagctcaaacaataaagaattacttagcttggtaaccagcaagaaaccaggacagcctctaagctgctctattactggcatctaccgggaatcccgggcctgaccgtatcagtgcgaggcggtcgtgggacagtatttcgaactacttacagttacttagcaagtccgtgacgagggtcctaggaagtagtcggtacggtaccttaagttttaacttacgtgtacgtacgactaaactttattaactacccgttaacccgtacccccggtaacggttacccggtaaccgaaaccggggtaaccgaaacgggtggtaacgaacgtaaacggaaaaccgtaacgttacgtacgggtacgtaccgacaccctaagtttacccg

SEQ ID NO: 155656 - DNA, 551 bp, Homo sapiens
  misc_feature: GYAE6OF01BGAPR.29.67.G01.1.454.CMB.1.raw
  modified_base (320)..(320): a, c, t, g, unknown or other
  misc_feature (320)..(320): n is a, c, g, or t
  modified_base (548)..(548): a, c, t, g, unknown or other
  misc_feature (548)..(548): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagaggccaccatcaactgcaagtccagccagtaatattttatatagctaccaacaataagtaattacttagcttggtaccagacaagaaaccaggacagacctacctaagctgctctatttacngggcacgtcgtaaccccgggaagttcccggggtcctggaccgtattcaggtgcaggcggtctgggactgtattcactactctagttacttagcagcctgcgaggctagagagtgtcgacctatttactactgtacaagtactaattattactactacccgtacccggtacgttcggaccgaggtaccgaaggtggagactacgaaagtacgagtcgactagcaccgtntcg

SEQ ID NO: 155657 - DNA, 205 bp, Homo sapiens
  misc_feature: GYAE6OF01DNG4S.29.67.G01.1.454.CMB.1.raw
  modified_base (112)..(112): a, c, t, g, unknown or other
  misc_feature (112)..(112): n is a, c, g, or t
  modified_base (133)..(138): a, c, t, g, unknown or other
  misc_feature (133)..(138): n is a, c, g, or t
  modified_base (145)..(205): a, c, t, g, unknown or other
  misc_feature (145)..(205): n is a, c, g, or t
tcagatagagtactcacgaccggtgctcgatttagagtatacatattgggtttgggcacagtcggccctgggcctgcctggtcaaggactaccttccagtactctatctgancgggctggcaaggcgcatagnnnnnngcatgcnnnnnnnnnnnnnnnnnnnnnnnnnnnnnnnnnnnnnnnnnnnnnnnnnnnnnnnnnnnnn

SEQ ID NO: 155658 - DNA, 717 bp, Homo sapiens
  misc_feature: GYAE6OF01DAWUO.29.67.G01.1.454.CMB.1.raw
  modified_base (239)..(239): a, c, t, g, unknown or other
  misc_feature (239)..(239): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttanatagctaccaaacaataagaattacttagcttggtaccagcaagaaacaggacacgcctacctaagctgctctatttacgtgggctactccgtaacccgggtaacgttcccggggtccctacggtaccgtaatttccgaggttcggcgacgggtccggggttcgtcggggaacaagttacgtttaccaacgtacttaccgtaagttaacgttaacgccgtaacgtcccttacggaccgtaagggtcctaaggtaaaggtagttcggtacgggtaaccctttaatttttaacgtttaccgtggttaccacggtaaacttaaagtttaacgtttaacttaccctaaccccgttacccccgggtaccggtttacccgggacccggtaaaccgggaacccggtaaagggtacggtaagtaacggtaaccgaaaaccggttaacgtagggttccgggacttacggactaaccctagttacccg

SEQ ID NO: 155659 - DNA, 559 bp, Homo sapiens
  misc_feature: GYAE6OF01D71DM.29.67.G01.1.454.CMB.1.raw
  modified_base (553)..(553): a, c, t, g, unknown or other
  misc_feature (553)..(553): n is a, c, g, or t
tcagatagagtactcacgaccggtgctcgatttagagtatacatattgggtttgggggagctacaacaggcaggcagggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctaccaacaataagaattactagcttggtaccagcaagaaaccaggacagcctcctaagctgctctatttactgggcatccgtaacccgggaactcccggggtccctgaccgtattcgagtggcaggcggtctgggacagtactttcactactcgaagtatagcagcctgcgaggtctagaagtgtgtcgacctatttatactgtcagactaattattaactaccgtaccgtcccggtacgttaccggaccgaacggacgaacggtaggagacgtacgaaacgtaacgtacgtacggacagaccgaccngttccg

SEQ ID NO: 155660 - DNA, 635 bp, Homo sapiens
  misc_feature: GYAE6OF01C6YK2.29.67.G01.1.454.CMB.1.raw
  modified_base (629)..(629): a, c, t, g, unknown or other
  misc_feature (629)..(629): n is a, c, g, or t
tcagatagagtactcacgaccggtgctcgatttagagtatacatattgggtttgggggagctacaacaggcaggcaggggcagcaagatggtgttgcagacccaggtcttctatttctctgttgctctggatctcgtggtgccgtacgggacatcgtgatcgacccagggggtctccagacctcctggctgttgttcgtggcgaggacggccacatcaactcgacaacgtccacgaccaagtaattattttatatagtacctaccaaacaaataaagtaaattacttagtacttaggtaaccaagacaacgaaacaggacacgcctactaagctgctactattactagggctacgtccgtaacccgggtaacgtccggggtaccctacgtaccgtactacgagtcggacaggcggtcgtcgggacacgtacgtttcactacgtactaagtattacgcacgccgtagctaggctagaacgtgtagtcggacccttaagttttactacgtgtaacaacgtactaaatttattaactaaccgttaccgtcccggtaacgttacgtccggtaaacggaccgaagggtgaacggaacttacgaaacgtaccgttaggtcgtacgagaaccctangttacg

SEQ ID NO: 155661 - DNA, 675 bp, Homo sapiens
  misc_feature: GYAE6OF01E6EUF.29.67.G01.1.454.CMB.1.raw
  modified_base (191)..(191): a, c, t, g, unknown or other
  misc_feature (191)..(191): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtctccagactccctggctgtgttcngggcgagacgggccacatcaactgcaagtccagccaagtaattattttatatagacctaccaaacaattaaagtaattactagtcttggtaaccagacaacgaaaccaggaccagccctactaagcctgcctactattttacgcgggtctacgttacccgtaacccgggacgttcccggggtaccctaggtacccgtagtccggtaaggtcgggtacgacggtcgggtacgtaggggaactagtactttccaccgtatcgaagttactaagccgtacgtcccgttgaccgaggtaccgtaggaacgtcgtacggtcggtaacctttaatttaacgttcttacgtcgtaacgtactaaattacctttaactaccgttaccgtaccccggtacggttaccggaccgtaaacgggaacccggtaaggtcggaagtaaccgtaacaaacgggtacttcggtacggtacctagtacccgctagttcccg

SEQ ID NO: 155662 - DNA, 511 bp, Homo sapiens
  misc_feature: GYAE6OF01DPBNE.29.67.G01.1.454.CMB.1.raw
  modified_base (237)..(237): a, c, t, g, unknown or other
  misc_feature (237)..(237): n is a, c, g, or t
  modified_base (407)..(407): a, c, t, g, unknown or other
  misc_feature (407)..(407): n is a, c, g, or t
  modified_base (445)..(445): a, c, t, g, unknown or other
  misc_feature (445)..(445): n is a, c, g, or t
  modified_base (506)..(506): a, c, t, g, unknown or other
  misc_feature (506)..(506): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctcagactccctggctgtgtttctgggcgagagggccaccatcaactgcaagtccagccagaatattttanatagctaccaacaataagaattacttagcttggtaccagcagaaaccaggacagcctctaagctgctcatttactggcatctaccggatccgggtcctgaccgattcagtggcagcggtctggacagatttcactactcagtattagcagcctgacaggctgaagatcgngtcctatttattactgtcagactaatattatactaccncccggtacgtcggcaacggactaaggtggaagatcgaaacgaacgtgtaggctggacacgntaccg

SEQ ID NO: 155663 - DNA, 558 bp, Homo sapiens
  misc_feature: GYAE6OF01AYUB4.29.67.G01.1.454.CMB.1.raw
  modified_base (238)..(238): a, c, t, g, unknown or other
  misc_feature (238)..(238): n is a, c, g, or t
  modified_base (349)..(349): a, c, t, g, unknown or other
  misc_feature (349)..(349): n is a, c, g, or t
  modified_base (420)..(420): a, c, t, g, unknown or other
  misc_feature (420)..(420): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaaccaggacagcctcctaagctgctacatttactgggcatccgtaccgggaatccgggtcctgaccgnttcagtggcaggcggtctagggacagtatttcactacgtctagtattagcacgcctgcgaggctagaagtntgtgacctagtttattacgtgtcagtactaagttacttataccgtaccgtaccccggacgttaccggacctaacgggacccgaagggtacggagtacgtacgtaaaccgacgtacgtacggctagaccacgtagttcc

SEQ ID NO: 155664 - DNA, 130 bp, Homo sapiens; identical to SEQ ID NO: 155561
  misc_feature: GYAE6OF01DB077.29.67.G01.1.454.CMB.1.raw
  modified_base (130)..(130): a, c, t, g, unknown or other
  misc_feature (130)..(130): n is a, c, g, or t

SEQ ID NO: 155665 - DNA, 739 bp, Homo sapiens
  misc_feature: GYAE6OF01EJAA3.29.67.G01.1.454.CMB.1.raw
  modified_base (365)..(365): a, c, t, g, unknown or other
  misc_feature (365)..(365): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgttgtttcgtgggcgagacgggccaccatcaactgacaagtccagccagtaattattttaatatacgcctaccaaactaaataaagtaaactttaacgttaagtcctttagggtaacccaagaccaaacggaaaacccaagggaccacggacccttacctaagcctgcctactattttacgngggactacgtcccgtaacccggggaactcccggggtacctacggaccgtaatttccgaggtcggcgaggtcgggtgtacggggactaggtactttacgaactaccttacgtaacgttaagttacgcgtacggtccctagaccggtaggtaccgtagaacgtagtcggtacggtaccttaagttttacttacgttacgtacgaagtactaaagttaatttaaccgtaacccttaccggttacccccgggtacggtttaccggacccggtaaacgggtaacccgtaaaggggtacggtaaggtaacgtaaaccggtaaaaccggtaacgttaacggtacggaaccgttacggtaaccctaaccgtacctttaccgg

SEQ ID NO: 155666 - DNA, 732 bp, Homo sapiens
  misc_feature: GYAE6OF01D2554.29.67.G01.1.454.CMB.1.raw
  modified_base (196)..(196): a, c, t, g, unknown or other
  misc_feature (196)..(196): n is a, c, g, or t
  modified_base (342)..(342): a, c, t, g, unknown or other
  misc_feature (342)..(342): n is a, c, g, or t
tcagatagagtactcacgaccggtgctcgatttagagtatacatattgggtttgggggagctacaacaggcaggcaggggcagcaagatggtgttgcagaccccaggtcttcatttctctgttgctctggatctctggtgccgtacggggacatcgtgatcgacccagtctccagacctccctggctgtgtttcgngggcgagcgggccaccatcaactgacaagtccagaccaagtaattattttatatacgcctaccaaactaataaagtaattacttagcgttaggtaccagacaacgaaaccaggacacgcctacctaagctgctactacgtttacgnggaccacgttaccgtaacccggggaacgttccccggggtacctacggtaccgtacgttcgacggttcgggaccgtaacgggtccggggttacgtacggggaaccctaggttaaccttttaccgaactaccgttaccgtaagtttacgttaacgaccgtaacggtcccgtacgcgtacggtactaggaagtacgtcggtaccgttacttaagttttaccgttacgtagtaccgaagtaccgtaaactttaacgtttacctaacccgttacccccggttacccgggtacggtttacccggaccggttaaacgggacccgtaagggtaccggagtaacctacgaaaaccgtacggtcgtaacgggtcccacggaccctacgtaccgtttaccg

SEQ ID NO: 155667 - DNA, 640 bp, Homo sapiens
  misc_feature: GYAE6OF01DHTC7.29.67.G01.1.454.CMB.1.raw
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagngggccaccatcaactgacaagtccagccagtaattattttatatacgctaccaaacaaataaagtaattaacttagcttaggtaccagacaagaaaccaggacacgcctactaagctgctacatttacnggcatccgtaccgggaacgtcccgggcctgaccgtntcaggtcgcacgcggatcgtagggactagtacttacgactactctagtatagctagcctgcgacgggactaggaaagtagtcggtacggtacctttaagttttactacgtgtaccgaagtactaaatttacttaactaacccgttacccggtacccccggtacggttacccggtaccgggtaaaccgggtaacggtaaacgggtagggtaaacggtaacgtaaaccgtaaaacggtaaaccgttcgggtaacggtaccgtacgtaccgaaccgtacg

SEQ ID NO: 155668 - DNA, 557 bp, Homo sapiens
  misc_feature: GYAE6OF01A0DQY.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattactagcttggtaccagcagaaaccaggacagcctctaagctgctcatttactggcatccgtaacccgggaatcccggggtcctcggaccgtattcgagtcggcgaggcgggtctgggactaggtactttacactactacagtacttagcagcctgcgaggctagaagtagtgtacgctatttatacgttgtcagtactaattattaattacctaccgtaccccgtacgttcggaccgaacggaccgtaaggtggacgacgtacgaaacgtaacgtaggtcggacgtagcacctgtcg

SEQ ID NO: 155669 - DNA, 582 bp, Homo sapiens
  misc_feature: GYAE6OF01BGDX0.29.67.G01.1.454.CMB.1.raw
  modified_base (316)..(316): a, c, t, g, unknown or other
  misc_feature (316)..(316): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagaattacttagcttggtaccagcagaaaccaggacagcctcctaagctgctcattttacgnggcatcgtacccgggaatcccggggtcctgaccgattcgagtggcaggcggtctgggacagtatttcacactcagtattagcagccctgcaggctaggaagtgtggtcggaccttaagttttacttactgtcagtacctaaattattacttaccgttaccgtccccgggtacgttaccggacccgtaaagggacccgtaagggtgggaagacgtaaccaaaacggtacgttacggtacgggtccgtagaccgtaaccctgttaccg

SEQ ID NO: 155670 - DNA, 591 bp, Homo sapiens
  misc_feature: GYAE6OF01B104K.29.67.G01.1.454.CMB.1.raw
  modified_base (191)..(191): a, c, t, g, unknown or other
  misc_feature (191)..(191): n is a, c, g, or t
  modified_base (241)..(241): a, c, t, g, unknown or other
  misc_feature (241)..(241): n is a, c, g, or t
  modified_base (332)..(332): a, c, t, g, unknown or other
  misc_feature (332)..(332): n is a, c, g, or t
  modified_base (583)..(583): a, c, t, g, unknown or other
  misc_feature (583)..(583): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttcgngggcgagagggccaccatcaactgcaagtccagccaagtaattattttanatagacctacaaacaataagtaattacttagcttaggtaaccagacaagaaaccaggaaccacgtcctacctaagctgctactatttacgnggctaacgtccgtaacccgggaacgtcccggggtaccctaggtaccgtattccgaggtcggacgaggtccgggtcgtagggactagtactttcactactacagtatacgctagctgcaggtcagagtatcggtacgtactatttacgtactgtacagtactaattactaacttacgtaaccgtcccgacgttcgaccgtaacgaccgtaaggtcgagactaacgaacgtagtggtacgacgacacgtaccngttacccg

SEQ ID NO: 155671 - DNA, 665 bp, Homo sapiens
  misc_feature: GYAE6OF01ARYKD.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaacttcaagtccagccagaattattttatatacgctaccaaacaataagaattacttagcttggtaccagcaagaaaccaggacagcctccaagctgctctatttactgggcatcgtacccgggaatccgggtccctggacccgtattcgagtcggactacggcgggtctgggacagtactttcaactacgttcgaagttacttagccgtaagtcctggacgacgggtctaggaacgtagttcggtcggtacctaagtttttaacttacgttagttaccagtaaccctaaatttaacgtttaaccgttaaccgttaccccgttacccccgggtacgttacccgggaacccggtaaccggggtaaaccgtaaacggggtacggaacggtaacgtaaccgaaaaccggtaacgtacgggtacggtacgtacggaccctacctacgttccgttaaccg

SEQ ID NO: 155672 - DNA, 736 bp, Homo sapiens
  misc_feature: GYAE6OF01DL1NF.29.67.G01.1.454.CMB.1.raw
  modified_base (196)..(196): a, c, t, g, unknown or other
  misc_feature (196)..(196): n is a, c, g, or t
  modified_base (246)..(246): a, c, t, g, unknown or other
  misc_feature (246)..(246): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagacctcccgtggctgtgtttcgngggcgagacgggccaccatcaacttcaagtccagccaagtaattatttanactagacctaccaaacaataaagtaattacgttagtcttaggtaaccagacgaacgaaaccgaggaccacgcctaccgtaagcctagctactagtttacgnggactacgtccgtaacccgggagtcccgggtcncgacgattcgagtcgacgaggtcggtgtgggaactcggtaattccaacgtctacgtaagtacgttacgacctacggtccgtaggaccgtacggtaccgtaagggaacggtacggttacggttaccgggtaccctttaaggtttttaacctttacggttaccgtaacgtaacgttaaccttaaagtttaccgtttaaacctaccccggttaacccggttacccccgggtacgttaccggggtaaccgtaaaccgggggaaaccctaaggggtacggtaaacggaacttaaacccggaaacggtaaccgttacgggtacggtaccgtacgaacccgtaaccttcggttacttacccgg

SEQ ID NO: 155673 - DNA, 130 bp, Homo sapiens; identical to SEQ ID NO: 155561
  misc_feature: GYAE6OF01EH0QO.29.67.G01.1.454.CMB.1.raw
  modified_base (130)..(130): a, c, t, g, unknown or other
  misc_feature (130)..(130): n is a, c, g, or t

SEQ ID NO: 155674 - DNA, 585 bp, Homo sapiens
  misc_feature: GYAE6OF01CN33N.29.67.G01.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataaagaattacttagcttggtaccagacaagaaaccaggacagcctactaagctgctcatttcnggcatccgtaccgggactccgggtcctgaccgtatcgagtggcaggcggtcgtgggactaggtactttcactacgtactagttacttagcaacggtccctgacagggtactagaagtagtgtcggtaccttaagttttacttactgtacaaggtactaaattattacttaccttacccgtcccggtacgttccggaccgaaacggtaaccgtaggtacggagtagtaaccgtaaacggtaactaggtacgcgtagaccacgtaattcgg

SEQ ID NO: 155675 - DNA, 505 bp, Homo sapiens
  misc_feature: GYAE6OF01D1CMF.29.67.G01.1.454.CMB.1.raw
  modified_base (238)..(238): a, c, t, g, unknown or other
  misc_feature (238)..(238): n is a, c, g, or t
  modified_base (400)..(400): a, c, t, g, unknown or other
  misc_feature (400)..(400): n is a, c, g, or t
  modified_base (501)..(501): a, c, t, g, unknown or other
  misc_feature (501)..(501): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctcaacaataagaattacttagcttggtaccagcagaaccaggacagcctctaagctgctcattactggcatctaccgggaatccgggtcctgaccgatcagtggcagcggtctgggacagattcacactcagtattagcagcctgcaggctgaagtntgtgcctatttatactgtcagctaattattatactactccccggtacgtcggacaagggaccaaggtggagatacgaaacgaacgtgtacgactagcaccntacg

SEQ ID NO: 155676 - DNA, 735 bp, Homo sapiens
  misc_feature: GYAE6OF01C2QCJ.29.67.G01.1.454.CMB.1.raw
  modified_base (282)..(282): a, c, t, g, unknown or other
  misc_feature (282)..(282): n is a, c, g, or t
tcagatagagtactcacgaccggtgctcgatttagagtatacatattggggtttgggggagcctacaacaggcaggcagggcagcaacgatggtgttgcgacggacccaggtcttcatttctctgttgctcgtggatctctggtgccgtacggggactatcgtgatggacccagtctccaagacctcccgtggtcctcgtacgtttccgtgggacgaggagggccaaccatcaactggccaagtccgacgccaagtaattattttatatacgcctaccaaanaagtaactaattaacttagtccttcggtaaccagacaacgaaaccgacggaacctacggccctacgtaacgcctaggccttactaactttaacgtcggtactacgtaccgtaacccggggtaacgtcccgggggttaccctacggacccgtagttaccggaggtacggactaacgggtcggttaccggtagggtaccgttaaggtacgttttaacggaacccgttaacgtacccgtaagtttaaccgttacggtactaacggtccccgttaggacccgaaggtcgttaacggaacgtagtaccggtcgtacctacgtttacttaccttcggtactacgtacttaattacgttactacgttacccgtacccgtaacggtcgaacccggacggaacgtaacgggacgtagaacgtaacaaacggtacgtacggtgccgtaggctaccgtagtccg

SEQ ID NO: 155677 - DNA, 717 bp, Homo sapiens
  misc_feature: GYAE6OF01C1N2B.29.67.G01.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagactccctggctgtgttctgggcgagacggccaccatcaactgacaacgtccagccagtaattattttanatagcctacaanaaataagtaattactagcttaggtaccagacaagaaaccaggacacgcctaccgtaagctagcctactatttacgtgggacagttacccgtaacccggggaactccccggggtaccctaggaacccgtattaccgaggtcggacgagggtcgggttcgagggactaaggtacttcactaactcgaagttacttagcacgtccctaggacgtaacggctaaggaacgttagtacgggtacggtaaccctttaatttttaacgtaaccgttcggtaacctaacgtaaccttaaattaacgttttaaaccgtacccttaacccccgggtacccccggggtaacgtttacccggacccggtaaaaccggggtaaccgtaaacgggtcgggaaagggtaaccaaaccgtaaaacccgggaaacttcggggtaacgacgtttaccgaacccttaaaccgccgttaccg

SEQ ID NO: 155678 - DNA, 541 bp, Homo sapiens
  misc_feature: GYAE6OF01DVQD3.29.67.G01.1.454.CMB.1.raw
  modified_base (237)..(237): a, c, t, g, unknown or other
  misc_feature (237)..(237): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccagtcaactgcaagtccagccagaatatttanatagctaccaacaataagaattacttagcttggtaccagcagaaaccaggacagcctctaagctgctcatttactggcagtctaccgggaagtccgggtccctgaccgattcagtggcaggcggtctgggacagtatttcactactcagtattacgcacgcctgcaggctagagagtgtcggcctatttacttactgtcagctaatattaattaaccgtacgtaccccggtacgttccgaccgaacgggaaccgaagggtggagtacgtacgaaaccgtaatacgtggactgacaccgtactcg

SEQ ID NO: 155679 - DNA, 532 bp, Homo sapiens
  misc_feature: GYAE6OF01B8NSY.29.67.G01.1.454.CMB.1.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
  modified_base (501)..(501): a, c, t, g, unknown or other
  misc_feature (501)..(501): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgtttcgtgggcgaggagggccaccatcaactgcaagtccagccagaattattttanatagctacaacaataagaattactagcttggtaccagacagaaaccaggacacgcctacctaagctgctctatttacngggcagtctacccgggagtccgggtacctgaccgattcgagtgcagcggtcgtagggactagtacttcacactacgagtattagcacgtcctgacgaggctagaagtatggtacgctaatttatactgtcagactaattacttatactaccgtccgacgtcgacgacggacgaggtacganagtacgaacgtagngtacgctagcacgntcg

SEQ ID NO: 155680 - DNA, 551 bp, Homo sapiens
  misc_feature: GYAE6OF01C4PJV.29.67.G01.1.454.CMB.1.raw
  modified_base (239)..(239): a, c, t, g, unknown or other
  misc_feature (239)..(239): n is a, c, g, or t
  modified_base (324)..(324): a, c, t, g, unknown or other
  misc_feature (324)..(324): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
  modified_base (517)..(517): a, c, t, g, unknown or other
  misc_feature (517)..(517): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccaagaatattttanatagctacaaacaataaagaattacttagcttggtaaccagacaagaaaccaggacacgcctacctaagctagctctattttacngggcactcgtaaccccggggatccggggtccctggaccgattcagtgcgaggcggtcgtgggacagtactttcgactactacagtattacgcagcctgcaggctagaagntgngaccttattattactgtacagtactaaattnttaatacctacctccccggtagttccgacgaacggacgaggtagagtanaccgaacgtaacgtggtacgtctagccactgtcc

SEQ ID NO: 155681 - DNA, 547 bp, Homo sapiens
  misc_feature: GYAE6OF01A7BLQ.29.67.G01.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (340)..(340): a, c, t, g, unknown or other
  misc_feature (340)..(340): n is a, c, g, or t
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatatttanatagctaccaacaataagtaattactagcttggtaccagcaagaaaccaggacagcctacctaagctgctcatttacnggcatcctaccggatcccgggtccngaccattcagtgcgaggcggtctgggacaggatttcactactnagtattacgcacgcctgcaggctaggaagntggtgacctatttatactgtacagtacaattattactaccgttacccgtcccggtacgttccggaccgtaacgggaccaagggtcggaacgatacgaaacgtaacgtggtacggtacagacctaccgagttccg

SEQ ID NO: 155682 - DNA, 746 bp, Homo sapiens
  misc_feature: GYAE6OF01EJO9G.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttcgtgggcgagagggccaccatcaactgacaagtccagccaagtaattattttatatagcctaccaaacaaataaagtaatttaacttagtcttacggtaccagacaacgaaaccaggacacgcctacctaagctgcctactatttacgtgggactacgttacccgtaacccggggtaacgttccccgggggtaccctacggacccgtattacgaggtcggacgacgggtccgggtcgtacggggaacaaggttactttaccaacgtaccgtacgtaagttaacgttaacggcctaacggtcccgtaggaccgtaacggggtaccttaagggtaaaggtacgttacgggttaccgggtacctttaagtttttaacgtttacgttacgttacgtaacgtaacttaaatttaacgtttaacttaacccgttaccccggtacccccgggttacggttaccgggtaacccgtaaacggggtaaaccgtaacggggtacggaaggtaacgtaaccgaaaacggtaacgtacggttacggacgtaccggacctaccgtgttaccg

SEQ ID NO: 155683 - DNA, 652 bp, Homo sapiens
  misc_feature: GYAE6OF01ER4KU.29.67.G01.1.454.CMB.1.raw
  modified_base (240)..(240): a, c, t, g, unknown or other
  misc_feature (240)..(240): n is a, c, g, or t
  modified_base (326)..(326): a, c, t, g, unknown or other
  misc_feature (326)..(326): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgttgtttcgtgggcgagagggccaccatcaactgcaagtccagccagaattatttanatagcctaccaacaataagtaattacttagtcttaggtaccagacaagaaaccaggacagcctacgtaagctgctactatttacgngggcagtccgtaaccccggggaactcccggggtacctacggaaccgtacgttacgaggttcggacgacgggtcggggtccgtaggggactaggttatttaccgaactacttcgtaagttattaacgcgtaacgtccctaggcgaaggactaggaaagtcgtagggtcgtaccttattttaacgtcttacgtctaagtactaaattacgttacttaccgtacccgtacccggtacgttaccggaccgaaacgggaccgtaacgggtaggaagtaacgtaaccgaaacgtaacgtacgtacggtactaccgtacctaccgacgttccg

SEQ ID NO: 155684 - DNA, 576 bp, Homo sapiens
  misc_feature: GYAE6OF01A6J7D.29.67.G01.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagatagagtactcacgaccggtgctcgatttagagtatacatattgggtttgggggagctacaacaggcaggcaggggcagcaagatggtgttgcagaccccaggtcttcatttctctgttgctctggatctctggtgcctacggggacatcgtgatgacccagtctccagactccctggctgtgttctgggcgagagggccaccatcaactgcaagtccagccagaattattttanatagctccaacaataagaattacttagcttgtaccagacaagaaaccaggacagcctacctaagctgctactatttacngggcatccgtaaccccggggaacgtcccggggtccctggaccgtattccgaggtggcaggcgggtctgggacagtatttcactactcaagtattagcacgcctagcaggctagaagtgtgtacggcctaattttactacgtgtcagtactaattattaactacctaccgtccccggtacgttccggaccgtaaacgggaccgaaggtacggagtagtaaccgaaacgaacgtacggtacgactacgctaccgtatccg

SEQ ID NO: 155685 - DNA, 559 bp, Homo sapiens
  misc_feature: GYAE6OF01DLMSQ.29.67.G01.1.454.CMB.1.raw
  modified_base (312)..(312): a, c, t, g, unknown or other
  misc_feature (312)..(312): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctcagactccctggctgtgtttctgggcgagagggccaccatcaactgcaagtccagccagaaatattttatatagctccaacaataagaattacttagcttggtaccagcaagaaaccaggacagcctctaagctgctcattacnggcatcaccggatccgggtcctgacgattcgagtggcaggcggtctgggacngtattcanactcagtatagcagcctgcgagctagaagatgtcgacctattttatacgtgttacaggtaactaaagttattactaaccgttaacccgtccccgggtaacgttcccggtaacgaaccgggtaaccgtaacgggtaggaagagtaaccgaaaacggttactacggtgtacgtagaccgacctaggtcg

SEQ ID NO: 155686 - DNA, 620 bp, Homo sapiens
  misc_feature: GYAE6OF01EI3RQ.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctccctggctgttgtttctgggcgagagggccaccatcaactgacaagtccagccaagtaattattttatatagcctaccaaacaaataagaatttaacttagcttaggtaccagacaagaaaccaggacacgcctacctaagctgctctatttacgtgggcactaccgtaacccgggaactcccggggtccctaggaccgtattcgaggtggcgaggcgggtcgtggggactaggtactttcactactctagttattagcagcctgcaggctagaagtagtgtacggtacttagttttacttacgtgtactaagtactaattaatttaactaaccttacccgtaccccgggtacgttccggacccggaacgggtaaccgaagggtacggaaggtaactacgaaaccgtaacgtacgggtacgtaccgtagacctacgtagttccg

SEQ ID NO: 155687 - DNA, 538 bp, Homo sapiens
  misc_feature: GYAE6OF01E11MQ.29.67.G01.1.454.CMB.1.raw
  modified_base (251)..(251): a, c, t, g, unknown or other
  misc_feature (251)..(251): n is a, c, g, or t
  modified_base (414)..(414): a, c, t, g, unknown or other
  misc_feature (414)..(414): n is a, c, g, or t
  modified_base (533)..(533): a, c, t, g, unknown or other
  misc_feature (533)..(533): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagagggccaccatcaactgcaagtccagccagaatattttatatagctaccaanaataagaattacttagcttggtaccagcagaaaccaggacagcctcctaagctgctcatttactggcatctaccgggatccgggtcctgaccgtatcgagtggcgaggcgggtctgggacagatttcacactcagttattagcacgcctgcaggctagaagtntgtcggacctatttatctgtacagctaatattatacctaccgtccccggtagttcggaccgaagggtaccgaagggtggtaagacgtacgaaacgtacgtacgtcggactagccacgtntaccg

SEQ ID NO: 155688 - DNA, 589 bp, Homo sapiens
  misc_feature: GYAE6OF01ANVQS.29.67.G01.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
  modified_base (437)..(437): a, c, t, g, unknown or other
  misc_feature (437)..(437): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagtaattattttanatagctaccaacaataagaattacttagcttaggtaccagacagaaaccaggacagcctctaagctgctacatttacgngggcactcgtacccgggtaagtcccggggtcctaggaccgtattcgaggtggcgaggtcgggtctagggactagtacttcactactctagtattagcacgcctgcgaggtctagaagngtggtcgtacctagtttacttactgttacaagtactaagttacttaacttaccgttacccgtaccccggtacgttccgaccggtaacgggaaccgtaagggtggtaagacgtaaccgaaacgacgttagacggactacgaccacgtgttacg

SEQ ID NO: 155689 - DNA, 666 bp, Homo sapiens
  misc_feature: GYAE6OF01BR4NL.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagaggccaccatcaacttcaagtccagccagaattattttatatagctaccaacaataagaattacttagcttggtaccagcaagaaaccaggacagcctcctaagctgctactatttacgtgggctacgtccgtaacccggggtaactcccgggggtcccctacggaacccggtatttccgaaggttcgggaccgtaacgggccggggttacgtacgggggaactaggtacttttccacctaacttaccgtaaggttaacttacggaccaggtccctgaccgaaggcctaggaagtagttggtacggaccttaagttttaactttacgtgttacgaagtactaaattacttaactaccgttacccgtccccgggtacgttaccggacccgtaacgggaaccgtaagggtacggacggtaataccggaaacgaacgtacggtcggtacctcgaccactacgtcgttaccg

SEQ ID NO: 155690 - DNA, 595 bp, Homo sapiens
  misc_feature: GYAE6OF01DTPWH.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgttgtttctgggcgagagggccaccatcaactgcaagtccagccaagaattattttatatagcctaccaaacaaataaagaattacttagtcttgtaccagcaagaaaccaggacagcctactaagctgctctatttacgtgggcatccgtaacccgggaacgtcccggggtaccctcggaccgtagttaccgaggtggcgaggccgggtcgtagggacgaagtactttaccactactacaagttattagcacgccctgcgaggctagaagtagtgtacggtacttatttacttactgtctaagactaattacttattacctaccgtcccggtacgttacggaccgaacgggaacgtaacggtggaagacgtaacgaaaccgtaacgtagtcggactagaccacctgtaccg

SEQ ID NO: 155691 - DNA, 686 bp, Homo sapiens
  misc_feature: GYAE6OF01CN5DY.29.67.G01.1.454.CMB.1.raw
  modified_base (244)..(244): a, c, t, g, unknown or other
  misc_feature (244)..(244): n is a, c, g, or t
  modified_base (346)..(346): a, c, t, g, unknown or other
  misc_feature (346)..(346): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgaccctagtctccagactccctggctgttgttcgtgggcgagacgggccacatcaactgacaacgtccagacagaattattttanatacgctacaaactaaataagtaattacgttacgactttacggaccaagacaacgaaaaccgaggaacacgcctactaagctgacctactacgttttacggnggacctaagtacccgtaacccggggtaacgtcccggggttaccctaggaacccgtagtttacgacggtggaccgcgggtacggtcgtagggaactaggtacttccaacgtactacgtaagttacttacggcacggtctgacacgggtacaggtaagtgtcggtacgtacctttaaatttacgtacgtcgttacgaacgttactaaagttaacttaccgttacccgtaccgttaccccggggaagtccgtaaccgggacggaacggttaaggtcggaagtaacctaacgaaaccggttaccgtagttcccggaacgtagtacccgaacgttaccgttacgg

SEQ ID NO: 155692 - DNA, 511 bp, Homo sapiens
  misc_feature: GYAE6OF01BXE78.29.67.G01.1.454.CMB.1.raw
  modified_base (238)..(238): a, c, t, g, unknown or other
  misc_feature (238)..(238): n is a, c, g, or t
  modified_base (508)..(508): a, c, t, g, unknown or other
  misc_feature (508)..(508): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatcctacccgggaatccggggtcctgaccgattcagtggcagcgggtctgggacagatttcacactcagtattagcagcctgcaggctagaagatgtgcctatttatactgtcagcaattattatactacctcccggacttcggccgacgggaccaggtaggagacgtacgaaacgagtagtggctgcacntcg

SEQ ID NO: 155693 - DNA, 649 bp, Homo sapiens
  misc_feature: GYAE6OF01B9T6W.29.67.G01.1.454.CMB.1.raw
  modified_base (183)..(183): a, c, t, g, unknown or other
  misc_feature (183)..(183): n is a, c, g, or t
  modified_base (195)..(195): a, c, t, g, unknown or other
  misc_feature (195)..(195): n is a, c, g, or t
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (353)..(353): a, c, t, g, unknown or other
  misc_feature (353)..(353): n is a, c, g, or t
  modified_base (538)..(538): a, c, t, g, unknown or other
  misc_feature (538)..(538): n is a, c, g, or t
  modified_base (634)..(634): a, c, t, g, unknown or other
  misc_feature (634)..(634): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctccagacctcccnggctgtgttcgngggcgaggcggccaccatcaactgacaagtccagaccaagtaattattttaanactacgctaaccaaanaaattaagtaatttacgtagtcgttaggtaaccaggaacaacggaaaccaggaacctacgcctaccgagcctagcctactagtttacgnggactacgtacccgaccgggtaaccgtcccgggtacctacgacccgtattccggaggtcggcgtacggtcgggtcgtacgggactaggtaacttccgaactaccgttagaattaacgtcgaccgacgtcccgtaggacgaacggtcaaaggtacgtagtccgtagtaccctagttttactaccgntaaccgagtacgttaaattctaacttaccgtcccggacgtacgtcgaacgtacggaacgtaggaggaacacgtacgaaacgtgtccggtcgacgtnaccacgttgttaccg

SEQ ID NO: 155694 - DNA, 617 bp, Homo sapiens
  misc_feature: GYAE6OF01EM285.29.67.G01.1.454.CMB.1.raw
  modified_base (193)..(193): a, c, t, g, unknown or other
  misc_feature (193)..(193): n is a, c, g, or t
  modified_base (571)..(571): a, c, t, g, unknown or other
  misc_feature (571)..(571): n is a, c, g, or t
  modified_base (588)..(588): a, c, t, g, unknown or other
  misc_feature (588)..(588): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagactccctggctgtgttcgngggcgagacgggccaccatcaactgactaagtccagaccaagtaattattttatatacgactaccaaacaataaagtaactttacttagcttaggtaccagacaacgaaccaggaccagacctacctaagcctagtcctactaactttacgcggctaacgtccggtaacccggacgtcccggggtccacgaccgtatcgaggtcgcgtacggcggtagtaggactagtacttcactactacgtaagttagtacgcacgtcgtagcgtagcgtagaagtagtcgtacgtacttatttactacgtgactagtactaagttataccttaccgtaccgtcccggtacgtacggaccgtaaacggaaccgtaaggtcggtaanaacgtacgaaacgtacncggttacgagttaccgactaacgcgttcg

SEQ ID NO: 155695 - DNA, 130 bp, Homo sapiens; identical to SEQ ID NO: 155561
  misc_feature: GYAE6OF01E0T4A.29.67.G01.1.454.CMB.1.raw
  modified_base (130)..(130): a, c, t, g, unknown or other
  misc_feature (130)..(130): n is a, c, g, or t

SEQ ID NO: 155696 - DNA, 533 bp, Homo sapiens
  misc_feature: GYAE6OF01AT37N.29.67.G01.1.454.CMB.1.raw
  modified_base (238)..(238): a, c, t, g, unknown or other
  misc_feature (238)..(238): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctacctaagctagctcatttactgggcagtcgtacccgggaatccgggtccctgaccgattcgagtggcacgcgggtctgggacagtacttcacactcagtattagcagcctgcaggctgaagtgtgtacggcctatttactacgtgtcagtataagttattaactactaccgtccccggtacgttcggaccgaacgggacaagggtcgagatacgaacgtagtgtacgtcagccncntcg

SEQ ID NO: 155697 - DNA, 773 bp, Homo sapiens
  misc_feature: GYAE6OF01D90HT.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcattttctctgttgctctggatctctggtgccgtacgggacatcgtgatgacccagtctccagactccctggctgttgttcgtgggcgagacgggccaaccataccaactgacaaacgtccagccaaagtaattaatttttaataatacgaccttaaccaaactaaaagtaaagtaaactttaacgttaagtctttaggaaccagacaagaaaccgagacagcctacctaagctcgactactattttacgagggactacgtaccgtaaccccggggtaacgttcccggggtccctacggaacccgtagttaccggtaggtcggaccgacggtccggggttacgtacggggtactaaggttactttaccgaacgtactacgtaagtttaattaccggaccgtacgtaccgtcgacgtacgggtacgtaagggaacgtacgtgtacggaccctttaaagtttttacggtatacggttaccgtaaacgaccgttaaaatttactttaacccgtaacccgttaacccgttaccccgggtaacgtttaccgggaacccggttaaacggggaaccgtaacggggtaacggtaagggaacttaaaaccggtaaaccgtaaacgtcgggttacggtacccttaaccgggccttaaccccggtatttacccg

SEQ ID NO: 155698 - DNA, 517 bp, Homo sapiens
  misc_feature: GYAE6OF01B625R.29.67.G01.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgaggagggccaccatcaactgcaagtccagccagaatattttanatagctaccaacaaataaggattacttagcttggtaccagcagaaaccaggacagcctcctaagctgctcatttacnggcatctacccgggaagtcccggggtccctgaccgattcgagtggcaggcggtctgggacaggtatttcacactccagttattagcagcctgcaggctagaagatgagcctatttatctgcagctaattattatactactcccggacgttcgccgaaggaccgtaggtgagatacaaacgaactgtgactgacncgntccg

SEQ ID NO: 155699 - DNA, 619 bp, Homo sapiens
  misc_feature: GYAE6OF01B7OEX.29.67.G01.1.454.CMB.1.raw
  modified_base (236)..(236): a, c, t, g, unknown or other
  misc_feature (236)..(236): n is a, c, g, or t
  modified_base (316)..(316): a, c, t, g, unknown or other
  misc_feature (316)..(316): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagaggccaccatcaactgcaagtccagccagaattatttanatagctacaacaataagtaattactagcttagtaccagacaagaaaccaggacagcctacctaagctgctctaatttacngggacatccgtaacccgggtaatcccgggtcctaggacccgtattcgaggtcggacaggtacggtctacggggactaggtatttccgaacactacaggttaattacgctacgcccgttagcgaagggcctaagggaagtaacgtggtacgtaccttaagttttacttacgtgtaactagtactaaagtttacttaacgtaccttaaccgtaccccggacgttccggaccgtaaacgggacgtacgaaggtacgggaagtacgaaaccgaacggtaacgtaggtcgtagtcgcgtaaccgtacg

SEQ ID NO: 155700 - DNA, 591 bp, Homo sapiens
  misc_feature: GYAE6OF01ECRSG.29.67.G01.1.454.CMB.1.raw
  modified_base (320)..(320): a, c, t, g, unknown or other
  misc_feature (320)..(320): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgagagggccaccatcaactgacaagtccagccaagaattattttatatagctaccaacaataagaatttacttagcttggtaccagcaagaaaccaggacagcctctaagctgctctatttcgnggcatccgtaacccgggatccgggtcctagaccgtattcgagtggcgacggcgggtctagggactagtactttcacgtactcagttatagcagtcctgcaggctagaagagtgtgaccttagtttactctgtcagtactaattattactacctaccgtacccggtacgttaccggaccggtaaacgggtaccgtaaacgggtcgggtaagtaacgtaccgaaaaacgtaccgttacggtacggtaccgttacggacctaccgtattaccgg

SEQ ID NO: 155701 - DNA, 617 bp, Homo sapiens
  misc_feature: GYAE6OF01B87U7.29.67.G01.1.454.CMB.1.raw
  modified_base (612)..(612): a, c, t, g, unknown or other
  misc_feature (612)..(612): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgaggagggcccaccatcaactgcaagtccagccagaattattttatatagcctaccaacaaataagaattacttagcttggtaccagacaacgaaaccaggacacgcctccgtaagctgctctatttacgtgggcattaccgtaacccgggtaacgtcccggggtcctaggaccgattcgaggtcgcacggcggtcgtgggactagtactttcactacgtcagttatagcacgtccctaggccgaggcgtagaagtgtaggtcgtacttatttacgttactgtacgatacgtaaattacttaacttacgttacccgtaccccggttaaccggttcggaacccggtaaacgggaacccggtaaggtcggtaagtacgtaaccgaaacgtaacgtcgtacggtacgacgcctaccgtntaccg

SEQ ID NO: 155702 - DNA, 773 bp, Homo sapiens
  misc_feature: GYAE6OF01B8D0J.29.67.G01.1.454.CMB.1.raw
  modified_base (345)..(345): a, c, t, g, unknown or other
  misc_feature (345)..(345): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacgggacatcgtgatgacccagtctccagactccctggctgtgtttcgtgggcgaggacggccaccatacaactgacaacgtccagaccaagtaattattttaataatacgcctaaccaaactaaataaagtaatttaacttagtcttacggtaccagacaacgaaaccaggacacgcctacctaagctgctactatttacgnggactactccgtaaccgggacgtcccgggtacctcgaccgtacttcgagtggacacggcggtcgtacgggactagtactttacaactactacgtagttagttaacgcgtaacgtcccgtagaccgaacgggtcctaagggaaacgtggttacgggtaccggtaaccctttaaagtttttaacgtttaccgttacggttaaccgaacggtaacttaaaatttaactttaaaccgtttaaaccccggttaacccccggttaccccccggggttaacgggtttaccccgggtaaaccggtaaaaccggggtaaacccgggtaaacggggttacgggaaacggtaaaccgttaaaaccgggaaaaaccgtttaaccggttacgggttaaccggtaccgttaaccggaacccaacccgttaacgtttacccgg

SEQ ID NO: 155703 - DNA, 764 bp, Homo sapiens
  misc_feature: GYAE6OF01EDNZJ.29.67.G01.1.454.CMB.1.raw
  modified_base (323)..(323): a, c, t, g, unknown or other
  misc_feature (323)..(323): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgacaagtccagccagaattattttatatagcctaccaaacaataaagaattacttagcttaggtaccagacaagaaaccaggacacgcctacaagctgctacatttacgnggctactcgtaccccgggaagtcccggggtcctagaccgacttcgagtggcgaggtcgggtctacggggactaggtactttcgaacctactacgtaagttacgttaacgcgtaacgcccgtaggtacgacgggtaccgttaaggaaagtacgttacgggttacggtaaccctttaaggttttttaaccttaaccgtttacggttaacccgtaaggtaaaccttaaacgtttaacgttttaaacccttaacccgtttaacccccgggtaccccccggggtttaaccggtttaaccgggtacccccgggtaaaacgggggtaaaccccgggttaaacggggtaaacggggtaaacggtaaccgttaaaaccggaaaacccggtaaacggttaacgggtccgggtaacggttaccggaacccttaccccgtaacgtttaccccg

SEQ ID NO: 155704 - DNA, 670 bp, Homo sapiens
  misc_feature: GYAE6OF01B3FH8.29.67.G01.1.454.CMB.1.raw
  modified_base (198)..(198): a, c, t, g, unknown or other
  misc_feature (198)..(198): n is a, c, g, or t
  modified_base (656)..(656): a, c, t, g, unknown or other
  misc_feature (656)..(656): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacatcgtgatcgacccagtcctccagacctcccgtggcttgtgttcgngggcgaggaggtcacatcaactgacaacgtccagaccaagtaattatttaatatacgtacctaaccaaacgtaaattaaacgtaatttacttaggtcttacggtaaccagaccaagaaaccgagacctacgacctactaacgctacgtcttaccgtaagtttaccgtggacctacgtccggtaaacccgggacgttcccgggtaccacggaccgtagttcgaggtcgacgcggcgggttcagggactagtacttaccgatacctacgtaagttaacgtacgacgtacgtcgtacggacgtaacggtacgtaagaagtagtggtacggtaccttatttacgtactgtactactacgttaattacgttaactaccgtacccgtacccggtacgtaccggtaccgaacgggtaccgaaggtacgagtaacgtaacgaacgtaacgttacgacggttacganaccgacgtacgtcg

SEQ ID NO: 155705 - DNA, 238 bp, Homo sapiens
  misc_feature: GYAE6OF01C5ZOU.29.67.G01.1.454.CMB.1.raw
  modified_base (134)..(134): a, c, t, g, unknown or other
  misc_feature (134)..(134): n is a, c, g, or t
  modified_base (146)..(147): a, c, t, g, unknown or other
  misc_feature (146)..(147): n is a, c, g, or t
  modified_base (149)..(149): a, c, t, g, unknown or other
  misc_feature (149)..(149): n is a, c, g, or t
  modified_base (151)..(151): a, c, t, g, unknown or other
  misc_feature (151)..(151): n is a, c, g, or t
  modified_base (153)..(238): a, c, t, g, unknown or other
  misc_feature (153)..(238): n is a, c, g, or t
tcagatagagtactcacgaccggtgctcgatttagagtatacatagttggggtttggggcacagcggccctgggctgcctggtcaaggactacttccagtactctatcgtgagcggggcctgggccaagggccncctattaaggcnngnangnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 155706 - DNA, 649 bp, Homo sapiens
  misc_feature: GYAE6OF01D935W.29.67.G01.1.454.CMB.1.raw
  modified_base (616)..(616): a, c, t, g, unknown or other
  misc_feature (616)..(616): n is a, c, g, or t
tcagatagagtactcacgaccggtgctcgatttagagtatacatagttgggtttgggggagctacaacaggcaggcaggggcagcaagatggtgttgcagacccaggtcttcatttctctgttgctctggatctctggtcgccgtacggggacatcgtgatcgacccagtctccagacctccctggctgttgttcgtgggcgaggacggccacatacaacttcaacgtccagcaagtaattattttatactacgaccttaccaaataaattaaagtaatttacgttagtcgtttacggtaaccagacaaacgaaaccagggacaccgtaccctaccgtaagcttacgctacgtaacgtttacgagggtacctacgtacccggtaacccgggtaacgttccccggggtacctacggtaacccgtattaccgaggtcggacgacgggtcgggtacgtcgggactagtacttcacgtactcgagttactgacgacgtctggacgacggtacgtaaggacgtagttcggtacgtaccttaagtttacgtctgtacagtaactatacgttactaccgtaccgtacccgtacgttcggaccgtacggacgaggtagtacganaacaacgtacgtgcgtacgacacacctgtctcg

SEQ ID NO: 155707 - DNA, 642 bp, Homo sapiens
  misc_feature: GYAE6OF01EQ71O.29.67.G01.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
tcagatagagtactcacgaccggtgctcgatttagagtatacatattggggtttgggggagctacaacaggcaggcaggggcagcaagatggtgttgcagaccccaggtcttcatttctctgttgctctggatctctggtgcctacggggacatcgtgatgacccagtcctccagacctccctggctgttgttcgngggcgagacgggccaccatcaactgcaagtccagccaagtaattatttatatagcctacaaacaataaagtaattaacttagcttcggtaaccagacaagaaaccnggacacgcctacgtaagctgcctactagttttacgngggacattcccgaacccggggtaatccccggggttccacgaccgtatcggagtcggcacggtcgggtctagggactaggtactttccactactcaagttactagcagcctcgactaggactaggagtatgtcggtaccttatttaccgttattcgtcgaacgtactaaattaactttaccttaacccgttacccgtacccccggtaaggttcccggtaacggaaccgggaaccgtaaacgggtcggagttaacgacgtaaaccgaacgtacgtaagggtccttaacggccacggtacgttcccg

SEQ ID NO: 155708 - DNA, 685 bp, Homo sapiens
  misc_feature: GYAE6OF01D228Z.29.67.G01.1.454.CMB.1.raw
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgtttctgggcgagacgggccaccatcaactgacaagtccagccagtaattattttanatagctaccaaacaataagaattacttagcttggtaccagacaagaaaccnggacacgcctctaagctgctctagttcgtggactacgtaccgtaacccgggacgttcccggggtcctaggaccgtattcgaggtcggacacgggtcggtcgtcgggactagtactttacgacgtactactaagttacttacgctacgtcctaggaccgtagggtctaggaaggtacgttcgggtacgtaccctttaagttttacgttacgtcgttacgaacggtacttaaacgtttaactttaaacgttaacccggtttaaccccggttaccccggggttaaccgtttaccgggaacccggtaaaccggggaaacccgtaaggggtacggtaacgtaacgtaaccggaaaacgtaacgtggtacggtacgtacgtacctacgtagttcccg

SEQ ID NO: 155709 - DNA, 608 bp, Homo sapiens
  misc_feature: GYAE6OF01EWLL8.29.67.G01.1.454.CMB.1.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (316)..(316): a, c, t, g, unknown or other
  misc_feature (316)..(316): n is a, c, g, or t
  modified_base (602)..(602): a, c, t, g, unknown or other
  misc_feature (602)..(602): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagagggccaccatcaactgcaagtccagccagaatatttanatanctccaacaataagaattacttagcttggtaccagacaagaaaccaggacagcctacctaagctgctcactttacngggcatccgtacccgggaatcccggggtcctgaccgtattcgagtcggcgagcgggtctacggggactaaggtctttacaactacgttacaaggttaacttacggctaacgtccctaggccgtaaggacctaggtaacgtagtcgtacgggacctttaatttacgtacctggttacaacgtactaaattactacttacctacccgtacccggttagtaccggaccgtaacgggacgtaaggtcggaacgataaccgaaacgtagtacggtcgacgtatacctacgngttacg

SEQ ID NO: 155710 - DNA, 727 bp, Homo sapiens
  misc_feature: GYAE6OF01CJLQ4.29.67.G01.1.454.CMB.1.raw
  modified_base (247)..(247): a, c, t, g, unknown or other
  misc_feature (247)..(247): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacatcgtgatgacccagtctccagacctccctggctgttgttcgtgggcgaggacggccaccatcaactgacaagtccagccaagtaattattttanatacgctaaccaaacaaattaaagtaactttaacgtttagcgtttacggtaaccagacaaacgaaaccaggaacacgcctactaacgctacgctactaatttaccgtggactacgtaccgtaccgggaacgttcccgggtccacgtaccgtagttacgacgttggcgtacgggtcgggtacgtacgggaactaggtactttacgactacgtacgtaagtacttacggcgacgtccgtgacgaacgggtcgtaaggaacgtagttacggtacggttacctttaagtttaacttaccggttacgtacgtaacgtaacgttaaactttaacgtttaacctaaaccgtttacccggtaccccggttaaggttccccgggaacggtaaaccgggtaaccggtaacggggtaacggtaacgtaacgtaaaccggaaaccgtacggttacggtacggtaccgtaccggactaacccgtcgttacccg

SEQ ID NO: 155711 - DNA, 702 bp, Homo sapiens
  misc_feature: GYAE6OF01DYOD3.29.67.G01.1.454.CMB.1.raw
  modified_base (193)..(193): a, c, t, g, unknown or other
  misc_feature (193)..(193): n is a, c, g, or t
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagcctccctggctgtgttcgngggcgagacggccacatcaactgacaacgtccagaccaagtaattatttanatacgctacaanaataagtaattactagtacttacggtaaccagacaacgaaaccgaggacacgcctactaacgctcgtctactacgtttacgcgggactacgttaccggtaaccccggggaacgttcccgggggtaccctacggaacccgttagttaccggaggtacgggaccgtacggggtcgggttacggtagggactaggttacttaccgacgtactacgaagtttaactacggctacggtccgtaggacgtaggaccgtaaggaagtcgtacgggtcgtacctttaagtttacgtacgtacgtaacaacgtactaagttaactttaacctaccgttacccgtacccgggtacgttaccggaccgtaaaccggggaaccgtaacgggtacggaagacgtaaacgaaaccggtaacgtaccggtacggtacctaacgaaccgtccgtacgtcccg

SEQ ID NO: 155712 - DNA, 132 bp, Homo sapiens; identical to SEQ ID NO: 155630
  misc_feature: GYAE6OF01C7JZR.29.67.G01.1.454.CMB.1.raw
  modified_base (130)..(132): a, c, t, g, unknown or other
  misc_feature (130)..(132): n is a, c, g, or t

SEQ ID NO: 155713 - DNA, 572 bp, Homo sapiens
  misc_feature: GYAE6OF01DRHN5.29.67.G01.1.454.CMB.1.raw
  modified_base (239)..(239): a, c, t, g, unknown or other
  misc_feature (239)..(239): n is a, c, g, or t
  modified_base (414)..(414): a, c, t, g, unknown or other
  misc_feature (414)..(414): n is a, c, g, or t
  modified_base (559)..(559): a, c, t, g, unknown or other
  misc_feature (559)..(559): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctggcgaggacggccaccatcaatgcaagtccagccagtaattatttanatagctaccaacaataagaattacttagcttagtaccagacaagaaaccgagacacgcctacctaagctgctactatttacgtggactagtaccgtacccgggacgtcccggggtaccctggaccgtatacgaggtcgcgtaggtcgggtcgtagggactagtacgttcacactnagtagtagcagtctgacaggtctagatagtgtacgtacttaatttactactgactagtactaattagttactactacccgtcccggtactcggacgaacggaacgtacggtacgtaagacgtaacgaaagtactaggtcacgtancggtactcgttcg

SEQ ID NO: 155714 - DNA, 510 bp, Homo sapiens
  misc_feature: GYAE6OF01EPI2S.29.67.G01.1.454.CMB.1.raw
  modified_base (238)..(238): a, c, t, g, unknown or other
  misc_feature (238)..(238): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagacttggtaccagcaagaaaccaggaacagcctcctaagcagctcatttactgggcatacacccgggaatccgggtccctgaccgattcagtgcagcggtntggacagatttcacactcagttattagcagcctgcngctagaanatgnggctatttatactgtcagcaatattatactactacccggagtcggccaagggaccaaggtcggagacgtcaaacgaacagtacgcagcacgatacg

SEQ ID NO: 155715 - DNA, 775 bp, Homo sapiens
  misc_feature: GYAE6OF01CHATV.29.67.G01.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctccagcctcccgnggcttgtgtttcgngggcgaggacggccaaccataccaactgaccaagtccagaccaagtaatttattttanatacgcctaccaaacaaataagtaaattacttagtcgtttacggtaaccagacaacgaaaccgagaaccacgccctactaagccgtacgcttactaacgttttacggacggacctacggtttaccccggtaacccggggtaaccggtccccgggggttacccctaggtaaaccccgttaacggtttcgaacgggttcggaccgaacgggtccggggttacttacggggaaaccttacgttaacgttccgaacgtaccgtacgtaagttacgttacgcgtaacgtccgtcggacgtacggtcgtaagaagtagtacggtcggtaacttaagtttttactagtacgtaccgaagtaacgttaaactttaacgttaaacgtaccccgttaacccggtaccccggggtaaccgttccgggtaaccggtaaacgggtaaccggtaaacggtacggggtaacgtaacgtaaccgtaaaaccggtacgttagggtccggttaccaccggacctaacgtcgttaccgg

SEQ ID NO: 155716 - DNA, 513 bp, Homo sapiens
  misc_feature: GYAE6OF01AV4Y8.29.67.G01.1.454.CMB.1.raw
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagagggccaccatcaactgcaagtccagccagaatattttatatagctaccaacaataagaattacttagcttggtaccagcagaaaccaggacagcctctaagctgctcatttacnggcatcgtacccgggaatccgggtcctgaccattcagtgcaggcggtntgggacagtntttcacactcagtatagcagcctgcaggtctagaagagtgtcggcctatttatactgtcagctaattatactactacctcccggtacgttcgccgtaacggacgaaggtgagactacaaacgtactgtcgcancnctntcg

SEQ ID NO: 155717 - DNA, 600 bp, Homo sapiens
  misc_feature: GYAE6OF01DVT82.29.67.G01.1.454.CMB.1.raw
  modified_base (201)..(201): a, c, t, g, unknown or other
  misc_feature (201)..(201): n is a, c, g, or t
  modified_base (336)..(336): a, c, t, g, unknown or other
  misc_feature (336)..(336): n is a, c, g, or t
  modified_base (588)..(588): a, c, t, g, unknown or other
  misc_feature (588)..(588): n is a, c, g, or t
  modified_base (596)..(596): a, c, t, g, unknown or other
  misc_feature (596)..(596): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgaggngggccaccatcaactgacaagtccagccaagtaattattttatatagcctaccaaacaaataagtaatttacttagtctttaggtaccagacaagaaaccaggacacgcctacctaagctgcctactatttacgngggtcagtaccgtaacccgggaacgtcccggggtcctcggaccgtacttacgacggtcggcgagggtccgggtcgtggggactaggtactttcactactactaagttatagcacgtcctgacagcgtagaagtgtggtgtaccttatttacttacgtgtctagacttaattacttaactaccgttaccgtccccggtacgtccggaccgaacggacgtaaggtcggagatacgaaacgtagtacggtcgacncgactcgnttcg

SEQ ID NO: 155718 - DNA, 761 bp, Homo sapiens
  misc_feature: GYAE6OF01CELYM.29.67.G01.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagactcccgtggcttgttgtttcgngggcgaggacgggcccaaccgataccaactgactaacgtccagccaagtaattattttanatacgcctaccaaactaaagtaagtaaacttaacttagtacgtttacggtaaccagtaccgaacggaaaaccccgagggaaccacgtaccctaccgtaagcctgaccttacgtaattttaccggcgggtacctaacgttacccggtaaccccgggtaacgttccccgggtaccctaggaacccgttatcgaggtcggaccgtacgggtccgggtacgtacgggaactaaggtttacctttacccgaacgtaccgttacgtaaggttaacgttacgaccgtacggtcccgttacggacggtaacggtccgttaaggaaaggttacgtcggtaccggttacctttaagtttacttactacggtctaaggtaactaactttacgttaacttacccgttaccccggtacccggtaaccggtaccggtaccggaaacgggaaccgtaagggtaggacgtaacgtaaccgaaagtacgtggtaccgtacgtacgacctaccgtgttaccg

SEQ ID NO: 155719 - DNA, 714 bp, Homo sapiens
  misc_feature: GYAE6OF01DOF9Z.29.67.G01.1.454.CMB.1.raw
  modified_base (246)..(246): a, c, t, g, unknown or other
  misc_feature (246)..(246): n is a, c, g, or t
  modified_base (332)..(332): a, c, t, g, unknown or other
  misc_feature (332)..(332): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgttgtttcgtgggcgaggacgggccaccatcaactgcaacgtccagccaagtaattattttanatagcctaccaaactaataagaattacttagcttaggaccagacaagaaaccaggacacgcctacctaagctgctactagtttacngggcaacgtccgtaaccccgggaacgtcccggggtcctacggaccgtattcgacggttggaccgagggtccggggttacgtacggggaacctaaggtaactttccgaactacgtactaaggttaacttacgacgaacgtccccgttagaccggaaggtccgtagaaaggtacggttcggtacggtacctttaagtttttaacgttaccgttaggttacctaaggtaacctaaagtttaactttacgtaacccgttaccccgtaccccgggttaccgttacccgggtaaccgtaaacggggtaacccggaaacggtaagggtaacgtaacgtaaaccgaaaccgtaacggtaggtacgtacgtacgacctacctacgttaccg

SEQ ID NO: 155720 - DNA, 689 bp, Homo sapiens
  misc_feature: GYAE6OF01C7SH2.29.67.G01.1.454.CMB.1.raw
  modified_base (244)..(244): a, c, t, g, unknown or other
  misc_feature (244)..(244): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctcagactccctggctgttgtttcgtgggcgagacggccaccatcaactgcaagtccagccaagtaattattttanatagctacaaactaataaagtaattacttagtcgtttaggaaccagacaacgaaaccgaggacacgtacctactaagctgactactagtttacgtggctacgtcccgtaaccgggacggtcccgggtaccacggtacccgatttacgaggtcggcgaggtccggggtcagggtacagtactttacacgtactacgtaacgttattacgacacgtcccgtaggacctaaggcgtaaggaagtcgtcggtacgtacctttaagtttacgttacgtcgtaacagtaacttaaagtttacttaacgttaccccgttaaccccggttaccccgggttaaccgtacccgggaaccgtaaaccggggtaaccgtaaaggggtaccggaagtaacctaaaaccgggtaaaccgtaacggttacggtacgggactaccgaccacccgttattcg

SEQ ID NO: 155721 - DNA, 592 bp, Homo sapiens
  misc_feature: GYAE6OF01AN48Q.29.67.G01.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgttgtttctgggcgagagggccaccatcaactgcaagtccagccagaatattttanatagctaccaacaataagaattacttagcttggtaccagcagaaaccaggacagcctacctaagctgctcatttacngggcatccgtacccgggaatcccggggtcctggacccgtattccaggtggcgaggcgggtctcgggacagtactttccactactctagtacttagctacgccgtagcagggtctaggaagtagttcggtacggaccttaattttataccgtgtacagactaattattactacctacccgtccccggacgttccggacccgaacgggtaccgaacgggtggaaggtactaaccgaaaccgtaacgtacggtacggtcgtacgactacccgtattccg

SEQ ID NO: 155722 - DNA, 484 bp, Homo sapiens
  misc_feature: GYAE6OF01CBOHD.29.67.G01.1.454.CMB.1.raw
  modified_base (238)..(238): a, c, t, g, unknown or other
  misc_feature (238)..(238): n is a, c, g, or t
  modified_base (415)..(415): a, c, t, g, unknown or other
  misc_feature (415)..(415): n is a, c, g, or t
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
  modified_base (467)..(468): a, c, t, g, unknown or other
  misc_feature (467)..(468): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (477)..(479): a, c, t, g, unknown or other
  misc_feature (477)..(479): n is a, c, g, or t
  modified_base (482)..(482): a, c, t, g, unknown or other
  misc_feature (482)..(482): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcattttaactgggcatcctacccgggaatccggggtcctcgaccgattcagtggcagcggtctgggacagatttcacactcagtattagcagcctgcaggctgaagatgnggcattatactgtcagcaatatatactacncccgatcgcaggacagngagannanaangngnnncgntc

SEQ ID NO: 155723 - DNA, 681 bp, Homo sapiens
  misc_feature: GYAE6OF01ECLN2.29.67.G01.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (328)..(328): a, c, t, g, unknown or other
  misc_feature (328)..(328): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgagacgggccaccatcaactgacaagtccgagccaagaattattttanatagctaccaanaataagtaattacttagcttggtaaccagacaagaaaccaggacacgcctactaagctgctactatttacgnggctacgtacgtaacccggggaatcccgggtcctacgaccgtattcgaggtggcgtacgggcgggtctacggggactaggtactttcgacctacttcgtaagttattacgactacgtccccgttggaccgagggtaccgtaggtaaagtacgtggtacggtaccttaaagtttttacgtacgttaggtacctaagtacctaaatttactttaaaccttacccgttacccgtacccccgggtaggttacccggtaaccggaaaccgggtaacgtaacggggtacggtaacggaacgtaaccgaaaacgtaacggttacggtacggacgttaaccgaccgtaaccgtcgttaccg

SEQ ID NO: 155724 - DNA, 782 bp, Homo sapiens
  misc_feature: GYAE6OF01EZU9P.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagacctccctggctgtgtttcgtgggcgaggacgggccaccatcaactgacagtccagccaagtaattattttatatacgctaccaaacaaataagtaaattacttagtctttaggtaaccagacaacggaaaccgaggtaccacgtaccctacccgtaagcctaggtccttactaacgtttttacgtcggggtacctaacgttacccggtaaccccgggggtaacggttccccgggggttacccctacggtaaccgtactttacggaagggttccgggacgtacggggtccggggttacggtacgggggtaacctacggttactttaccgaaccgttaccttacggtaagtttaacgttacgacgtacgtacccgtaggtaccgtaagggtacctagggtaaacgtagttcggtacggtaccctttaagttttacgtttaccgtgttaccgaactaacttaaagtttaacctttaacgttaaccccggttacccggtaccccgggtaccgttacccgggaaccggttaaaccgggaaccggttaagggtaacggtaacgtaacgtaacggaaacggtaggttcggtacgactacggccctacgtgttacg

SEQ ID NO: 155725 - DNA, 654 bp, Homo sapiens
  misc_feature: GYAE6OF01EXY4R.29.67.G01.1.454.CMB.1.raw
  modified_base (252)..(252): a, c, t, g, unknown or other
  misc_feature (252)..(252): n is a, c, g, or t
  modified_base (353)..(353): a, c, t, g, unknown or other
  misc_feature (353)..(353): n is a, c, g, or t
tcagatagagtactcacgaccggtgctcgatttagagtatacatattgggtttgggggagctacaacaggcaggcagggggcagcaagatggtgttgcagacccaggtcttcatttctctgttgctctggatctctggtgccgtacggggacatcgtgatgacccagtctccagacctcccgtggcttggttgttcgtgggcgaggacggccaacatacaactgacctaagtccagccaagtaattatttanatacgactaccaaataataagtaattacttagcttaggtaaccagtaacaacgaaaccgaggaactacgacctaccgtaagcctagcttactagtttacgnggtacacgttaccggaaccgggtacgtcccgggtcctacggtacgtactcgacgtggacgacggtcggtacgtagggactaacgttcttacactactacgtagttaacgtacgcgaacgtccgtagacgtacggtctaaggtagtcgtagtacgttaccttaagtttactaccgtataccgataacgtaattacgttaacctcgtacccgtaccggtacgtacggtacgaggtaccgtacgggaagtacggaagtaactaacggaaacgtaccgtacggttagaaccggtcgaccaagtac

SEQ ID NO: 155726 - DNA, 686 bp, Homo sapiens
  misc_feature: GYAE6OF01DY06H.29.67.G01.1.454.CMB.1.raw
  modified_base (581)..(581): a, c, t, g, unknown or other
  misc_feature (581)..(581): n is a, c, g, or t
  modified_base (676)..(676): a, c, t, g, unknown or other
  misc_feature (676)..(676): n is a, c, g, or t
tcagatagagtactcacgaccggtgctcgatttagagtatacatattggggtttgggggagctacaacaggcaggcaggggcagcaagatggtgttgcagacccaggtcttctatttctctgttgctctggatctctggtgccgtacggggacatcgtgactcgacctagtcctcagcctcccgtggctgttgttcgtgggcgagcggccacatcaatgacaacgtccagaccaagtaattatttatatacgtcctaaccaaagtaataagtaaacttaccgtagtcttacggaacgacgtacgaaacgaaccgaggaccacgtccttaccgtaagcttacgtcctacgttaaccgtttacgcggtacctacgttaaccccgggtaaccccggggtaaccggtccccggggttacccacggtaacccgttattacggacggttcggacggtacgggtccgggtaaggtaccgggtaacgtatacccgtttaacacgttaaccgtacgtaacgttactacgactcggactgacggtacggactaggacgtagtcgtacgttacctagtttaactcgttcganaacgtactaagttactacgtacccgttaccgccggttacgcggacggacgacgaaggtctaagacctaaggaaccgtgtacgtcgtacacgtacncctggttacg

SEQ ID NO: 155727 - DNA, 808 bp, Homo sapiens
  misc_feature: GYAE6OF01BRHFA.29.67.G01.1.454.CMB.1.raw
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctccctggctgttgttctgggcgagaggccaccatcaactgacaagtccagccaagaattattttanatacgcctaccaacaataaagtaattactagcttaggaccagacaagaaccaggacagccctactagctgctctatttacgnggcacgtaccgtacccgggacgtcccgggtcctcgaccgtattcgaggtcggcgacggtcggtcgtacgggaactacggtactttacgaacctacgttacgaaggtttacttacgacgtaacgtcccgtagggaccgtaacgggtaccgttaacgggaaggtacgtttacggggtaccggttaacctttaaacgttttttaacgttacccgtttacggtaacccgttaacggtaaaccgtttaaacgtttaacgtttaaacccgttaaacccggtttacccccggttaccccccggggttaaccgggttaccccgggtaaaccccgggttaaaccgggggtaaaccccgggttaaacgggggttaccggggttaaacggtaaaccggttaaaaccccggttaaaaccgggttaaaccggttacggggttaaccgggttcccggtaaaccggttaccccgtaaacccgttaaccggtttaccccgg

SEQ ID NO: 155728 - DNA, 674 bp, Homo sapiens
  misc_feature: GYAE6OF01B9AQA.29.67.G01.1.454.CMB.1.raw
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgaggngggccacatcaactgacaagtccagccaagaattattttanatagcctaccaaacaataagtaattactagtcttaggtaccagcaacgaaaccgaggaacacgaccctacgtaagctacgctactaatttacgtgggacctaacgttcccggtaacccggggtaaccgttcccggggtccctacggtaacccgtattccggaggtcgggccgagggtccgggtcgtaggggaactaggttactttaccgaactacgtacgtaagttacgttagccgacggtcctgacgtacgggtactaggaagtgtacggtcggtaccttaagttttacgttacgtcgtaccgaagtacttaagtttaacttaccgtaacccgtacccgttacccggtacggttacccggaacggtaaccgggaacgtacgggtacggaagtacgtaccgaaacgtagtggtacgtctacgactacgtactcg

SEQ ID NO: 155729 - DNA, 857 bp, Homo sapiens
  misc_feature: GYAE6OF01ATI47.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtctccagacctccctggcttgttgttcgtgggcgaggacgggccaccatcaactgcaacgtccagaccaagtaactttattttactatagacctaccaaactaaaataaagttaactttaactttagtacgtttacgggtaaccacggtaccaaacggtaaaaccccgaaggtaaccgaccggtaccccttaccgttaaaacgtccgttacggtccctacgttaacgttttaaccggtcggggtaccctaacggttaccccggtaaaaccccgggggtaaccggttcccccgggggtacccgttaccggaaccccggttaactttacggaacggttgggacccgtaagggtcccggggttacggtacggggtaacctacggttaacttttaccaaccgtaccgttacgtaacgtttaacgttacggtaccgtaccggtacccgttacgacggaacgtcgtaaggtaacggtacgttacggtacgggtaccctttaagtttttacctacgttacgtaacgtacgtaacgttaaattaacgtttaaccgttacccgttaaccccgtaccccgggttaccggttaaccggtaccggaaaccgggtaaccggtaacggtacggtaacggtacgtaaacccggtaaaaccggtaacgttacgggtaccggacgtaccgacccgtacgtccttaccg

SEQ ID NO: 155730 - DNA, 651 bp, Homo sapiens
  misc_feature: GYAE6OF01DYGMH.29.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtgcctacggggacatcgtgatgacccagtctccagactccctggctgtgttctgggcgagagggccaccatcaactgcaagtccagccagaattatttanatgctacaacaataagaattactagcttggtaccagacaagaaaccaggacagcctactaagctgctctattacnggacagtccgtaccgggaactcccgggtaccctgaccgtattcgacgtcggacgacggcgggtcgaggggactaggtaactttaccgaacgtacctacgtaaggttaacttacggctaacgtccctggaccgtagggtcctaagggaaagtacggtggtaccggtaccctttaattttaacgttaaccgttcgtacgtagtacctaaatttacttaacttacccgttacccgtacccggtacgttaccgtaccggaacgggtaaccgaacgggtacggtaagaacgtaaccgaaaacggtacgtacggtacggtactacggccgtaaccgtgttaccg

SEQ ID NO: 155731 - DNA, 781 bp, Homo sapiens
  misc_feature: GYAE6OF01BXLPK.29.67.G01.1.454.CMB.1.raw
  modified_base (243)..(243): a, c, t, g, unknown or other
  misc_feature (243)..(243): n is a, c, g, or t
  modified_base (330)..(330): a, c, t, g, unknown or other
  misc_feature (330)..(330): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtctccagactccctggctgttgtttctgggcgaggagggccaccatcaactgacaagtccagccagaattattttanatagcctaccaaacaataagaattacttagtcttaggtaccagacaagaaaccaggacacgcctactaagctgcctactatttacgngggctacgtccgtaaccccgggaacgttcccggggtccctacgaacccggtattcgaggtcggcgagggtccggggttcgtaggggactaggtactttccgaacctacgtacgtaaggttaacttacggaccgtacggtacccgtacggtcccgtaagggtccttaagggaaacgggtacgttcgggtaccgggttaccctttaaacgttttttaacgttaaccgtttcggtaaccgtaacggtactttaaaagtttaacctttaaccgtttaaaccccgttaacccccggttacccccggggttaaacccgggttaccccgggtaaaccccggtaaaccgggggaaaccccggttaagggggttaccgggtaaaggtaacgttaaaacccgtaaaaccggtaaacggtcgggttacggtaccgaccgaccctaaccgtacccgttaccgg

SEQ ID NO: 155732 - DNA, 532 bp, Homo sapiens
  misc_feature: GYAE6OF01AXFJ9.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgggaatcccgggtcctgaccgattcagtggcaggcggtctgggacagatttcactactcagtattagcagcctgcaggctgaagtatgtggcctatttacttactgtcagctaattattactactacctccccggtacgttccggaccgtaacgggaccgaagggtcggagacgtacaaacgagtcgtacggctagcaccgtatccg

SEQ ID NO: 155733 - DNA, 699 bp, Homo sapiens
  misc_feature: GYAE6OF01CJ6V1.29.67.G01.1.454.CMB.1.raw
  modified_base (240)..(240): a, c, t, g, unknown or other
  misc_feature (240)..(240): n is a, c, g, or t
  modified_base (327)..(327): a, c, t, g, unknown or other
  misc_feature (327)..(327): n is a, c, g, or t
tcagatagagtactcacgaccggtgctcgatttagagtatacatattgggtttgggggagctacaacaggcaggcagggcagcaagatggtgttgcagacccaggtcttcatttctctgttgctctggatctctggtgccgtacggggacatcgtgatgacccagtctccagacctccctggctgtgttcgtggcgagagggccaccatcaactgcaagtccagccagtaattattttanatgctaccaacaataagaattactagcttaggtaccagacaagaaccaggaccagtccctactaagctacgcttactacttttacgngggtacctaacgtacccggtaacccggggtaacgtccccgggggttccctacggtaacccgtatttaccggagggttcggcggtacgggtccggggttccgtacggggaactaggttactttaccgactactacgtagttaagttacgcacggtacctggactacgggtctaggaacgttagtcgtcgggtactttaagtttactttaacgtcgttacgacgtactaaattactttacttaacccgttacccgtaccccgggttaacgggttccggtaaccgggaaacggtaccggaacgggttacggacggtaactacccggaaaacgtacgttaacggtcggtacgttaccggaccctccgtaacttccg

SEQ ID NO: 155734 - DNA, 739 bp, Homo sapiens
  misc_feature: GYAE6OF01EXSWV.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgaccagtctccagacctccgtggctgttgttcgtgggcgaggacggccaccatcaactgactaacgtccacgaccaagtaacttattttatatacgacctaaccaaactaaagtaaagtaactttaacgttacggtactttacgggtaaccagaaccgaaacgtaaaaccgaagggtacccacggtaccccttaaccgtaacgtccgttacgtaccttacgttaacgttttacggtcgggtaacctacgttaccccggtaacccggggtaacgttccccggggtacctacggacccgtagttcgtacggtcggacgtacgggtccgggttacgtacgggactagttacttaccgaacttacttacggtagtttacgtacgaccgtacgtccgtacggacgtaggactaaggaggtacttcggtacgttactttaagtttacgttacgtcggtactaagtactaagtttaccttacctacccgtacccgtaccggtacgtcgggaaccgtaacgggaacgtacgggtgaaccgacgtaacgaaacggttcggtacgtcggtactagaccctcgtatccgg

SEQ ID NO: 155735 - DNA, 739 bp, Homo sapiens
  misc_feature: GYAE6OF01DVKAI.29.67.G01.1.454.CMB.1.raw
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgcaagtccagccagaattattttanatanctaccaataataagaattacttagtcttaggtaccagccaagaaaccaggacacgcctacctaagctgtctacgtatttacgtggctacgtccgtaaccccgggaacgtcccggggttacctcgaccggtattcgaggtcggctacgggcggttacgtgggaacctagtacgtttcgaacctctacgtagtaacgtttacgacgtaacgtcccgttcgaacgtcggaccgttaggtaaacggtacgttcggtacgggtaccctttaagtttttaacgttaccgtttacggttacaacggttaacctaaacgttttaacgtttaaacctttaaaccccggtttacccccggttaccccgggtttaaccgggtttaaccccgggtacccgggaaaaccgggtaacccggtaaacggggtcggtaaacggtaacgtaacccgaaaaccggtacgtttacgggtaccggtaccgtacgtaccccgaacgttacgttaccgg

SEQ ID NO: 155736 - DNA, 740 bp, Homo sapiens
  misc_feature: GYAE6OF01BWFHQ.29.67.G01.1.454.CMB.1.raw
  modified_base (248)..(248): a, c, t, g, unknown or other
  misc_feature (248)..(248): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctccctggctgttgtttcgtgggcgaggacgggccaccatcaactgacaacgtccagccaagtaattattttanatagcctacaaactaataaataacttacttagcgtttacggtaccagtacaacgaaaccaggaacacgtacctaccgtaagcctagaccttactacgttttaccgtgggacctacgttacccggtaacccggggtaacgttccccgggggttaccctacggaaccgtactttacgacggttcggacgtacgggtccgggtacgtacgggaactacggtactttccaacgtactacgtaacgttagttacgacgtacgtacctacggacgtacggtacgtaaggtaaggtacgttcggtacggtacctttaagttttacttacgttacgtacgtaacgtaacttaagtttaacttaaccttacccgtaacccggttaccccgggtacggtttaccggaacccggtaacggggaaccgtaagggtacggtaacgtacggtaaccgaaacggtaacgtacgggtacgtaccgtacgtacctaaccgtcgttaccg

SEQ ID NO: 155737 - DNA, 811 bp, Homo sapiens
  misc_feature: GYAE6OF01ECBJK.29.67.G01.1.454.CMB.1.raw
  modified_base (195)..(195): a, c, t, g, unknown or other
  misc_feature (195)..(195): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacgggacatcgtgatcgacccagtcctccagacctccctggctgtgtttcgngggcgagacggccaccatcaactgaccaagtccagaccaagtaatttattttatatacgctaccaaacaaataaagtaactttacttagtctttacggtaccagaccaagaaaccgaggaccacgccctacctaagctgccttctaacgttttacgcgggtacctaacgttacccggtaaccccggggtaacccgttcccggggtaccctacggaccccggtaattccgaggttccggcggtacgggtcggtcgacgggtacctaaggttacttacgaccgtacgttaccgtaagtttaacgtaaccgcgtaaccgtcccgttacggaccgtacgggttccgtaagggtaaaacggttcgttcgggtaccgtttaccttttaaacgtttttaacgttaaccggtttggtaaaccctaagttaaaccgtaaacttttttaacttttaaacccgtttacccgttaacccccgggttaccccgggttaaccggtttaccccggggaaccgttaaaccgggaaccggtaagggtaaccggtaagtaacgttaaacccgaaaccgttaaaccgggttggtttaaccggtacgtacccgaaccctttgttaccggtttaccg

SEQ ID NO: 155738 - DNA, 699 bp, Homo sapiens
  misc_feature: GYAE6OF01COCN5.29.67.G01.1.454.CMB.1.raw
  modified_base (253)..(253): a, c, t, g, unknown or other
  misc_feature (253)..(253): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacatcgtgatcgacccagtctccagtactcccgtggctgttgttcgtgggcgaggacggcccacatacaactgactaacgtccaagccaagtaattattttanatacgacctaaccaaactaaataaacgtaactttacgttagtacgttaggtaaccaggacaaacgtaaaccgaggacacggtacctactaacgctgtactctaagtttacgcggactacgtcccgtaaccgggtaccgtccggtccctgacctatcgagtcggcgtacgggcggtcgtacggactacgtacgtttacaacctcgtacgtattacgttaagaccgtacgccctaggaccgtaggtacgtacggtaagtcgttcgacggttacctttaatttacgttaacgttcgttaacgaacgttaactaaagtttcttaaccttacccgtaccccggtaccgtaccggttaccggaccggtaaccgggtaacgtaaacggggtcgtaacgtaacgtaaaccggaaacgttaccgtagggtaccgtacagtacctaccttcgtacg

SEQ ID NO: 155739 - DNA, 830 bp, Homo sapiens
  misc_feature: GYAE6OF01CCPZG.29.67.G01.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagngggccaccatcaactgcaagtccagccagaatatttanatagctacaacaataagaattactagcttgtaccagacaagaaaccaggacagcctactaacgctacgctactatttacgtcgggcaacgttccgttaaccccggtaacgttcccggggtaccctacggtaacccggaatttccgaacggttcgggaccgtaacgggtccggggttcgtacggggggtaaccctaagggttaacgttttaccaaccgtaaccgttacgtaaacgtttaacgttaacggtaccgtaacggtaccccgttagggtaccgtaacggggtaaccgttaagggaaaacgggtaagttaccgggttaccggggtaccctttaaacggtttttaacttaaacccgtttaggttacccgaaaggtaacccgttaaaagttttaaaccttttaaaccgtttaaaccccgtttaaccccggtttaccccccgggttaaccgggtttaacccgggtaaccccgggtaaaacgggggtaaacccccgggtaaaaggggttacgggtaagggtaaaccgttaaaccgtaaaaccgtttaaccgtacgggttacggtacgttacggaaccgtaacctaccgttacccg

SEQ ID NO: 155740 - DNA, 134 bp, Homo sapiens
  misc_feature: GYAE6OF01A0CKN.29.67.G01.1.454.CMB.1.raw
  modified_base (130)..(134): a, c, t, g, unknown or other
  misc_feature (130)..(134): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnn

SEQ ID NO: 155741 - DNA, 755 bp, Homo sapiens
  misc_feature: GYAE6OF01DIV63.29.67.G01.1.454.CMB.1.raw
  modified_base (305)..(305): a, c, t, g, unknown or other
  misc_feature (305)..(305): n is a, c, g, or t
tcagatagagtactcacgaccggtgctcgatttagagtatacatattggggtttgggggagctacaacaggcaggcaggggcagcaagatggtgtgcagacccaggtcttcatttctcttgttgctctggatctctgggtcgcccgtacggggactatcgtgatcgaccctagtcctaccgacgtaccttcccgtgggccttggtttcggttttcggcgggggacggaacggaaccggggcccaaccaacgtccaaacgtcggaaccaaacgtcccaacggacctaaggttaaatttattttaanaacgtccgacctaacccgtaaaactaaaagtaaaagtaactttaacttaacggtcgttaacggaaccaagaaccaaacggaaacctagggacctacgtaccctaaccgtagtcctacgtacgtactaacgtttacgcggtactaacgtacccgggtaaacccgggtaccggtccgggtacccctaggacccttagttcggacgtcgggtacggacggtccgggtcgtagggaactacggtacttacacgttactactaaggttaactcgaactcgaccgtgacgtagacgtaagagtacgtcgtacgtacttaagtttactacgtcgtaactacggtacttaagttaacttaacctccgtaaccccggtcggtaactccgggaacgacggacgtaaaggcggaagaactaacgaaagtacggtccgagtccggaccgtaccagtactacg

SEQ ID NO: 155742 - DNA, 603 bp, Homo sapiens
  misc_feature: GYAE6OF01DJRV5.29.67.G01.1.454.CMB.1.raw
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
  modified_base (350)..(350): a, c, t, g, unknown or other
  misc_feature (350)..(350): n is a, c, g, or t
  modified_base (571)..(571): a, c, t, g, unknown or other
  misc_feature (571)..(571): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctccagacctccctggctgtgttcgngggcgagacggccacatacaactgcaagtccacgacaagaattatttanatagctaccaaactaaataaagtaatttaacttacgtactttacggtaaccagacaaacgaaaccgaaggacacgacctacctaagctcgctacgtaactttacgngggacctagtacccgtaaccgggaacgtcccggggtccctacggaccgtacttcgacggtcgacgtacggcggtcggtaggacgtagtactttcactactacgtaagttacttacgctacgctgacaggctagaagtagtcggtacgtacttatttaacttactacgacagtactaagttactactacgtacccgtccgtacgtcgacgacgacgtacggngagagacaacgacgtgtacgctagcactgtac

SEQ ID NO: 155743 - DNA, 787 bp, Homo sapiens
  misc_feature: GYAE6OF01E12VT.29.67.G01.1.454.CMB.1.raw
  modified_base (262)..(262): a, c, t, g, unknown or other
  misc_feature (262)..(262): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtgttcgtgggcgaggcggccaccatcaactgacaagtccagccagtaattatttagtatacgtcctaccaaanaaataacgtaattaccttagtcgttacggaaccagacgaacgaaaccgaggaccacgtcctacctaagtcctgcttacgtagtttaccgagggtccaacgtacccggtaaccccggggtaccgttcccggggtaccctaggtacccgtagttccggacggttacggacggtacggtaacggggttactacgggggtaaccttaggtaacgttttacccaactaaccgttaccgtaacgttaacgttaccgacgttacggacccgtacggtaccgagggttaaccgtaggtaagtacggtgttaccggtacctttaatttaacggttcgtaaggttcctaaacgtacctaaatttaaccttaaccgttaccccggttaaccccgttccccggggtaaccgtttaaccgggacccgaaaaccggggtaacccggtaacgggttaacgggaaccggtaaacgtaaccgtaaaaccgggtacgtaccgggttacgggaccctaacggaccctaccgtacggtttacccg

SEQ ID NO: 155744 - DNA, 144 bp, Homo sapiens
  misc_feature: GYAE6OF01BPJY3.29.67.G01.1.454.CMB.1.raw
  modified_base (130)..(144): a, c, t, g, unknown or other
  misc_feature (130)..(144): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnnnnnnnnnnnn

SEQ ID NO: 155745 - DNA, 674 bp, Homo sapiens
  misc_feature: GYAE6OF01CYS53.29.67.G01.1.454.CMB.1.raw
  modified_base (203)..(203): a, c, t, g, unknown or other
  misc_feature (203)..(203): n is a, c, g, or t
  modified_base (479)..(479): a, c, t, g, unknown or other
  misc_feature (479)..(479): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtcgccgtacggggacatcgtgatcgacccagtcctccacgacctcccgtggcctgttcgtttcgngggcgaggacgggcccaccatacaacttcaacgtccagaccaagtaatttattttatatacgtcctaccaaataaagtaacgtaaactttacgttagtaccgttacggtaaccagacaaacgaaaccgaggaaccacgcctacctaacgctcgtacctacttactttacggcgggactaacgtaccgtacccgggtaacgtcccggggtcctacgtaccgtacttcgaggtcggacgacggtcggtcgtacgggactagtacgttcaactaccttnaagttactagacgacgccgtagcgtagactaggagtagtcggtacgtactttatttacgttctacgtgaagtactaaattactacttaacccgtcccgttacccggtagttaccgggaacccgttaaacggaccgtagggtacgaagtacgaacgaacgtaacgtggtacgaccgtacaccgaactgttcctacg

SEQ ID NO: 155746 - DNA, 771 bp, Homo sapiens
  misc_feature: GYAE6OF01AUF14.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgttctgggcgagaggccaccatcaactgcaagtccagccagaattattttanatagctaccaaactaataaagtaattaacttagctttaggtaccagcaagaaaccaggaccagaccctactaagctgcctacatttacgtgggctatcccgtacccgggaatcccggggtccctagaccgagttccgaggtggacgtacggtcggggtctaggggactaggtacgtttccaacgaccgttacgtaagttaacgttacggaccgaacggtcccgttacggaccgaacgggtacccgttagggaaacggtacggttcgggttaccggggtaccctttaagttttttaacgtttaacccgttacggttaacccgtaacggtaacccgttaaaagtttaaccttttaacgttaaaccccgttaaccccggttaccccccggggttaaccggtttcccgggaaacccggtaaaaccggggtaaccccggtaaaagggggttaccggggaaaggttaacgtaaacccgaaaacggtaaaccgttcggttacgggtacccgtacggtacccaaccgttaccgttacccgg

SEQ ID NO: 155747 - DNA, 791 bp, Homo sapiens
  misc_feature: GYAE6OF01BXE2A.29.67.G01.1.454.CMB.1.raw
  modified_base (770)..(770): a, c, t, g, unknown or other
  misc_feature (770)..(770): n is a, c, g, or t
  modified_base (780)..(780): a, c, t, g, unknown or other
  misc_feature (780)..(780): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtctccagacctccctggctgttgttcgtgggcgaggacggaccaccataccaacgtgaccaacgtccgaacgaccaagtaaatttacttttaagtacgtaacgtcctaaccaaaactaaagttaaacgtaaaactttaacgttacggtaccgtttaggtaaacctaacgacgaaacgaaaaaccccgaggaccgtacgtacccgtaccgttaaacggtccttacgtaccgttactttaacgtttttaccggacgggtaactaaccggttacccggtaaacccccgggtaaacggtttcccccggggttaccctacggaaccgttattaccgaggttcggaccgtaagggtcccgggtcggtaacgggactacggttaatttacccgaacgtacttacgtaagtttacaacggtccaacgtcccgtacgacggtacggacgtaggaaagtgtcggtacgtactttaattacgttaactcgtactaaggaattttaactaacttaaccgttaccgttaaccccggttacccggtaagttcccggaacggtaacccgggtaacgtaagggtacggagaaccgtaaccaaagttcgtagtcggtaacnccggtaaccncgtacttaccg

SEQ ID NO: 155748 - DNA, 598 bp, Homo sapiens
  misc_feature: GYAE6OF01BL61W.29.67.G01.1.454.CMB.1.raw
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagacctccctggctgtgtttctgggcgagagggccaccatcaactgcaagtccagccagaatattttatatagctaccaacaataagaattacttagacttggtaccagacagaaaccaggacagcctacctaagctgctctatttacgtgggcatccgtaccgggactcccgggtcctgaccgattcagtcggcacggcggtctgggactaggatttcacactcaagtattacgcgtagcctggacaggctagggacgtagtgtcggtacctaagtttttactaacttgttccaacggtcgtaaatttattaacttaccttaccgttccccgggtaagtttccgaccgtaacgggaccgtaacgggtcgggataacgtacaaaccgggtaattacgggtacggacgttaggccctacctagttccg

SEQ ID NO: 155749 - DNA, 880 bp, Homo sapiens
  misc_feature: GYAE6OF01D9R9R.29.67.G01.1.454.CMB.1.raw
tcagatagagtactcacgaccggtgctcgatttagagtatacatattgggtttgggggagctacaacaggcaggcagggggcagcaagatggtgttgcagacccaggtcttcatttctctgttgctctggatctctggtgcctacgggacatcgtgatgacccagtctccagacctccctggctgtgtttcgtgggcgagacggccaccatcaactgacaacgtccagccaagtaattattttatatacgctaccaacaataagtaatttactagtcttacggtaccagaccaacgaaaccaggacacgacccttacctaagcttacgactaccttaagttttaccgtcgggactaagttccccggtaaacccggggtacgttccccggggtccctacgaccgtattcgaggtcgggaccgagggtccgggttacgtacggggactaacggtactttaccaaccgtaacgtcgttaacgtttaacgttaccgtacgtacggtacccgttaggacccggtaacgggtaccgtaaacgggtaacggtacggtttacgggtttaccgggttaaccgttttaaacgttttttaaacgtttaccgttacgggtttaacgaaccggtttaaacctttaaaacggttttaaacttttaaacccggtttaaacccccgtttaacccccgggttacccccgggttaaacccgggtttacccggtaaaccccgggggaaaccggggttaaaccccgggttaaacgggggttaaaccgggttaacggaaaaccgttaaaccccgggaaaaaaccccgggttaacggttaacggggttacccgggtaaaccggttaccttaaccccggtaaaccgtttaccggttaacccgg

SEQ ID NO: 155750 - DNA, 729 bp, Homo sapiens
  misc_feature: GYAE6OF01DONSE.29.67.G01.1.454.CMB.1.raw
  modified_base (197)..(197): a, c, t, g, unknown or other
  misc_feature (197)..(197): n is a, c, g, or t
tcagatagagtactcacgaccggtgctcgatttagagtatacatattgggtttgggggagctacaacaggcaggcagggggcagcaagatggtgttgcagacccaggtcttctatttctctgttgctctggatctcgtggtgcctacggggacatcgtgatcgacccagtcctcacgtctcctggtctgttgttcgngggcgaggacggcccacatcactcgacaacgtccacgctaagtaattacttttaataagtacacctaaccctaaactaaagttaaaggtaactttacgttaagtccgtttaggtaaccaaggaccaaacggaaaaccgcgggaaccaccggtacctaccgtaaagcgttcgtaccttacgtacgttttaaccgcgggtactacgtacccggttaaccccggggtaacggttccccggggtacctacggtaccccgttaattccggcggtcggtacggacgggtcgggtacggtacgggaactacggtaactttacaacctactacgttaattacgtacgcgtaccggtctaggaactggacgttaggaagttgttcggtacgtacctttaagtttctacgtcgtaacagtaacttaagttacttaaccggttccccgtacggtccccggttagtacggacggtaacggacgggtaaacgtggaagttaaaccacggtaaacgacgtcgtggaccctgaacctctaacgttcg

SEQ ID NO: 155751 - DNA, 706 bp, Homo sapiens
  misc_feature: GYAE6OF01C1JSK.29.67.G01.1.454.CMB.1.raw
  modified_base (440)..(440): a, c, t, g, unknown or other
  misc_feature (440)..(440): n is a, c, g, or t
tcagatagagtactcacgaccggtgctcgatttagagtatacatattggggtttgggggagctacaacaggcaggcaggggcagcaagatggtgttgcagacccaggtcttctatttctctgttgctctggatctctggtcgccgtacgggacatcgtgatcgacccagtctccacgacctccgtggctgttgtttcgtgggcgaggacgggaccacctatacaacgtgacaacgtccacgaccaagtaatttattttataatagcctaaccaaaactaaataaagtaaatttacttagtcgtttacggtaaccagacaaacgaaaccgaggaccacgccctactaacgctgacctactagttcgtacggcaacgtcccggtaaccgggtacgtcccggggtcctcggtaccgtattcgaggtcgcgtacggcgggtcgnggtactagtacttcgactactagtagtactacgacgacgtcctagctacgggtctaggtaacgtaggttacggtcggttaacctttaagttttactacgtttcggtaactacgttaaactaatttacttaaaccgttacccgtaccccggttacccgggtaaccggttaccggtaaccggaaaccgggtaaccggtaagggtaacgggaactaaccggtaacgtaaaacgtacgtacggtcggacctgaacccgtactcgttaacg

SEQ ID NO: 155752 - DNA, 545 bp, Homo sapiens
  misc_feature: GYAE6OF01BN7Q3.29.67.G01.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccacatcaactgcaagtccagccagaatatttanatagctaccaacaataagaattacttagcttggtaccagcaagaaaccaggacagcctcctaagctgctcattcngggcatctaccgggatccgggcctgaccgntcagtcggcngcggtcgtggactagnttcactactcagtattagcagtccgtgcgaggactgaagtagtgtacgtcctatttactacgtcgtcagtactaattacttataccttaccgtccccggtagttccgaccgaacgggaccgaaggtcgaagtacgtacgaaaacgtaccgtagtcggactagaccgtacgtcgttacg

SEQ ID NO: 155753 - DNA, 748 bp, Homo sapiens
  misc_feature: GYAE6OF01DIKIU.29.67.G01.1.454.CMB.1.raw
  modified_base (250)..(250): a, c, t, g, unknown or other
  misc_feature (250)..(250): n is a, c, g, or t
  modified_base (354)..(354): a, c, t, g, unknown or other
  misc_feature (354)..(354): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagactccctggctgttgttcgtgggcgaggacgggccaccatcaactcgacaacgtccacgccagtaattatttttanaatacgacctaccaaactaataaagtaacttacttaagtcgttacgtaaccagacgaacgaaaccgacggacacgtccctactaagtctagctactagtttacngggactacgtaccgtaacccgggtacgtcccgggtacctcgaccgtactacgaggtcggcgtacgggcgggtcgtacgggaactaggttactttaccactacgtacgtaagttacgttagaccgtagtccgtcggaacgtagggtccttaagggaacggttagttccgggttaccgtaaccgtttttaaactttttacggtaccgttggttaaaccctaagggttaaccttttaaacgtttacttaacccgttaaccccggttacccggtacccccggggttaacgtacccgggtaaccggtaaaccggggtaccgtaaagggtacggtaacggaaccgtaaacgtaaccggtaaggtccggttaggaaccgtcctacctacgttaccgttacg

SEQ ID NO: 155754 - DNA, 680 bp, Homo sapiens
  misc_feature: GYAE6OF01BEOH3.29.67.G01.1.454.CMB.1.raw
  modified_base (183)..(183): a, c, t, g, unknown or other
  misc_feature (183)..(183): n is a, c, g, or t
  modified_base (255)..(255): a, c, t, g, unknown or other
  misc_feature (255)..(255): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (458)..(458): a, c, t, g, unknown or other
  misc_feature (458)..(458): n is a, c, g, or t
  modified_base (670)..(670): a, c, t, g, unknown or other
  misc_feature (670)..(670): n is a, c, g, or t
  modified_base (674)..(674): a, c, t, g, unknown or other
  misc_feature (674)..(674): n is a, c, g, or t
tcagatagagtactcacgaccggtgctcgatttagagtatacatattgggtttgggggagctacaacaggcaggcaggggcagcaagatggtgttgcagacccaggtcttcattttctctgtgctctggatctctggtgccgtacgggacatcgtgatcgacccagtcctccgagcctcccgnggcttgttgttcgtgggcgaggacggccacctatcgaacgtgacaaagtccgaagccaagtaattattttanaagtacgacctaacccaaataaaacgttaaagtaaacttttacgttaacgtcgtttacggtaacccaagtaccaaacggaaaacccagggaaccaccgtacccgtacttaaacggctcgtaccttagttattaacgtcggactaacggtccgtaacccgggtacgtccgggtaccngacctatcgnggtgccgaggtcggtangggacagtaccttcaccctatgtaacgtacttagaccgacgtaccgtggactacgggacgttacgggaagtacgttagtcgtacctttaatttacgtacgttacgtactaacgtactaaagttactttaacgtacgttaccgtaccgtcgtacggtaccgaacgtacgaacggtagtacgagtaccgtaaactaagttcggctacgacgacncgtnttaccg

SEQ ID NO: 155755 - DNA, 781 bp, Homo sapiens
  misc_feature: GYAE6OF01CUSF8.29.67.G01.1.454.CMB.1.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgcccgtacgggggacagtcgtgactcgaccccgagtcctccagtacctcccgtggtcttggttcgtttcgngggcgaggacgggcccacatcaaactgccaagtccagcctaagtaacttatttanatcgactacaaactaataagtaattacgttacgnttacgtaacngacaaacgaaccgtggaacncgaccctactaacggtcctcgaccgttacttaacggttttaccgacggggtacctaacgttaccccggtaaacccggggtaaccggttccccgggggttaccctaacggtaccccgtaggtttccgaacggtcgggacgtaacgggtcgggttaccgtacggggtaaactacgtacgtttaccgaacgttacgtacgtaaggttactaacggtccgaggtaccccgtgacggtaacggtcgtaacggaacgtacggtttggacccggttaacgtttaacgtttaaccgttacggtgtaaccgaacgttaacgttaattaccgtttaactaacccggttaccggttacccgggtacgttacggacccggtaaacgggcgttaacgggcgtaaacgtacgtaacggtaaaccgttagggtcgtaacgggtccctgaacccgtacgcggtttacc

SEQ ID NO: 155756 - DNA, 622 bp, Homo sapiens
  misc_feature: GYAE6OF01CRR4Y.29.67.G01.1.454.CMB.1.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (431)..(431): a, c, t, g, unknown or other
  misc_feature (431)..(431): n is a, c, g, or t
  modified_base (607)..(607): a, c, t, g, unknown or other
  misc_feature (607)..(607): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctcgtggtgccgtacggggacatcgtgatcgacccagtctccagactccctggctggttcgttcgtgggcgaggacgggcccaccatcaacgtcgacaagtccagaccaagtaattattttanatcgactaccaacaataagtaattacgtagtcttacggacngacacgaacaggacncgcctactagctgctacgtattcgnggctacgtaccgaccgggtaacgtccgggtacctgtacctagtccgaggtcgacgacgggcggtactagggtactagttaccttacgactacgtntaacgttatacgactgtcctaggctaagggtcgttagaagttacggttcggtacgtacctttaagttttacctacggttagtaaccaaggttactaacttagtacctacgtacccgtaccggtaccgtacggacgacgaacgtacggtggactagtacgaacgtatgtacgttacncggtaactcgattcg

SEQ ID NO: 155757 - DNA, 920 bp, Homo sapiens
  misc_feature: GYAE6OF01A2BDN.29.67.G01.1.454.CMB.1.raw
  modified_base (210)..(210): a, c, t, g, unknown or other
  misc_feature (210)..(210): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggtatctctggtcgccgtacggggacatcgtgatcgacccagtcctccgaggtacctcccgtgggcttcggttacgtttccgnggggacgacggaccgggcccaacctataccgaaccgtcgaccgaaccgtaccacggtaccgtaaggtaaacttttacttttaataacgtacgtacccttaaccaaaataaacgtaaaaggttaactttaaccgtttaggtaccgtttacgggtaacccacgaaccgtaaaccggaaaccgacgggtaaccaccggtacccctaccggttaaggccttacggaccttacgttaacgttttacgcgggaccttaaccggtaccccggttaaccgggtaccgttccccggggtaccctaggtaaccgtcgtttacgacgggtacggccggtacgggtcgggtacgtacggggaactacggtttactaccgacgtacttacgtagttaacgtacgtaccggtaactccggttaaggaccggtacggttagtaaggtaacgtacggttcgttaaccgggtaacttttaagtttaccgttaacgtcggtaacctaaacggttacgttaagtttaacccttaaaccggtttaccccgaccccgggtttaacccccgttaccggggtaacccgggtaaccggtaaaccggggtttaaaccggggaacggggttaaaccgggtaactaaacccgggttaaaaccggttaaaccggttaaccggttaccgggttacccgggtacgttaaacccgcccggttaaacggtcccggtttaccc

SEQ ID NO: 155758 - DNA, 670 bp, Homo sapiens
  misc_feature: GYAE6OF01CL3R1.29.67.G01.1.454.CMB.1.raw
  modified_base (247)..(247): a, c, t, g, unknown or other
  misc_feature (247)..(247): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagacctccctggctgttcgttcgtgggcgaggacggccacatcaactgacaagtccagccaagtaattattttanatagcctaccaaactaataaagtaacttacttagctttaggtaaccagacaagaaccgaggacacgacctactaagctagctactagtttacgtgggactacgtaccgtaacccgggacgttcccgggtcctagaaccgtattcgagtggctaggccggtgcggactagtacttcgactactagagttactcgacacgtcgagacgagtcgtagaagtacgttcggtacgtaccttaatttacgttacgttgtacctaaggtactaaacgtttaacttaaccgttaacccttaccccgggtacccggttaaccggttaccggaaccggtaaacgggaaaccggtacgggtaacggaaggtaaccgtaaacgtaaacccggtacgttacggtaccggtaccgtacgaaccgtacgtcgttaccg

SEQ ID NO: 155759 - DNA, 835 bp, Homo sapiens
  misc_feature: GYAE6OF01EI0M1.29.67.G01.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtgccgtacggggacatcgtgatcgacccagtctccagacctccctggcttgttgtttcgngggcgaggacggcccaccataccaacgtgacctaacgtccacgccaagtaatttatttanatacgctaccaactaaataagtaactttacgtagtccgtttaggtaaccagacgaacgtaaaaccgnggtaaccnccggtaccctaccttaagggccctagccttaactagttttacgcgggtactacgttacccggtaacccggggtaacggttccccggggtacctacggtaccgtagttaccggtaggtacgggtcgaacggggttccgggttaccggtaacgggggtacctaacggttaaccgttttacccgaaccgttaacccgttacgttaaggtttaacgttaacggaccggttaacccggtacccgttacggaccgggtaacgggttaccgtaacgggtaaacggttacggttacgggttaccggtaacctttttacgtttttaacgttaccggttacggtacccgtaaggtaacctttaaacgttctttaaacccgttaccgttaccccggtttaccccggggtaaccgttaaccggggtacccaaaaccggggtactaaggggtccgtaaggtacctaaccgaaaccggtagtcggtacggtacgtacccaccgtcgtacgttaccg

SEQ ID NO: 155760 - DNA, 873 bp, Homo sapiens
  misc_feature: GYAE6OF01BGYTI.29.67.G01.1.454.CMB.1.raw
  modified_base (168)..(168): a, c, t, g, unknown or other
  misc_feature (168)..(168): n is a, c, g, or t
  modified_base (301)..(301): a, c, t, g, unknown or other
  misc_feature (301)..(301): n is a, c, g, or t
tcagatagagtactcacgaccggtgctcgatttagagtatacatattggggtttgggggagctacaacgaggcaggcaggggcagcaagatggtgttgcagacctcggtcgttctatttcttctgttgtctctggtgtctctggtggccgtacgggacggactcgtgntacgtaccacgtctacctacgaccgtcccgtcggtcgttgtttcggttacggttcgggccgggaggacggaccgaacctactactaaccgttactaacgtaccgtacgacaacgttaattaattttaacttanacgtacctaccaaaacgtaaattaaacgtaaacgtttaacgtttacgtacgttacggttaaaccgagtaaccgaaaagtaaccgaaccggacgaaccgtcccgtaccttaaacgctcgaccttaccgtaacgtttactcgggccgtagttaaccccggtaacccgggaaccggttccggtccccgtaggaaccgtaacgtttgacccggtaggtcgacgggttccgggtcggaggtacgacggtttaacttccggaaactccgtagtaacgtacgttaacgctacggtcgcgtacgacggtaacgtaggtaacgacgggttagtcgtaaccgtttagtttaccgttttaacgtccgtaaacgtaccgttaaacgttaaccgtaacttttaacgttaacccgttaacccggttaacccccggtaccgggtttaacccggacccggtaaaaccgggtaccgggtaaaacgggttaccggtaaacggtaaccggttaacccggtaaaaccggttaccgggtaccggtaacggggtacctaccggtaacccgttacgtaccgtttcgggttaaccc

SEQ ID NO: 155761 - DNA, 765 bp, Homo sapiens
  misc_feature: GYAE6OF01D9LWA.29.67.G01.1.454.CMB.1.raw
  modified_base (194)..(194): a, c, t, g, unknown or other
  misc_feature (194)..(194): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgccgtacggggacatcgtgatgacccagtctccagacctcctggctgtgtttcgnggcgagcggccaccatcaactgacaacgtccagacctaagtaatttattttatacgtagtcctaaccaacaataaagtaattacttagtcgtacgtaccagaccaacgaaacgacgaacgacgtaccgtacctaagtcctagtcgtacttactttacgagggactacgtacccgtaaccgggtaaccgttcccgggtacccgtagacccgtacttcgtaggtcggacgaccggtcggggtcgtacggacgtaagttaccgtttaccaacctacctagtacgttaactacggtaccacggtacccgttacggcgtagggaccctaagggtaacgttaggttacggtacggttcctttaaatttttaccggttacgttacggttacgtaacggtaaccttaaagtttaaccgtttaaccttaacccggtttacccggtaccccgggttacccggttaaccggtacccgggtaaaccgggtaaccggttaacgggtacgggtaacgttaacgaccgggttaaaacgtaccgggtagtaccggtaccgtaccggtacctacccgtcggtttaacg

SEQ ID NO: 155762 - DNA, 735 bp, Homo sapiens
  misc_feature: GYAE6OF01CEGMC.29.67.G01.1.454.CMB.1.raw
  modified_base (256)..(256): a, c, t, g, unknown or other
  misc_feature (256)..(256): n is a, c, g, or t
  modified_base (731)..(731): a, c, t, g, unknown or other
  misc_feature (731)..(731): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctaccagacctcccgtggcttgttgtttcgtgggcgaggacgggccaccgatccaaactgacaacgtccagaccaagtaacttattttanatacgacctaccaaataaataagtaacttacgttaacgtcgttacggtaaccagaccaacggaaaccctagggaacacgacccttacgtaagctacgcttactacgtttacggacgtctacgtaccggtaacccggggtaccgttcccgggtccctacgtaaccgtactttcggacgtcggaccgacgggtccgggttacgtacgggtactaaacggttctttaaccgacgttaccgttaacgtaagttaactttacggacctaaggccccgttagaccgtagggtacctaaggtaacggtacgttacggttacggtacctttaaagtttaccgttattaccgaccttaagtaccgtaatttaacttaccgtaacccgtacccggttacccggaccgtttacggaaccgtacgggacgtagggtcgaacgtaacgtacgaacgttaacggttggactacgtaggaactaccgttntacg

SEQ ID NO: 155763 - DNA, 830 bp, Homo sapiens
  misc_feature: GYAE6OF01AJ76X.29.67.G01.1.454.CMB.1.raw
  modified_base (141)..(141): a, c, t, g, unknown or other
  misc_feature (141)..(141): n is a, c, g, or t
  modified_base (552)..(552): a, c, t, g, unknown or other
  misc_feature (552)..(552): n is a, c, g, or t
  modified_base (594)..(594): a, c, t, g, unknown or other
  misc_feature (594)..(594): n is a, c, g, or t
  modified_base (601)..(601): a, c, t, g, unknown or other
  misc_feature (601)..(601): n is a, c, g, or t
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
  modified_base (662)..(662): a, c, t, g, unknown or other
  misc_feature (662)..(662): n is a, c, g, or t
  modified_base (670)..(670): a, c, t, g, unknown or other
  misc_feature (670)..(670): n is a, c, g, or t
tcagatagagtactcacgaccggtgctcgatttagagtatacatattgggtttgggggaggctacaacaggcaggcaggggcagcaagatggtgttgcagacccaggtcttcattttctctgttgctctggatctcttggngccgtacggggacatcgtgatcgaccagttcttaccgacgaccgttcccgtggtcctaggtttcggtttccgtaggggacgtacggtaccggggtacccaccctacttaccgaaacgttcaaccgtaaccggtcccgaacgggaccctaaagttaaacgttttattttttaacggacttaccgcctaaaccctaaacgtaaacttaaggtaactttaaccggttaagttcgtttaaccggttaaccacggtaacaaccgtaaaccgacgggtaaccacggttaccctacgtaacggtcctttacggacctttaacttacgtttaccgtacggacctacgtttaccccggtaacccggggtacttcccggggtacccctacggaccggttaacttcggacgtggggtaaccncgggtgggtaccttacgggacttagttccgtaacccgttaanacgttancgttaagcgacgtacacggacagtcggtanagttaacgnggtacgttagtttactttaacncggttaancgtaacttacctaagtttaaccctttaacggtacccgttttacccggtaccccgttagggttaccacgggtaaacccggtaacggtacggtaccgggtaagtaccgaacggttaacttaacgacggttaacggtcgtaaaccgtcctaccgttacgtacg

SEQ ID NO: 155764 - DNA, 703 bp, Homo sapiens
  misc_feature: GYAE6OF01A9UUK.29.67.G01.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (395)..(395): a, c, t, g, unknown or other
  misc_feature (395)..(395): n is a, c, g, or t
  modified_base (455)..(455): a, c, t, g, unknown or other
  misc_feature (455)..(455): n is a, c, g, or t
  modified_base (479)..(479): a, c, t, g, unknown or other
  misc_feature (479)..(479): n is a, c, g, or t
tcagatagagtactcacgaccggtgctcgatttagagtatacatattgggttgggggagctacaacaggcaggcaggggcagcaagatggtgttgcagacccaggtcttcatttctctgttgctctggactctcgtggtcgccgtacggggacagtcgtgatcgaccctagtcctcaacgtcctcccnggtctgttgttcgngggcgaggacggaccctaccactacaacgtcgacgaacgtcccacgacctaagttaatttattttaatacgtacgaccttaaaccaaaactaaaagttaaagtaactttaccttaacggtcgtttacggaaccaaggaacaaacggaaaccgaggacaccggaccttacgaagtctcgtctataacgtttcgnggcctacggttcccgaaccgggtccgttccgggtacctcggaaccgttgtacgtggtacncggaggtcgggtacgacgggtaancgttaacttcacgtacgtagtaagttacacgtacgtaccgtctacgggcgtaacggtaccgaagtaacggtagtcgtacgttaacctttagtttaaccttggttacgacttacgaacttaagttacttaacctaccgttacccggccgtaaccggtcggaacgtacgggtacgaggtagaatacgacgaagtaacgtgtacgacgtacgaactccgtgttaccg

SEQ ID NO: 155765 - DNA, 727 bp, Homo sapiens
  misc_feature: GYAE6OF01EBJKI.29.67.G01.1.454.CMB.1.raw
  modified_base (361)..(361): a, c, t, g, unknown or other
  misc_feature (361)..(361): n is a, c, g, or t
  modified_base (415)..(415): a, c, t, g, unknown or other
  misc_feature (415)..(415): n is a, c, g, or t
  modified_base (718)..(718): a, c, t, g, unknown or other
  misc_feature (718)..(718): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacagtcgtgaatcgaccccagtcctaccagtaccttccccgtggccttgttgtttcgtgggcgaggacgggcccaccgatcaactgacaagtccagccaagtaattattttatatacgactaccaaactaaataaataatttactagtaccgttaggtaccagacaaacgaaaccgaggacagccctacctaagctgcttactatttacgnggctaacgtacccgtaccgggtaaccgtcccgggtcctacgaccgtacttacgngtcggaccgacgggtcggttaggacgggaacttaaggttaccttttaaccgacgttacttaaggttaacgttacgccgaacggtccctaggcgtaaggtcgggtaagtaacggtcgtttcgggtaccggttactttacgttttaactttacgtacgttactagtaacttaaagttactttaccgttaaaccgtccccggttacccggtacggtaccggtaacggtaaaccggaaacggtacgggtaagggtaacgtaagtaaaccggaaacggtagtacggttcggtacacgtaaccgacctnttcgttacg

SEQ ID NO: 155766 - DNA, 135 bp, Homo sapiens
  misc_feature: GYAE6OF01CYB8Y.29.67.G01.1.454.CMB.1.raw
  modified_base (126)..(126): a, c, t, g, unknown or other
  misc_feature (126)..(126): n is a, c, g, or t
  modified_base (131)..(135): a, c, t, g, unknown or other
  misc_feature (131)..(135): n is a, c, g, or t
tcagatagagtactcacgaccggtgctcgatttagagtatacatattgggtttgggcacagcggccctgggctgcctggtcaaggactacttccagtactctatctggagcgggctggcaaggcgnatagnnnnn

SEQ ID NO: 155767 - DNA, 841 bp, Homo sapiens
  misc_feature: GYAE6OF01EXG28.29.67.G01.1.454.CMB.1.raw
  modified_base (659)..(659): a, c, t, g, unknown or other
  misc_feature (659)..(659): n is a, c, g, or t
  modified_base (833)..(833): a, c, t, g, unknown or other
  misc_feature (833)..(833): n is a, c, g, or t
tcagatagagtactcacgaccggtgctcgatttagagtatacatattgggtttggggggagctacaacaggcaggcagggcagcaagatggtgttgcagacccaggtcttcatttcctctgtgctctggatcctcgtgggtcgaccgttacggggactatcggtagtacgtacgaaccccgtagtcctacccgacgtacccttcccgtcggtcttggttagtttcggtagggacgaacgggacggaccctaacgataccaaacctcgactaacggtccacggtaacctaagtaaattttagttttacaacgtaccgtacctaaacctaaaacgtaaaacgtttaaacgttaaacgttttaccggttaacgttccggttttaaaccgggaaacccgtaaggtaaaaccccgaaaaccggaaaccccggtaacggtaacccacccggtaaccccttacgttaaaacggtccttccggttaaccttaaccggtttaacgttttaccggaaccgggtaccttaaccggttaaccccgggtaaccccggggtaaccggggttccccgggaccgttaaccgtaccggttacttacggaccgggtacgtcggtacgggtcggttacggacggacttaggtacttaccgatactacgtactacgtancgtacctgacgacgaggtactagagtcgttagtaccgtattagttaactcgtagtactaagtacttaattaacgttactaaccctccggtacccgacgttacggaacgtaaccgggataacgggtacgaacgtacgtaaacgaaccgtggtaccgttacgaccgtagaccttcncgttaccg

SEQ ID NO: 155768 - DNA, 589 bp, Homo sapiens
  misc_feature: GYAE6OF01DLBMQ.29.67.G01.1.454.CMB.1.raw
  modified_base (241)..(241): a, c, t, g, unknown or other
  misc_feature (241)..(241): n is a, c, g, or t
  modified_base (332)..(332): a, c, t, g, unknown or other
  misc_feature (332)..(332): n is a, c, g, or t
  modified_base (572)..(572): a, c, t, g, unknown or other
  misc_feature (572)..(572): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgacaagtccagccaagtaattattttanatagcctaccaaacaataaagtaattacttagtcttacggtaaccagacaagaaaaccaggacacgcctacctaagctgctctatttacgnggcatccgtacccgggaagtcccggggtcctagaccgattcgaggtggcgaggcggtcgtaggggacagtactttcactactctaagtactagcacgctgcaggctagaagtgtgtcggtaccttatttattactgtacgatactaagttattaactacctacccgtacccggtacgtccggaccgaagggaaccgagggtacggagacgttaaccgaaacgtacgtaggtcggacgtanacctaccgtattacccg

SEQ ID NO: 155769 - DNA, 661 bp, Homo sapiens
  misc_feature: GYAE6OF01DFJ03.29.67.G01.1.454.CMB.1.raw
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (652)..(652): a, c, t, g, unknown or other
  misc_feature (652)..(652): n is a, c, g, or t
tcagatagagtactcacgaccggtgctcgatttagagtatacatattgggtttgggggagctacaacaggcaggcaggggcagcaagatggtgttgcagaccccaggtcttcatttctctgttgctctggatctcgtggtgccgtacggggacatcgtgatcgacccagtcctccagacctcccgtggctgttgtttcgtgggcgacggacggccaccatcaactgacacgtccganccagtaattattttanacttaacgcctaccaaactaaataagtaacttaacttacgtctttacggaccagacaacgaaccaggacacgccctactagctcncgtactatttacgnggactacgtaccccggtaaccgggtacgtcccggggtcctacggaccgtacgtttacgacggtcgggaccgaacgggtccggggtcgtacgggacctaggtactttaccacctacgtacgtagttagtacgcgactcccggtagcaacgggtgtaaggacgtaggtcggttacgtacctttaattttaacgttagtctaacgtagtaacttaattacgttaactacccgtaacccggttccgaccggtacgtacgaacggtacgaacggtacgagactaagacccgtagcgtgcctacanccgtattcg

SEQ ID NO: 155770 - DNA, 660 bp, Homo sapiens
  misc_feature: GYAE6OF01DQB3R.29.67.G01.1.454.CMB.1.raw
  modified_base (199)..(199): a, c, t, g, unknown or other
  misc_feature (199)..(199): n is a, c, g, or t
  modified_base (254)..(254): a, c, t, g, unknown or other
  misc_feature (254)..(254): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacagtcgtgatcgaccctagtctccagacctcccgtggctgtgtttcgnggggcgaggacggccaccatcaactgcaagtccagcagaaattatttagtaaganctacaaacaataaagaattaagtagcgttaggaccagacaacgaacagacacgctacctaagcagctatattacgtaggctactacccgaaccgggtaacgtccggggtaccctagaccgtattacgaggtaggcaagggtcggtcgtagggactagtacttacaactacgtgaagttaagtacgacgaggtccctaaggtcgaggtactagggaacgtaagtcgggtacgtacgtaagttttaacttagtacgtagaacgtataaacgttatttaactacccgttaacccgtcccgggtaacgttcggtaaccgaaccggtaaacccgggtaaggtacgggtaacgtaactaaacgggaaaccttaaacggtccggtaggaccgtaaggtacctacgtaactacg

SEQ ID NO: 155771 - DNA, 751 bp, Homo sapiens
  misc_feature: GYAE6OF01D54O3.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagacctccctggcttgtgttctgggcgagacgggccaccatcaactgacacgtccgagccaagtaaattattttatattacgacctaccaaacaaagtaagtaaactttacgttactcgttacgggtaaccagaccaaagaaaacccgtaggaaccgacgtacctacccgttaaggccttcgtaccttacttaacgtttaacgtcgggactacgtacccggtaacccgggtaacggttccccggggtacctacggtacccgtattccgtaggtacggacaacgggtcgggtcgacggggaacttaacggtatttccgaactacttacgagttaacttacgactaacgtcctaggacgtaggtactaggaataggtacgtacggtacttaagttttacgtactgtacgacgtactaaacgttatttaccgtaaacccgttaccggtaccccggtaaccggttacccggaccggaaaaccgggttaccggaaaggggttacggaagttaaacggttaaccaaaccggtaaccggttacggtaccggttacggtaacccgtacgaaacccgttgttaacccgg

SEQ ID NO: 155772 - DNA, 615 bp, Homo sapiens
  misc_feature: GYAE6OF01AYJLY.29.67.G01.1.454.CMB.1.raw
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
  modified_base (435)..(435): a, c, t, g, unknown or other
  misc_feature (435)..(435): n is a, c, g, or t
  modified_base (468)..(468): a, c, t, g, unknown or other
  misc_feature (468)..(468): n is a, c, g, or t
  modified_base (492)..(492): a, c, t, g, unknown or other
  misc_feature (492)..(492): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacagtcgtgatcgacccagtcctccagacctccctggctgttgtttcgtgggcgaggacggccaccatcaactgacaagtccagccaagtaattattttaanatacgacctaccaaactaaataagtaactttacgttagctttacggtaccagacaacggaaaccaggacacgtcctacgtagctgctctattcgnggctacgtccgtaaccgggacgtcccgggtacctacgacctagttcgaggtcgcgacggtcggtctagggactagtacttcacgtactntagtactgcgacgccgtgacgagtcgagaagtntacggtcgtacttagtttatcgtntacagttactaattacgttacttaccgtacccggtacccggttacgtaccggaccgaacgggaacgtacgggtagagtaacgtacaaacgtcgtacggtccgactacgccgtaactcgttccg

SEQ ID NO: 155773 - DNA, 671 bp, Homo sapiens
  misc_feature: GYAE6OF01BNC8Y.29.67.G01.1.454.CMB.1.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
  modified_base (314)..(314): a, c, t, g, unknown or other
  misc_feature (314)..(314): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagacctcccgtggctgttcgtttcgngggcgaggacggccaccatccaactgacaacgtccagaccagtaattatttanatacgcctaccaaactaaataaagtaactttactaagcgtttacggaccagacaacgaaaccnggacacgcctacgtaagctcgctactacgttacgtggactacgttaccgtaaccgggacgtcccgggtaccacggacgtatcgaggtggccgtaggccggtagtaggactaggtacttcacgtacgtacgtaaggttacttacggactacgtaccgtggacgaacggtcgtaagtaaagtcgttcgggtacgtaccttaagtttacgttacgtacgtacctaagtacctaaagtttactaacctaccgttaacccggtacccggtacggttacgaccggtaaacgggaaccgtagggtacgaagtacgtaaacgaaacggtactacgggtctacgtacgacccgtaccgtcgttacg

SEQ ID NO: 155774 - DNA, 703 bp, Homo sapiens
  misc_feature: GYAE6OF01EI1VR.29.67.G01.1.454.CMB.1.raw
  modified_base (259)..(259): a, c, t, g, unknown or other
  misc_feature (259)..(259): n is a, c, g, or t
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (667)..(667): a, c, t, g, unknown or other
  misc_feature (667)..(667): n is a, c, g, or t
  modified_base (688)..(688): a, c, t, g, unknown or other
  misc_feature (688)..(688): n is a, c, g, or t
  modified_base (694)..(694): a, c, t, g, unknown or other
  misc_feature (694)..(694): n is a, c, g, or t
tcagatagagtactcacgaccggtgctcgatttagagtatacatattgggtttgggggagctacaacaggcaggcaggggcagcaagatggtgttgcagacccaggtcttctatttctctgttgctctggatctcgtggtcgccgtacgggacatcgtgatcgacccagtctccagacctcccgtgtctgttgttcgtgggcgaggacggaccaccactacaacgtgactaacgtaccacgaccaagtaattattttanatacgacctaaccaaataaagtaaacgtaacttacgtagtcgttacgaaccagacaaacgaaaccgaggaccacgtcctacgtaagcgtcgtctactattacgnggacctacgtacccgtaaccgggtaccggtcccgggtaccncgtaaccgtacttcggacggttcggacggtacgggtaccgggtacggtacggaacgtaacgttacctaccgtacgttacctaagtaagttacgttacggacgttaccgacgttcgaacggtacggtacgtaacggtaagttacggtagttaccggttaaccttagtttttaaccgtacgttgtaccgtaagtaactaatttaccgttaacttaccgtaacccgttaccgtacggtacggaccgaggaaccgttaggaccgtanacgtaacgaacgagtcgtacncgtacnctatgtacg

SEQ ID NO: 155775 - DNA, 765 bp, Homo sapiens
  misc_feature: GYAE6OF01CLWOC.29.67.G01.1.454.CMB.1.raw
  modified_base (261)..(261): a, c, t, g, unknown or other
  misc_feature (261)..(261): n is a, c, g, or t
  modified_base (370)..(370): a, c, t, g, unknown or other
  misc_feature (370)..(370): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtgccgtacggggacatcgtgatcgaccagtctccagacctcctggctgttgtttcgtgggcgacggacgggcctaccattccaacgtcgacgtaacgtccacgaccgaagtaatttattttanatcgtcctacaaacaataagtaatttactagtcgttacggtaaccagacaaacgaaaccgtaggaacacgtaccctaacgtagtcgtcgaccttagttacttttacggnggtacctacgtcccggtaacccgggtaaccgttcccggggtaccttacggaaccgttacgtttaccggacggtcggtacggtacgggtcggggtcggtagggaactacgttactttaccgacctacgtacgtagttagtacgacgacgtcccgtgaccgagtacgacgtagtacgtgtacgtactttacgtttaacgttcgtagtaacgtacgaacttaagtttaattaccgttaacccgttacccggttaccccgttacggttacccggaaccggttaaccgggtaaaccgggtaagggtaaccgggtagttaaccggttaaccggtaaaaccggttaacggtaacgggttccgggttacgtaaccggtacccgtacccgttacgtttacccgg

SEQ ID NO: 155776 - DNA, 783 bp, Homo sapiens
  misc_feature: GYAE6OF01AFQ9Q.29.67.G01.1.454.CMB.1.raw
  modified_base (92)..(92): a, c, t, g, unknown or other
  misc_feature (92)..(92): n is a, c, g, or t
tcagatagagtactcacgaccggtgctcgatttagagtatacatattgggtttgggggagctacaacaggcaggcagggcagcaagatggtnttgcagacccaggtcttcattttctctgttgctctggtatctcgtggtgccgtagggacatcgtgatcgacccagtcctccgacgacctcccgtggcgtgttgttcgtgggcgaggacggccactatacgtaacgtgactaacgtccgacgaccaagtaatttagtttatacgtacgtcctacctaaaactaataaactaacgtttacttaacgtcctttaaggtaaccaggtacaaaccgaaaccgtaggaacccgacgtaccctaccgtaagtcctcggaccttacctaagtttacgcggaactacgttacccggtacccgggtaagttccccgggtacgtacggccgtaacgtttcggacggtacggtcggtaacggtggtaccgtagggtacctaggttaccgttacacgtaaccgtagtaatacgtagaccgtacgtacccgtgaaccggaagtttacgaagtaaacggtcgtaaccggttacgtaacgttttaactttagttacccctagacccgttaataaccgttaatttaaccttaacgttaaccccgttaacccgggttaccttaccgggtaccgacccggtaaacggaacccgggtagggtacgtaaaccgtaacgtaacccggaaaacggttcttaacggtaccgtacggaacccgtacccgtccggttaattaacccg

SEQ ID NO: 155777 - DNA, 717 bp, Homo sapiens
  misc_feature: GYAE6OF01DXEDD.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtcctccagacctccctggctgttggtttcgtgggcgaggacgggccaccatcaactcgacaacgtccagccaagtaactttattttaatatacgtcctaccaaaacaaacgttaaagtaaactttaacgttaacgtacgtttacggtaaccaggtaccaacggaaaccaggacacgtcctactagctgacctatacgtttacgaggactacgttaccggtaacccgggtaacgttcccgggtacctacgtaccgtactttacgaggtcggacgtacggtcggtacgtacgggaactaggtactttaccacgttactcgtaagttacgttacgacgtacgtccgtacgcgtacgacgtagtaagtcgtggtcgtactttagttttactacgttcgtactaagtactaacgtttacttaaccgttacccgttacccggttaccccgtacggttaccgggtaaccggaaaccggtaacggtaacgggtacggtaagtaccggtaacctaaacggtacgttacggtcgtacgtaccgcctaccgttagttaccgg

SEQ ID NO: 155778 - DNA, 761 bp, Homo sapiens
  misc_feature: GYAE6OF01DJS05.29.67.G01.1.454.CMB.1.raw
  modified_base (205)..(205): a, c, t, g, unknown or other
  misc_feature (205)..(205): n is a, c, g, or t
  modified_base (261)..(261): a, c, t, g, unknown or other
  misc_feature (261)..(261): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (429)..(429): a, c, t, g, unknown or other
  misc_feature (429)..(429): n is a, c, g, or t
  modified_base (527)..(527): a, c, t, g, unknown or other
  misc_feature (527)..(527): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctcgtggtgcccgtacggggacagtcgtgatcgaccccagtcctccagacctcccgtggcttggttcgttcgngggcgaggcggccaccgatcaactgacaacgtccagaccaagtaatttaattttanatacgtcctaaccaaacgtaaagtaaacgtaatttaacgttagtactttacggtaaccagtaccaacgaaaaccgtaggaacctacggtaccctaccgaagtcgtnaccttctagtttacgnggtactacgtccggtaacccgggacgtccgggtacctcgaaccgtnttcgacggtgaccgtagggtcggtaccgtgggtactagttacctttacgaactcgtaacgttaagttacgttacgacgtacgtacccgtcggaaccgngggtaccgtaagaacggttcgttcggacgttactttaagtttcttaacgttacgtacgaagttacttaacttaacgtttacctaccgttaaccccggttaccggggtaaccgttcccgggaaccggaacgggttaaaccggtaacggggtaacggttacggtaaaaccgtaaaccggtaaacggttaccgttacgggtacggtaaccgtcgtaacccgaacgttcgttacccgg

SEQ ID NO: 155779 - DNA, 687 bp, Homo sapiens
  misc_feature: GYAE6OF01B1I5T.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtcctccacgactccctggctgttgttcgtgggcgaggacggccaccatcaactcgacaacgtccagaccaagtaacttatttatactacgacctaccaaactaataagtaattacttagcttacgtaccagacaacgaaccaggacacgcctacgtacgctcgctactattacgcggtactacgtaccgtaaccgggtacgtcccgggtacctacgtaaccgtattcgacggtgacgacgggtcggtacgtacgggactaggttactttaccgactaccgttacgtaggttaacttacggactacgtccgtacggcgtacggtactaggaacgttcgtcggtacgtacctttaagtttacttacgtcggtactaacgtacttaacttacttaaccttacccgtaccggtaccccggtaacggttaccggaaccggtaacgggtaaccgtaacgggtacggtaacgtaacgtaaaccggaaacgtacgtaggtaccggtacgacgtacctacgtcgttaccg

SEQ ID NO: 155780 - DNA, 709 bp, Homo sapiens
  misc_feature: GYAE6OF01A7FCY.29.67.G01.1.454.CMB.1.raw
  modified_base (195)..(195): a, c, t, g, unknown or other
  misc_feature (195)..(195): n is a, c, g, or t
  modified_base (248)..(248): a, c, t, g, unknown or other
  misc_feature (248)..(248): n is a, c, g, or t
  modified_base (338)..(338): a, c, t, g, unknown or other
  misc_feature (338)..(338): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagacctccctggcttgtgtttcgngggcgaggacgggccaccatccaactgacagtccagccaagtaattattttanatagctaccaaacaataagtaattacttagcttaggtaccagcaacgaaaccgagacagtccctacgtaagcctgcctacgtatttacgnggacacgtaccggtaccccgggaaggtccccgggtacctcggacccgtagttcgacggtcggacgcggtcgggtcgtagggactacgtactttaccacgtacttacgtacgttattacgcgtacgtcctacggaccgtaggacgtagaacgtagttcggtacgtacgttaacttttacgttaccgtcgtacgtaacgtaacttaagtttaactttaaccgttacccgttaaccccggttacccccggtaacggttcccgggtaacccggaaacggggtaaccggtaacgggtagggaccgtaacgttaaacccggtaaacggtaacgttacgggtaccggtacgtaccgtaaccgtaccgttaccgtaccg

SEQ ID NO: 155781 - DNA, 683 bp, Homo sapiens
  misc_feature: GYAE6OF01E3TOU.29.67.G01.1.454.CMB.1.raw
  modified_base (197)..(197): a, c, t, g, unknown or other
  misc_feature (197)..(197): n is a, c, g, or t
  modified_base (373)..(373): a, c, t, g, unknown or other
  misc_feature (373)..(373): n is a, c, g, or t
tcagatagagtactcacgaccggtgctcgatttagagtatacatattgggtttgggggagctacaacaggcaggcaggggcagcaagatgggtgttgcagaccccaggtcttcattttctctgttgctctggatctctggtgcctacggggacatcgtgatgaccccagtcctccagacctccctggctgtgtttcngggcgagacgggccaccatcaactgaccaagtcccagccagtaattattttatatacgccttaccaaactaaataagtaatttaccgttaagtcctttaggtaacccagtaccgaaacgaaacccgaggaccacgaccccttaccaaaggtccctagaccttactattttaaccgngggcctacgttaccccggtaacccggggtaactcccggggttcccctggtaaccccgtattccggaggtcggtaccgagggtccgggttacgtagggactagtaacgtttccaacgtactcacggttaacttacgccacggtctacgcgaggctaggaagagtcgtcgtactatttactagtcgtactaacgataacttaagttactaacccgttcgtaccccggacgtcggtaccgtaaacgggaccctaagggtcggaagtaacgtaacgtaaaacggcgtaggtacgacgtacgacctccaagttcc

SEQ ID NO: 155782 - DNA, 686 bp, Homo sapiens
  misc_feature: GYAE6OF01DLW5W.29.67.G01.1.454.CMB.1.raw
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
tcagatagagtactcacgaccggtgctcgatttagagtatacatattgggtttgggggagctacaacaggcaggcaggggcagcaagatggtgttgtagacccaggtcttcatttctctgttgctctggatctctggtgccgtacggggacatcgtgatcgacccagtcctccagacctccctggctgttgtttcgtgggcgaggacggccaccatcaactgaccaagtccgacgaccaagtaatttatttatatacgctaccaaactaagtaataatttactagtcgttacggtaaccagacaacgaaacgaggacncgtacctacctaagctgcctactagttacgnggtcctacgtaccggtacccggtacggtcccggtacctcgacgtactcgagcggcgacggtccggtcgagggactaagtcttacactactacgtagttacagacctacgtcctaggcgtacggtacgtagacggtagttcggtaccggtattacgttttactaccggttactagacgttaactaacgtttacgttaaccgttacccgttacccgttacccggtacgggttaacccggaacccgggtaacgggtaaccggtaagggtcgaaacgtaacgaacccggtaaaacgtacgttacggacggttcccaacggtacaccgttcgtcggttaccg

SEQ ID NO: 155783 - DNA, 873 bp, Homo sapiens
  misc_feature: GYAE6OF01EP83O.29.67.G01.1.454.CMB.1.raw
  modified_base (212)..(212): a, c, t, g, unknown or other
  misc_feature (212)..(212): n is a, c, g, or t
tcagatagagtactcacgaccggtgctcgatttagagtatacatattgggtttgggggagctacaacaggcaggcaggggcagcaagatggtgttgcaggacccaggtcttctattttctctgttgctactggatctcgtggtcgccgtacgggactagtcgtgagtcgaccctgtcctaccagtacctcccgtggtcttgttcgtttcggngggacgacggaccggtcccaaccgataccgtaactcgacgaacgtcccaacgtaccgtaaagttaactttaatttatacgtacggtacctaaccgaaaataaagttaacgtaaacttttacggtacgtaccggtttacggaaccacgaacaaaccggaaacgtacgaaccaccgtcccgtaaacgtaacggtcctcgtaccgttactttaaccgttacggtacgaccccgttaacggttaccccggggttaaaccccgggtaccgggtttaccccggggtaccgtaaccggttacccggtttaacgtaccggtaacgggttccgggaccggttaccggggtccggttacggggtaccgtaaacgttacggttaactaacccgttaacgtccgtttaagtaacggttaccgttaggacccgtacctcggtacggaccgtagggtacttaagggacgtttacgtcggtaaaccgtttctttaacgtttaaccgtgtaaccgtcgaaacttacgttaaacttacccgttaaccgtaaccccgtccccgggtttccggaaacggtccgggtaaccggtaaacgggacgggttaaacgggtcgaaactacgtaacggtaaacccggttggaccgttacggaccgtagaccccttgtacgtttaccg

SEQ ID NO: 155784 - DNA, 693 bp, Homo sapiens
  misc_feature: GYAE6OF01A5EK9.29.67.G01.1.454.CMB.1.raw
  modified_base (258)..(258): a, c, t, g, unknown or other
  misc_feature (258)..(258): n is a, c, g, or t
  modified_base (349)..(349): a, c, t, g, unknown or other
  misc_feature (349)..(349): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagacctcccgtggcttgttgtttcgtgggcgtaggacggacccaccatccaacgtcgacaacgtccacgccaagtaattattttanatagcctacaactaataagtaatttactagtcttacgtaccagacaacgaaccaggacacgtcctactaagctgaccttactacgtttacncgggtaccacgttacccggtacccgggtaacggtccccgggtaccctggaaccctagttcgacgtcgggacgtacgggtcggttacgtcggggaactacggtactttaccaccgttaacgtaccgtaagttaacgtacgtccgtaacggccccgtaggacgaacggtacgtaagaagtcggttagtccggtacctttaagtttacttacgtgtaccgtataacgtaaatttaccttaacgtaccgtaccccgttaccggtacgtccgggtaaccgacgggtacccgaagggtagtactaacggtaaacgaacgtacgtgtacggctaccgactaactcggttcc

SEQ ID NO: 155785 - DNA, 956 bp, Homo sapiens
  misc_feature: GYAE6OF01EDPI8.29.67.G01.1.454.CMB.1.raw
tcagatagagtactcacgaccggtgctcgatttagagtatacatattggggtttgggggagctacaacaggcaggcaggggcagcaagatggtgttgcagacccaggtcttcatttctctgttgctctggactctcgtggtcgccgtacggggactagtcgtagactacgaccctagtcctccacgtacctccgtggtcttgttggttcgtgggcgaggacggccactatcaacgtcgacaacgtccgaacgacctaagtaatttatttatacgtacgtacctaactaaactaaagtaaacgttaactttaacgttacgttaccttacggtaaccgaacgtaaccgaaacggtaaaccgacggaaccgtaccgtaccgttacccgtaaaggtcccttacggtacccttaacgtttaacgtttaccgggtacgggtaccttaaccgggttaacccggttaaacccggggtacccggttccccggggtaacctacggtacccgttacggtacggtaccggtcggggtaccgtaacgggggtccgggtacggtacggggtaaaccgttacgttaaccgttaccgaaacgttccgttaacggtaacgttaccggttaacggacccgtacgtacccggtaggaaccggtagggttaccggtaaggtaacgggttcgttaccggttacgggttaaccttttacgtttttaacgtacggttacttacggtaaaccgttaacttaaacgtttaaacccgtttacccggttaaccccggttttaacccccgggtacccgggttaacccgggttaacccgggttaaacccgggggtaaacgggttaacccggggttaaacggggtaaccgggtaaaaccgggttaaacggttaaccgggaaaacccgggtaaggttcggttaaacgtaccgggtaaccctacggttacccgtccggttttaaccgg

SEQ ID NO: 155786 - DNA, 713 bp, Homo sapiens
  misc_feature: GYAE6OF01EUH4H.29.67.G01.1.454.CMB.1.raw
  modified_base (192)..(192): a, c, t, g, unknown or other
  misc_feature (192)..(192): n is a, c, g, or t
tcagatagagtactcacgaccggtgctcgatttagagtatacatattgggtttgggggagctacaacaggcaggcaggggcagcaagatgggtgttgcagacccaggtcttcatttctctgttgctctggatctctggtgccgtacggggacatcgtgatgacccagtctccagactccctggctgtgttcngggcgagacggccaccatcaactgacaagtccagccaagtaattattttatatagcctaccaacaaataaagtaattacttagcttaggtaccagacaacgaaaccaggacagcctacctaagctgtctactactttacgtgggactacgtaccgtaaccccgggtaacgtccccggggtaccctacggtacccgtattcgaggtggacgtacgggtcgggtacgtacggggactaggtactttaccaacgtacctacgtaagttaacgttacgacgtaacggtcccgtacggacgtaacgggaccgttaagggaaacggtaggttacggtacggtacctttaaagtttttaacgttaccgttaggtactaacgtaactaaagtttaacttaacttacccttacccggtaccccgggtaacgttccggaacccggtaaacgggaaccgtaacgggtacgggtaagtaacgtaaccgaaacggtaacgtacggtacggtacgtacgtccaaccgtcgttccg

SEQ ID NO: 155787 - DNA, 782 bp, Homo sapiens
  misc_feature: GYAE6OF01BGI1O.29.67.G01.1.454.CMB.1.raw
  modified_base (212)..(212): a, c, t, g, unknown or other
  misc_feature (212)..(212): n is a, c, g, or t
  modified_base (269)..(269): a, c, t, g, unknown or other
  misc_feature (269)..(269): n is a, c, g, or t
  modified_base (769)..(769): a, c, t, g, unknown or other
  misc_feature (769)..(769): n is a, c, g, or t
tcagatagagtactcacgaccggtgctcgatttagagtatacatattgggtttcgggggagctacaacaggcaggcgaggggcaggcaagatggtgttgcagacccaggtcttcatttctctgttcgctcctggatctctggtcgaccgtacggggacctagtcgtgaactccgaacccagtcctccgaagcctccctggtctgttgttcgngggcgaggcggccctaccatcctaactgactaacgtccagaccagtaatttatttanacggtactacctaaccgtaaataagtaaacgtaactttaccgtagtcgttacggtaaccacgacaacggaaaccgaggtaaccacggtacctaccgttaaggcctaggtaccttaacttacgtttacggtcgggtacttaaccggtacccggtaacccgggaaccgttccccggggtacctaacgggaccgttaacggtttcccggggacgtaccggtacggggtccgggttacgaacggggtactaacggtttactttacccgaacgtacgttaccgtaagtaacgttacggaaccgtacgcccgttagaccggtagtacgtaaggacgtagtacggtcgtaacttacgttacgttagaccgtacgtacacgttaactaccgttaactaccccgttaccgtaacccggtcggtaaccgtacccgaacgggtaaccgtagggtaaccggtaacgtactaaccggtaaacgtcggtaccgtacgtacgtaaccgacctacncggttcttacccg

SEQ ID NO: 155788 - DNA, 625 bp, Homo sapiens
  misc_feature: GYAE6OF01AQEOZ.29.67.G01.1.454.CMB.1.raw
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (386)..(386): a, c, t, g, unknown or other
  misc_feature (386)..(386): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagacctccctggctgttgttcgtggggcgaggacgggcccaaccataccaactgacgaagtccagccaagtaattattttanatacgctaccaaanaataagaattactagtcttacggaccagacaacgaaccaggacacgcctacaagtctgctactacgttgtcgggactacgtaccgtacccgggacgtccgggtcctagaccgtatcgnggtacggcaggtcggtcgacggctagttactacactactgacgttagtacgcacgtcgtagaccgaggtactaggacgtagtacgtcggtacttaatttcgtagttcgcgaatacttaaattattacctaccgtaccctaccggtacgtccggtaacgtaaccgggtaccgaaggtcgtaggaacctacgtaaaccgtaaggtcggtacggaccgtacggtactaccgtgtttaaccgg

SEQ ID NO: 155789 - DNA, 741 bp, Homo sapiens
  misc_feature: GYAE6OF01CDL89.29.67.G01.1.454.CMB.1.raw
  modified_base (181)..(181): a, c, t, g, unknown or other
  misc_feature (181)..(181): n is a, c, g, or t
  modified_base (213)..(213): a, c, t, g, unknown or other
  misc_feature (213)..(213): n is a, c, g, or t
  modified_base (278)..(278): a, c, t, g, unknown or other
  misc_feature (278)..(278): n is a, c, g, or t
  modified_base (577)..(577): a, c, t, g, unknown or other
  misc_feature (577)..(577): n is a, c, g, or t
tcagatagagtactcacgaccggtgctcgatttagagtatacatattgggtttggggagctacaacaggcaggcaggggcagcaagatggtgttgcagacccaggtcttcatttctcttgttgctcgtggtatctcgtggtcgccgtacgggactagtcgtagactcggaccctagttccnccgacgccgtcccgtggcttggttcgttcggngggacgaggaccggaccacctatacaacgtcggacaacgtccgacgacgtaagtaatttatttanagtacgtacctaaccgaaaataaaagttaaacgttaacttaacgttacgtaccgtttaacggaaccaaggaaccgaaacggaaaccgaaggtaaccaccggtacccttacgaacgtcctacgtaccttaagttacgttacggcgtaacctaccggttacccggtaaccggtaccggtccggtaccctaggtaaccgttagtacgcggtacggacgtgggtacggtacgtaggacttacgttataccgagtacctagtaacgtactcgactacgtcgtacgacgagttacgaaggacgtntaccgtacgtaacctttaagttctacgtactacgtaactacgttaaactttaccgtaccgtacccttaccggtacccggtaacgtaccgggaacgaaacgggtacgaacggttaacgaagtacctaaccggaaacttggacgtagtacacgctaacgtgttccg

SEQ ID NO: 155790 - DNA, 971 bp, Homo sapiens
  misc_feature: GYAE6OF01CK0R5.29.67.G01.1.454.CMB.1.raw
tcagatagagtactcacgaccggtgctcgatttagagtatacatattgggtttgggggagctacaacaggcaggcaggggcagcaagatggtgttgcagaccctaggtcttctatttctcgttgttgctctggactctcgtggtacgtcccggtaaggggactacgtcggtggtactacgtacccgtacgtcctaccacggtacccttcccggtgggtctttcggtttcggtttaccggaggggaccggtaacgggaccgggaccctaaccgtacgtaaccgtaaccgtaccgacgtaaccgtacccgtaacgtaaccgtaaaggttttaacttttaagtttttaacgaacgttaccgtacccttaaaacccgtaaaaattaaaacggttaaaacgttttaaaccgttttaccgttaaacggttccgggttttaacccggaaaccgacgtaaacccgaaaaccggtaaaccccgaacgggtaacctacccggttaccccgtttaacctaacgggttccctacgtacctttaaccgttaacggttttaccggacggtacccctaacgggttaacccgggttaaccccggggttaccgtcccgggttacccctaggtaacccgttagtaccggacgggtcggaaccggtcgggtaccggtagacgggttaaactcgtaaccttcaaccgtgtaacgttagtacgtcgtaccgtcgtacgacgacggtaacgtacgtaagtaacgtcggttacggtacttacgtttaacgttacgtacgttacgaacgttaacgttaacgttaacgtttaaccgtaccgtttaacccggtaccccggttaccggttaaccggtaacccgggtaaaccgggtaaaccgggtaccggtaagggttaacccggaaagttaaacccggtaccggttaaacggtaaccgtttcgggaccgtaacgtacccgaactttccgtacgtttcg

SEQ ID NO: 155791 - DNA, 710 bp, Homo sapiens
  misc_feature: GYAE6OF01E3AAP.29.67.G01.1.454.CMB.1.raw
  modified_base (266)..(266): a, c, t, g, unknown or other
  misc_feature (266)..(266): n is a, c, g, or t
  modified_base (377)..(377): a, c, t, g, unknown or other
  misc_feature (377)..(377): n is a, c, g, or t
  modified_base (699)..(699): a, c, t, g, unknown or other
  misc_feature (699)..(699): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtgccgtacggggacatcgtgatcgaccctagtcctccacgtacctcccgtggcttggttcggtttccgtggggcgaggacgggcccaccatacaactcgactaacgtccagaccaagtaattatttanatacgcctaccaactaaataagtaacttacttagtccgttacggaccagaccaaacggaaaccgaggaccacgtcccttaccgtaagtctcgtaccttacgtagtttacgnggactacgtcccgtaacccggggacgttcccggggtacctacggtaaccgtagtaccgaggtcggaccgtacgggtcggttacggtacgggactaaggttacttaccaactacgtacgtaacgttacgtacgactacgtccgtagacgaggtactagagtacgtcgtacgtacttaagtttactacgtcgtacgaagtactaacttacttactacccgtaccgtcccgggtaacgttccgggaacccggtaaacgggaaccgtaagggtacgtaacggtaacgtaacgtaaaccggtgttacggtccggtacgtacgtaccncgtacgttccg

SEQ ID NO: 155792 - DNA, 759 bp, Homo sapiens
  misc_feature: GYAE6OF01CKEIM.29.67.G01.1.454.CMB.1.raw
  modified_base (180)..(180): a, c, t, g, unknown or other
  misc_feature (180)..(180): n is a, c, g, or t
  modified_base (248)..(248): a, c, t, g, unknown or other
  misc_feature (248)..(248): n is a, c, g, or t
  modified_base (364)..(364): a, c, t, g, unknown or other
  misc_feature (364)..(364): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtagccgtacgggacatcgtgatgacccagtctccagcctccnggtctgttgttcgtgggcgaggacggccacctatcaactgacaacgtccagaccagtaattagtttanatagcctaaccaaataataaagtaatttaactagtaccgtttaggaaccagacaaacgaaacccgaggaacctacgtacccttacgtaacggccttagacttacttagtttaacgngggtaactaccgtaccgtaaccccggggtaacgttcccggggtacctaggacctacgttacggaacggttcggaacgacgggtcggttacgaggggaactagtacctttacaacgttactacgtaagttaacgttacgccgtacggcccttacggaacggtaacggtaccggttaagaaacgggtacgtttacgggaccgtttaaccttaagttttaacgttaccggtttacgaaacgtagtaaaccctaaagtttaaccttaaccgttaacccttacccgggtacccggtaaccggttaccggtaccgggaaaccggtacgtaacgggtaaggtaagtaaccgttaacgaaaaccgttacgtacggtacgtacctagaccctaacgtcttacgg

SEQ ID NO: 155793 - DNA, 656 bp, Homo sapiens
  misc_feature: GYAE6OF01E3JTJ.29.67.G01.1.454.CMB.1.raw
  modified_base (323)..(323): a, c, t, g, unknown or other
  misc_feature (323)..(323): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctaccaacaataagaattacttagtcttggtaccagccaagaaaccaggacacgcctacctaagctgctctacgtttacnggcacgtccgtaccgggactcccgggtcctagaccgatcgacggtggcgacggcgggtcgtacgggactagtactttccactacgtcaacgttattaacgccgtaagtcccgttaggccagggtctaggaagtagttggtacggtaccttaagttttacttacgtgttcaaggtactaagttaattaacttaccgttaaccccgtcccggggtaacgttccgggaacccgtaaacggggtaacccgtaaggggtacggtaacggtaacgtaaccggaaaaccggttaacgtacgggttacggtaccgaacggtaccgtacctacggttacccg

SEQ ID NO: 155794 - DNA, 741 bp, Homo sapiens
  misc_feature: GYAE6OF01CLJYJ.29.67.G01.1.454.CMB.1.raw
  modified_base (170)..(170): a, c, t, g, unknown or other
  misc_feature (170)..(170): n is a, c, g, or t
  modified_base (205)..(205): a, c, t, g, unknown or other
  misc_feature (205)..(205): n is a, c, g, or t
  modified_base (352)..(352): a, c, t, g, unknown or other
  misc_feature (352)..(352): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtgccgtacggggacagtcgtgactcgaacccngtcctccagaccttcccgtggcttggttgtttcgnggacgagacggccaccatcaacgtcgacaacgtccacgaccaagtaattagttttacaatcgtacctacaactaagtaagtaacttacttacgtcgttacggtaacacgaccgtaaagaacccgaggaccacggtacctacgtaacnccgtgcctacgttaacgtttcgcggtacaccgttaccgaccgggtaaccgtcccgggtaccacgtaccgtactcgaggttcggaacgtcgggtccggtaggtcgggtaactacggtaactttccaacgttacctacggtagttaacgttacgtccgaagtccgttagcgtaacgtcgtagtaacgtagttccggacgttactttaacgtttacgtattcggtaactaccgtaacgttaatactttaaccgtaccttaccccggtacccggttaccggtaccggtaccgggtaaaccgggaacgttaccggggtaagaacccggttaacgtaaaccgtaacgtaaacggcggttaccgacggttacgacccgtaaaccttcgttaaccgg

SEQ ID NO: 155795 - DNA, 660 bp, Homo sapiens
  misc_feature: GYAE6OF01D4R2O.29.67.G01.1.454.CMB.1.raw
  modified_base (240)..(240): a, c, t, g, unknown or other
  misc_feature (240)..(240): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacgggacatcgtgatgacccagtctccagactccctggcttgtgtttcgtgggcgagagggccaccatcaactgcaagtccagccagaattattttanatagctacaacaataagaattactagcttggtaccagacaagaaaccaggacagcctacgtaagctgctctatttacgtggacacgttccgtaacccgggtaacgttccccggggtccctaggaccgtattcgaggtggcgagggcgggtctacgggactagtactttccaaccgtacgtctaaggttattaacggctaacggtccctggacgtaacgggactaggaaagtcgtacggtcggtaccttaagtttttaacgttaccgttagggtacccaaggttaacctaagtttacttaaccttaccgttacccgtaccccgggttacggtaccgtaccggaaaccgggtaccggtaaagggtcggaagtaactaacgaaaccgtacgttacggtacggactacggtccaccgtcgttcg

SEQ ID NO: 155796 - DNA, 676 bp, Homo sapiens
  misc_feature: GYAE6OF01COQDI.29.67.G01.1.454.CMB.1.raw
  modified_base (123)..(123): a, c, t, g, unknown or other
  misc_feature (123)..(123): n is a, c, g, or t
  modified_base (266)..(266): a, c, t, g, unknown or other
  misc_feature (266)..(266): n is a, c, g, or t
  modified_base (380)..(380): a, c, t, g, unknown or other
  misc_feature (380)..(380): n is a, c, g, or t
  modified_base (500)..(500): a, c, t, g, unknown or other
  misc_feature (500)..(500): n is a, c, g, or t
  modified_base (635)..(635): a, c, t, g, unknown or other
  misc_feature (635)..(635): n is a, c, g, or t
  modified_base (663)..(663): a, c, t, g, unknown or other
  misc_feature (663)..(663): n is a, c, g, or t
tcagatagagtactcacgaccggtgctcgatttagagtatacatattgggtttgggggagctacaacaggcaggcaggggcagcaagatggtgttgcagacccaggtcttcatttctctgttnctctggatctctggtcgccgtacggggacatcgtgatcgacccagtcctccacgactccctggcttgtgtttcgtgggacgagacgggccacctataccgaactcgaccaaacgtccaacgaccaagtaatttaacttttaanatacgtcctaaccaaactaaataaagttaaacttacttaagtcgtttacggtaacacgactaaacgaaccgaggacacgtaccctacgtaacgcgtcgactacttatttacggnggacctacttacccggaccgggtaaccgtccgggtaccctggtaacctagttcgaaggtcggcgacgggtcggttacgcgggactaggttaccttacaacctacgttacgtaagttaagngtaccaccggtacctcggacgtacggacgtaggtaaactagtcggtacgtctttaaatttcgtacgtataacgaacgtactaagttacttactacccgtacgtccgaacgtccgacggacggtacgaaggtgtanacgaaactacgaagttggccgttacganacccgtatgtacg

SEQ ID NO: 155797 - DNA, 136 bp, Homo sapiens
  misc_feature: GYAE6OF01BJKYY.29.67.G01.1.454.CMB.1.raw
  modified_base (130)..(136): a, c, t, g, unknown or other
  misc_feature (130)..(136): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnnnn

SEQ ID NO: 155798 - DNA, 737 bp, Homo sapiens
  misc_feature: GYAE6OF01CKJ72.29.67.G01.1.454.CMB.1.raw
  modified_base (249)..(249): a, c, t, g, unknown or other
  misc_feature (249)..(249): n is a, c, g, or t
  modified_base (355)..(355): a, c, t, g, unknown or other
  misc_feature (355)..(355): n is a, c, g, or t
  modified_base (721)..(721): a, c, t, g, unknown or other
  misc_feature (721)..(721): n is a, c, g, or t
  modified_base (728)..(728): a, c, t, g, unknown or other
  misc_feature (728)..(728): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacgggacatcgtgatcgacccagtctccagactcccgtggctgttgttcgtgggcgagacggccacatacaactgacaagtccagaccaagtaatttaatttaanatagacctacaaactaaataaagtaattaacttagtcgttacggaccagacaacgaaaccgaggaaccacgacctacgtaacgctacgactacttaacgtttacgngggtacctacgttacccggtaaaccgggtaaccggttcccggggtcccctacggtaaccgttacgtacccggtaaggtcgggaaccgtcggggtaccgggttcggtaacgggactaacggttaccttaccgacctacgtacgtaaggttactacgtaccgacgttccggagtaccggaacggtagtaacggaaaggtttcgtaccggtacgttaaccttttaagttttaacgtaccgtacggtaaccaagttactaaaactttaccttaaaccgtaacccgttacccggttacccggtagttacccgggaacgtaaaccgggtaacgagggtaacgaagtactaaaccgaagtacgttgcggtacngtaaccngttaccgtg

SEQ ID NO: 155799 - DNA, 702 bp, Homo sapiens
  misc_feature: GYAE6OF01AZRHN.29.67.G01.1.454.CMB.1.raw
  modified_base (190)..(190): a, c, t, g, unknown or other
  misc_feature (190)..(190): n is a, c, g, or t
  modified_base (235)..(235): a, c, t, g, unknown or other
  misc_feature (235)..(235): n is a, c, g, or t
  modified_base (317)..(317): a, c, t, g, unknown or other
  misc_feature (317)..(317): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttcnggcgagaggccaccatcaactgcaagtccagccagaatattttanatagctaccaacaataagaatttactagcttaggtaaccagacaagaaaccaggaccagcctactaagctcgctcatttacnggctagtccgtaccgggatcccgggtccagtaccgattcgaggtcggcgaggcggtcgtagggactaggtactttccgaacgtacttaccgtaagttaacgttagaccgtaacggcccttaggaccggtacgggtaccgttaggaaacgttagtttaccggacccgtttaacgttttaacgttaccgttacgttaccgtaacgtaacccttaaagtttaacgtttaacgttaaaccgtttaccccgtaacccccgggttaacgtacccgggtaccgtaacccggggtaaaccggtaacggggtaacggtaaccggtagtaaccccgtaaaacgacggttaacgggtacgtaccgtacgtacccaacccgtacgtccgttaaccgg

SEQ ID NO: 155800 - DNA, 744 bp, Homo sapiens
  misc_feature: GYAE6OF01DIOK1.29.67.G01.1.454.CMB.1.raw
  modified_base (252)..(252): a, c, t, g, unknown or other
  misc_feature (252)..(252): n is a, c, g, or t
  modified_base (573)..(573): a, c, t, g, unknown or other
  misc_feature (573)..(573): n is a, c, g, or t
tcagatagagtactcacgaccggtgctcgatttagagtatacatattggggtttgggggagctactttaacaggcaggcaggggcagcaagatggtgttgcagacccaggtcttcatttctctgtgctctggatctcgtggtcgccgtacggggacagtcgtgagtcgaccctagtcctcacgctcccgtgcttgttgttcgtggcgaggcggccacatacactgacgatccacgccaagtacttattttanatacgcctaacaaactaataagttattacgttagtacgttacgaccaggaccaaggaaacccaggaccacgtacccgtacgtacgtaccgtcgaccgttattaacttcggcggtacctaaccggtaccggtaaaccccgggtacggttccccgggtaccttacggaaacccgttggttacgacggggttccgacggtaacggggttcccggttaacgggtacggggtaaaccttaacggttttaacctttaacccgaacgttacccgttaacgttaacgttaacggtaccgtacgaccgtacgttcgacggtagcgtaagngtagtcgtacggtattacgttacttacggtactactaacgtataacttacgttacttacccgttaccgtcccggttaccggaccggtaaccggtaaaccggtacgggtaacggtacggtaagtaccgtaaagaaccgttaacggtcgtactacggacgccgtactcgtacg

SEQ ID NO: 155801 - DNA, 775 bp, Homo sapiens
  misc_feature: GYAE6OF01EYC16.29.67.G01.1.454.CMB.1.raw
  modified_base (262)..(262): a, c, t, g, unknown or other
  misc_feature (262)..(262): n is a, c, g, or t
  modified_base (373)..(373): a, c, t, g, unknown or other
  misc_feature (373)..(373): n is a, c, g, or t
tcagatagagtactcacgaccggtgctcgatttagagtatacatattggggtttgggggagctacaacaggcaggcagggggcagcaagatgggtgttgcagacccaggtcttcatttctctgttgctctggatctctggtgccgtacggggacatcgtgatcgacccagtctccagacctccctggcttgtgtttcgtgggcgaggacgggcccaaccatccaacgtcgaccaacgtccacggccaagtaatttattttanatacgacctaccaaacaaataaacgtaatttacgttagtacgtttacggtaccagacaacggtaaaccaggaaccacgcctacctagacctgacctacgtacgttttacgngggtacctagtacccgtaacccggggtacgttccccggggtcctacggaccgtacgttacgacggtcggacgtacgggtcgggttacggtacgggtaacgtacgtacttaccaacgtacctagtaacgttactagacctacgtccgtcgacgtcgggactagggaacgtggttcggtacggtacctttagtttaacttcgtacgtacaacggtactaaactttaacttaccgttaacccgttaacccggtaccccgggtaaccggttaccgggtaacccggtaaaccgggggtaaccgtaaacgggggtaccggtaaaggtaaccgttaacccgggtaaaaaccgttaccgggttacggttaccgggacccgttaaggcccgttaaccgacggttttacccg

SEQ ID NO: 155802 - DNA, 779 bp, Homo sapiens
  misc_feature: GYAE6OF01AL4JW.29.67.G01.1.454.CMB.1.raw
  modified_base (140)..(140): a, c, t, g, unknown or other
  misc_feature (140)..(140): n is a, c, g, or t
  modified_base (256)..(256): a, c, t, g, unknown or other
  misc_feature (256)..(256): n is a, c, g, or t
  modified_base (364)..(364): a, c, t, g, unknown or other
  misc_feature (364)..(364): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcnccgtacgggacatcgtgatcgacccagtctccagacctcccgtggcttgttgtttcgtgggcgaggacgggccaaccatcaactcgcaacgtccacgccaagtaactttattttanatacgccttaccaaacaaataagtaacttacttagcgtttacggtaccagacaacggaaaccgagaccacgtacctacctaacggtctacgtctacttagtttacggngggtactaacgtacccggttaacccggggaaccggttcccgggtacccgtacgtaaccggttacttaccgaggttcggacggacgggttccgggtacggtacgggtaacgttacggtactttaccgacgtaccttacgtaacgtttaaagtccgacgttacgcccgttaggcgtaacggtacgtaaggaacgggttatacggtttaccggttaactttaacgttttacgtaacgttacgtaacgtacgtaaacctttaaagttaacgttttaaccctaacccgtttcccccggttaccccgggtaaggttacccgggtacccggttaaaccgggtaacggtaacgggtacggtaactaacggtaaactaaccgggtaactgggttacgacccgttagacccttaacgtacttccg

SEQ ID NO: 155803 - DNA, 854 bp, Homo sapiens
  misc_feature: GYAE6OF01ENCK7.29.67.G01.1.454.CMB.1.raw
  modified_base (668)..(668): a, c, t, g, unknown or other
  misc_feature (668)..(668): n is a, c, g, or t
tcagatagagtactcacgaccggtgctcgatttagagtatacatattgggtttgggggagctacaacaggcaggcaggggcagcaagatggtgttgcagacccaggtcttcatttctctgttcgctcgtggactctcgtgggtcgccgtacggggactagtcgtgatacggacccagtactccgagacctccgtggtcttgttcgttcggtagggacgacggtacggcccacactacctaacgttcgaccgtaacgtcccgaagaccgtaaagttaaacttttaagttttaactacggtacgtacccttaaccaaagtaaaacttaaaacggttactttaacgtacgtaccgtttaaccggaaccgtaagaaccgaaaccgaaaaccggtaggtaacctaaccgtcccgttaacgtaacgtacctcggttaacctttacgtaacgttttaccggcgggtacctaaccgttaacccggggtaacccgggtaccggttcccgggtaccttacggaacctaacgttcggaaccgtcggtacgcgggtccgtagggtacgacctaagtccttacgacttacgttacgaacgtttactcgtaacgtccggacgttacgacggtaagacgtaagacggttaaacggtcggtaacctttaacgttatttacgttntaacgtacaacgttacttaaattacgttaacctacccccgttaacggtaccccggtacggttaacccggaccggggaaaccgttacccggtaaaggggtctaaagggtaaccgtaaaacggtaaacccggtttaaaggtccgggtacccgtaaggtacccggtaaccttaccgtacgtttacccgg

SEQ ID NO: 155804 - DNA, 671 bp, Homo sapiens
  misc_feature: GYAE6OF01AUPBM.29.67.G01.1.454.CMB.1.raw
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (331)..(331): a, c, t, g, unknown or other
  misc_feature (331)..(331): n is a, c, g, or t
  modified_base (362)..(362): a, c, t, g, unknown or other
  misc_feature (362)..(362): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgaccagtctcagacctcctgctgtgttgnggcgagacgggccacancaactgcaacgcacgacagaacttatttanatacgactaccgaacaaataagtaactttactagacttacgaccagacaacgtaaaccgagacacgtacctactaacgctcgtctactatttacgnggcacgtaccgaccgggaagtccgggtaccncgtacgtactactaggtcgacgtacggtcgggttacagggactaagtacttacgaactacgtactaacgttactacggactagacccgtagacccgaggttaccacgggtaagaggttcgacggtaccttaattttacactttacggacctaaggtaaccttaaattacttaacgtaacccgtttaacccggtacccggtaaccgttaccgggtaacctaaacggggtaaccgtaacggggtaacggacggtaactaaacggtaaaccaacgggttacgtaggtaccgtaaggcctaaccgtacgttcg

SEQ ID NO: 155805 - DNA, 709 bp, Homo sapiens
  misc_feature: GYAE6OF01A7KK0.29.67.G01.1.454.CMB.1.raw
  modified_base (196)..(196): a, c, t, g, unknown or other
  misc_feature (196)..(196): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacgggactatcgtgatcgaccctagtctcagacctccgtggctgttgttcgngggcgaggacggccactatacaactgactacgtccagaccagtaattatttanatacgctaacaanaataagtaacttactagtcgttacggaactacgacaacgaaccgagacacgcctactanctcnctactagttcgnggcctagtccgtaccggacgtcccgggtccagtaccgtatcacggtgccggtcggcgggtacgtacgggaactacggttaccttaccgacttaaccgtagtaacgttacgttacgacgtacgttcccgtagaccggtaacgggacgttaacgggtaacggttacggttacggttaccgggtaccttttaaacggttttacgttaacggtacgttacgtaacgttaacttaacgtttaaacgtttaacccgttaacgttacccccggtaccggttacgggtaaccggttacccggaaacgggtaaccgtaacgggtacgtacggtaactaacggtaacgtacggtacggtacgtcgacgtactacgtcgtacg

SEQ ID NO: 155806 - DNA, 696 bp, Homo sapiens
  misc_feature: GYAE6OF01D91UD.29.67.G01.1.454.CMB.1.raw
  modified_base (233)..(233): a, c, t, g, unknown or other
  misc_feature (233)..(233): n is a, c, g, or t
  modified_base (454)..(454): a, c, t, g, unknown or other
  misc_feature (454)..(454): n is a, c, g, or t
  modified_base (570)..(570): a, c, t, g, unknown or other
  misc_feature (570)..(570): n is a, c, g, or t
tcagatagagtactcacgaccggtgctcgatttagagtatacatattgggttgggggagctacaacaggcaggcaggggcagcaagatggtgttgcagacccaggtcttcatttctctgttgctctggatctcgtggtcgccgtacggggacatcgtgatcgacccagtcctccagacctcccgtggtcttgttcggtttcggtgggcggaggacgggccaccataccaacgngacctaagtaccagaccaagtaaattattttaatagtacacctaaccaaactaaataaagtaaatttaacgttacgtcgtttaacggtacctagacaaacgaaaccgacggtacaccggacctaccgtaagcgtcgtctactatttacggtcgacctaaccgtacccgtacccgggtacgtccccgggtaccgaccgtaccgtactacgtacggtcggacncgggtccggtcgtagggaccaggttactacgtactccttacgtagttactcggtaccgactcccgtaggaccgagggtacaggagtagtcggtacctaactttagtttactcggtntacaagtactaattacttataaccccggttccacccgggttacgtaccggtacggaacgggtacggaagtaggtacgaacgacgtaaacggtgtaccgtaggtccgacctacgtccgtacgttccg

SEQ ID NO: 155807 - DNA, 734 bp, Homo sapiens
  misc_feature: GYAE6OF01B4CPL.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttctatttctctgttgctctggatctcgtggtcgccgtacggggacagtcgtgatcgaccctagtctccagtacctcccgtgctgttgttcgtgggcgaggcggccaccactcactcgactacgtccagaccaagtaactttattttatatacgtacctaaccaaacgtaaataaagttaactttacgttaacgtcgttacggtacacgtaaccgaaagaaaccgaggaccacgtccctaccgtacgtctacgtccttacgttacttacgcggtactacggtaaccccggtaacccgggtacggttccccgggtacctcggtaacctcgttacggacggtgccgggacggtccggtcggtacgggaactaacggttacttacccacgtaactacgttaaggtaacgtacgaccgtacgtaccgagtaccggagtacgtaagagtcgtacgtacgttcttaagtttactcgtcgtagtacgtaattaacttacgtacttaacccgttacccggtaccccgggttagtacccggtaacggacgggtaaacgtaggtaccggaaagtaaccgtaaaccggaacgttacggtaccggtacgtacgtacccgtaccgtacttccgtacccg

SEQ ID NO: 155808 - DNA, 751 bp, Homo sapiens
  misc_feature: GYAE6OF01CF89O.29.67.G01.1.454.CMB.1.raw
  modified_base (563)..(563): a, c, t, g, unknown or other
  misc_feature (563)..(563): n is a, c, g, or t
tcagatagagtactcacgaccggtgctcgatttagagtatacatattggggtttgggggagctacaacaggcaggcaggggcagcaagatggtgttgcagacccaggtcttcatttctcttgttgcctcgtggtctcgtcgtggtcggaccggtaacggggactacgtcggtagacaccggccctagtcctaccacgtaccctcccggtgggtccttggttcgtttcggacgggcggaacgggtcggcccaacctacttacctaaccgttacgaaccgtccgaaccgtacgtaaagttaacttttaatttatacgtaccgtacctaaccaaaagtaattaaagttaacctttagtactacggttacggtaacctaggaaccaacgaacgaggacacccgtacctacgaagctcgtactacgttaacgttcggtagtaccctaacgtacccgggtaccgggtaccggtcccggggtactaccggtacgttaacgtcggtcgggttacggaccgtcggggtcgtacggtaacggactacttagttaccacgttacgatacgttanacgcgtactcgtagacgtacgtaggtagtacgtggtacggttaacgtcctttaaagttctttaggtacctgtaacgttattacgttaccttaccgtaccgttaaccgaccggttacggtacgacgtaaccgggacgaggtacggcgtacgaactaaacggcgtcgtacgcgtacactcgtactcgtcg

SEQ ID NO: 155809 - DNA, 683 bp, Homo sapiens
  misc_feature: GYAE6OF01EQZWB.29.67.G01.1.454.CMB.1.raw
  modified_base (669)..(669): a, c, t, g, unknown or other
  misc_feature (669)..(669): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagcctccctgcttgttgtttcgtgggcgaggacgggccaccatacaactgaccaacgtccagccaagtaattatttatatacgtcctaccaaacaataagtaactttacttagtacgtttaggaaccagacaacgaaaccgaggacacgtcctaccgtaagtcctcgcctactatttacggtcggactacgtaccggtaaccccgggtacggtcccgggtccctacggtaaccgtcgttacgacggtcggccggtacgggtccgggtacgtacgggactagtacgttaccaactacgtacgtaacgttaagttcgacacggtaccgtcgacgtaggtacagggtaactacggtcgtcggtaacctttagtttacgtgttacgcgtaagtactaatttaacttaacttaccgtacccgtacccggtacgtaccggacccgggtaacgaaccggtagggtacgaagtactaaacgtaaccgtagtacggtcgacgtacnccgttactgtcccg

SEQ ID NO: 155810 - DNA, 772 bp, Homo sapiens
  misc_feature: GYAE6OF01ESMXU.29.67.G01.1.454.CMB.1.raw
  modified_base (203)..(203): a, c, t, g, unknown or other
  misc_feature (203)..(203): n is a, c, g, or t
  modified_base (555)..(555): a, c, t, g, unknown or other
  misc_feature (555)..(555): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctgggtcgccgttacggggacatcgtgatcggaccctagtctccagacctccgtggcttgtcgtttcgngggcgaggacggaccacatacaacgttacaacgtccagtaccaagtaactttaattttagaactacgtcctaaccaaattaaagtaaataacgttacttacggctttacggaaccaggacaaagaaaccgaggaacctacgcccgttaaacgtaacggtccgtacgtacctttaaccgtacgtttttaaccgggcgggtaacttaaccggttacccgggtttaaaacccggggtaacggttcccccggggtaccctaggtaaccccggttatttcggaacggttcggaacgtcgggtaccgggtgtaacggggtatacggtaactttcaacgtacttacgtaagttacgtanaccgtacgtcgtaaggccgtaagggtcctaaggtaacgtcgttacgggtcgtaaacccgtttagtttaaactttcggaacgttacgaacggttaacttaacggttacttaacgtaacccgtaccgtacccgttaggtaccgtaacgaacgggttacaaggtaggcgtaaatccgaaagtccgtaggtaacgtcgtacaccggtactcgtgttacccg

SEQ ID NO: 155811 - DNA, 985 bp, Homo sapiens
  misc_feature: GYAE6OF01AZV06.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcactttctctgttgctcgtgatctcgtggtcgccgtacgggactagttcgtgtacgtcgtaccctagtcctaccacgtaccttcccgtggtcgttcggttcgtttcggtcggggacggtacgggaccgggtacccaaccgtacgttaccgtaaaccgtcggtaaccgtaaccgtacccgaacgtacccgtaaagttaaacttttacgtttttaactaacggttaccgtacccttaaacctaaaacgtaaaaacgttaaaacgttaaacgttttaacggttaacgtaccggtttaaccggttaaaccgaacgtaaccgtaaacggtaaaaccccggtaacggacccgtaaccggttaacccctttaacccggtaagtacccggttcggtaacctttaccgtttaacggttttaaccggtcgggtaccctaaaccggttaccccggttaaccccggggtaaccggtttaccccgggttacccgtaacggttacccgttaacgtttccggaacgggtcgggtaacccggtacggggttcggtaccgggttacgggtacttaaacccggtacttttacccggaaccgttacgttaccggttaaggtttaacccgttacgaccggtaccgtcccggtacggtaacgggtacgtaaccgtaagggtaccgttagtccggtacgtttacctttagtttaccttaccgtacgtacgtaactaacggttacttaacgttaacccttacccgggacccgttacccggtacggtacccgggtaaccggtaacggggtaacccgtaggggtaaccgttacggaaatttaaacccgggaaccgtttaggacgttaccggtacgttccgaccttacgttccggttaccg

SEQ ID NO: 155812 - DNA, 746 bp, Homo sapiens
  misc_feature: GYAE6OF01DAX2A.29.67.G01.1.454.CMB.1.raw
  modified_base (194)..(194): a, c, t, g, unknown or other
  misc_feature (194)..(194): n is a, c, g, or t
  modified_base (250)..(250): a, c, t, g, unknown or other
  misc_feature (250)..(250): n is a, c, g, or t
tcagatagagtactcacgaccggtgctcgatttagagtatacatagttgggtttgggggagctacaacaggcaggcaggggcagcaagatggtgttgcagacccaggtcttcatttctctgtgctctggatctctggtgccgtacggggacagtcgtgatcgacccagtctccagacctcctggctgtgttcgngggacgaggacgggccctacgatacaactgacagtccacgaccagtaattatttanattacgacctaacaaacgtaataaacgtaattacgttacgtaccttaggtaaccagaccaaagaaccgagactacgacctacgagtcgtcgacttacgtacttacggtacggacctacgtacccggtaaccccggggtaccggttcccgggtaccctacggtaccttacgtcgaacgggtcgaaccggtacggtcggggtagtacggggtacttaaggttacccttacgaacccgttataacggttaacggttacgtacgacgaccgttacgtcgggaacgtaccgtaaggtagtaaacgggttgtcgtacggtttacttaagttttaactcgttaccgaagtactaacgttaaattcgttaaccaccggttcccggtaccccggtgttaccccggaacgaaacccgggtaaggtacgggtaaagtacgggactaaacccggtaaaggttaccgttacgggtacccgttacgccggtaaaccttccaggtttaccc

SEQ ID NO: 155813 - DNA, 741 bp, Homo sapiens
  misc_feature: GYAE6OF01B56AR.29.67.G01.1.454.CMB.1.raw
  modified_base (282)..(282): a, c, t, g, unknown or other
  misc_feature (282)..(282): n is a, c, g, or t
  modified_base (355)..(355): a, c, t, g, unknown or other
  misc_feature (355)..(355): n is a, c, g, or t
tcagatagagtactcacgaccggtgctcgatttagagtatacatattggggtttgggggagctacaacaggcaggcaggggcagcaagatggtgttgcagacccaggtcttcatttctctgttgcgtctggatctctggtcgccgtacgggactagtcgttgactcggacccagtcctccgacgtacctcccgtggccttggttgtttccgtgggccgaggtacgggacccaacctataccaactcgaccaacgtccaagtacctaagtaatttattttaanaactacgacctaacaaacgtaaaagtaacgttaattacgttagtacttacggtaaccaggacaacgaaaccgnggaccacgtacctacgtagctctactaactagttacgcggtactacgtaccgaaccgggtcgttcccgggtacctacgaaccgtcttacggtacggtcggacgtacggccggttacggaacgggtactaccgttacttaccaccgtaccgtacgtacgttacgtaccgacgacggtacccgacgtacggtacggagtaacgcggttaacggtcgtcgttaccgtttaagtttgttacggaacttcggaaccttaataacgttaacttaacgtaccgttaacccgaccgggttccggacggtaaccggacggtaaccggtaggacggttaacggaactaacgggaaaccgtgggttaccgacgttacggtacacctacgtcttacgg

SEQ ID NO: 155814 - DNA, 705 bp, Homo sapiens
  misc_feature: GYAE6OF01CFOL3.29.67.G01.1.454.CMB.1.raw
  modified_base (262)..(262): a, c, t, g, unknown or other
  misc_feature (262)..(262): n is a, c, g, or t
  modified_base (350)..(350): a, c, t, g, unknown or other
  misc_feature (350)..(350): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacagtcgtgatcgacccagtctccagtacctcccgtggcttgttgtttcgtgggcgaggacggcccaacctatccaactgaccacgtccgacgaccgaataatttattttanaactagacctacaaaactaaataaacgtaactttacttagtccttacggtaccaagacaacgaaccaggacacgcctacgtaagctancctacttattcgaggtcacgtccgaccgggacgttcccgggtcctacgtacctagttccgaggttacgggcctacggggtaccgggttcggtacgggaactagttaccgttacgacctacgtacgtacgtttataccggactcggtacccgtagacggtacggtacctaagggaacggttcggttagtaccggtaacctttagttttaaccacggttgtaccgtaagttacttaaacgttatttaaccgaccttacccggtaccccggtaggtacccgttaccggaaacggtaacgtacgggtaagacgtaacaaccgaacgtaggtcgtacggacctggaaccctgtccttacg

SEQ ID NO: 155815 - DNA, 739 bp, Homo sapiens
  misc_feature: GYAE6OF01B0CFD.29.67.G01.1.454.CMB.1.raw
  modified_base (260)..(260): a, c, t, g, unknown or other
  misc_feature (260)..(260): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacagtcgtgatcgacccagtcctccagacctccctggcttgttgtttcgtgggcgaggacgggcccaccgatacaacgtcgacaacgtccacgccaagtaattattttanatacgctaccaaactaataaagtaacttacttagtcttacggtaaccagaaccgaacgaaaccgaggaccacgtcccttaccgtaaggcctacgtaccttacttaacgttttacgacgggtacctaacggttacccggtaaccccgggtaacggttccccgggtaccgtacggaaccgtagtttccgacggttgacggtacggtcggtacgtacgggtactagttacttaccaacgtacgttacgtaacggttacttacgaccgtacgtccgtagacgtacggtactaggtaacgttagtcggtactacctttaagttttactacgtacgtacgtaacgtacttaaacttacttaaccgtacccgttacccggttacccgggtacggtaccggtaaccggtaaccggtacggaacgggtcgaacggtacgtaacgaacgtacggttacgtcgggtactacgaccttaccgtgttacccg

SEQ ID NO: 155816 - DNA, 676 bp, Homo sapiens
  misc_feature: GYAE6OF01AETPY.29.67.G01.1.454.CMB.1.raw
  modified_base (265)..(265): a, c, t, g, unknown or other
  misc_feature (265)..(265): n is a, c, g, or t
  modified_base (361)..(361): a, c, t, g, unknown or other
  misc_feature (361)..(361): n is a, c, g, or t
  modified_base (650)..(650): a, c, t, g, unknown or other
  misc_feature (650)..(650): n is a, c, g, or t
  modified_base (671)..(671): a, c, t, g, unknown or other
  misc_feature (671)..(671): n is a, c, g, or t
tcagatagagtactcacgaccggtgctcgatttagagtatacatattgggtttgggggagcgtacaacaggcaggcaggggcagcaagatggtgttgcagacccaggtcttcatttctctgttgctctggatctctggtgccgtacggggactatcggtcgatcgacccagtctccagacctccctggccttggttcgtttcgtggggcgaggacgggaccaccatcaactgactaacgtcccagaccaagtaattaacttttanatacgtcctacctaaataagtaagtaattacttagtctttacggtacagtacaacgaaccgaggacacgtcctacagctgtcttactacgttacgnggactacgtacccggaaccccgggtacgtcccggggttcctacggtacccgtattccgtacgggtcgaccgtacggtacgggtcgtaggggaacctaggtactttaccactacgtacgtaagttacgttacgaccgtacgaccgtggaccggtagtaccgtaggtaaggtgttacggaccgttacctttaagtttcgtacctgtaccaacgttataacttacttacgttacccgtaccgtaccggtacgtccgacgaacgggtacagggttgacgtagaccgtaaacgngttagccggtatcgactacgnttccg

SEQ ID NO: 155817 - DNA, 867 bp, Homo sapiens
  misc_feature: GYAE6OF01CZP60.29.67.G01.1.454.CMB.1.raw
  modified_base (210)..(210): a, c, t, g, unknown or other
  misc_feature (210)..(210): n is a, c, g, or t
  modified_base (817)..(817): a, c, t, g, unknown or other
  misc_feature (817)..(817): n is a, c, g, or t
  modified_base (853)..(853): a, c, t, g, unknown or other
  misc_feature (853)..(853): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtcgccgtacgggacagtcggtgactcgaccctacgtcctccacgtaccctcccgtggtcttgttgtttcggngggacggacggacggcccaccgtactaccaaccgtcgaactaacgtcccgacggacctaaattaactttaattttaataactacgtaccctaaaccaaaataaagttaaacgttaaacttttaaccgtttaacggttcccggttttaaccggtaaccgaacgaacccgtaaaacggaaaaaccccgagggtaacccgtaccccggttaccccttaaccggtaaccgtccctaggtttaaccctcgttttaaaccgttcgggtccggtaaccgtaacccgttaacccccgggttaccccggggttaaacccgggtcccccgggttacccgtacggtaaccgtacggttcgacggtcgggacccggtacgggtcgggttaacgcggtaacgttacgttaacttccgacctacgttacggttaagtacttaacggcctacggtacccgttacgcggaaccggtagtacggtaaggttggtaccggttacgttacttttactttacgttacgttacgactaaccggttattaacgttaactttaacccgtacccgttaccccggtaccggtaccggttacccggtaccggtaacggtacgtagggtacggnttaaacgaaccgtaccgtaggtccgtacggcgtacnctaccttacgtcgg

SEQ ID NO: 155818 - DNA, 768 bp, Homo sapiens
  misc_feature: GYAE6OF01BM5JD.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctaccagacctcccgtggctgttgttcgtgggcgaggacggccaccatccaatcgacaacgtccacgaccaagtaattattttatatacgctaccaaacaataagtaattacctagtcttacggtacagacaacgaaaccgaggaccgacgtaccttaccgtaacgtacgtcgtacttaccgttagttttacggtacggtctaaccgttaccggtaacccccggggtaacggttaccccggggtccctacggacccgtagttacggacggttcggcgacgggtccggggttacggtagggtaacgtagttaaccgtttaccgaccgtaacgttacgtaacgttaacttacgacgtacggtacccgtcgacgtaacgggtacctaggaacgtagttacggtacgggtaaccctttagtttttaaccgtacttacggtaactaacgtaactaatttaaccgtttaccttaacccgttaccccggtacccggtaccgttaccgggaccgtaaccgggtaaaccggtaacggggtcgtaaacggtaacgtaaacggtaaacccgtagtacggtacggttccgtacgacctaccgttattcccg

SEQ ID NO: 155819 - DNA, 744 bp, Homo sapiens
  misc_feature: GYAE6OF01BHVLC.29.67.G01.1.454.CMB.1.raw
  modified_base (260)..(260): a, c, t, g, unknown or other
  misc_feature (260)..(260): n is a, c, g, or t
  modified_base (360)..(360): a, c, t, g, unknown or other
  misc_feature (360)..(360): n is a, c, g, or t
  modified_base (504)..(504): a, c, t, g, unknown or other
  misc_feature (504)..(504): n is a, c, g, or t
  modified_base (664)..(664): a, c, t, g, unknown or other
  misc_feature (664)..(664): n is a, c, g, or t
tcagatagagtactcacgaccggtgctcgatttagagtatacatattgtgtttgggggagctacaacaggcaggcaggggcagcaagatggtgttgcagacccaggtcttcattttctctgttgctctggactctcgtggtcgccgtacggggactatcggtgatcgacccagtcctaccagacctccctggcttgttgtttcgtgggcgagcgggccaaccatacaactgacaacgtccacgccaagtaattattttanagtacgcctacaaactaataagtaactttacgttagtacttaggaccagacaacgaaaccgagacacgacctaccgtaagctagctacttacgtttacgnggtactacgtacccggtaacccgggtacggtccccgggtacctcgtaaccgtacgttacgaggtcggacgtacgggtcggtacgtagggaactagttcttacgaaccttacgtaacgtaggttactacggacctaacgccgttnaaccggtacgtagtaacggtaaagttcgttcgggtaacccgttaatttaactttttacccgtacgtagtaacctacgtaacttaacgttaacttaccggttaaccccgtaccgggttaaccccggcggttacccggtaaccgggaagggttaaacccggngggtaaccgggaaacgttacccctaaaaggtaacccggtaaacggttcgtaccgggttaacacgtcccgtaaaccgttcg

SEQ ID NO: 155820 - DNA, 834 bp, Homo sapiens
  misc_feature: GYAE6OF01EK63S.29.67.G01.1.454.CMB.1.raw
  modified_base (216)..(216): a, c, t, g, unknown or other
  misc_feature (216)..(216): n is a, c, g, or t
tcagatagagtactcacgaccggtgctcgatttagagtatacatattgggtttgggggagctacaacaggcaggcaggggcagcaagatggtgttgcagacccaggtcttctatttctctgttgctctggatctcgtggtcgccgtacgggacatcgtgatcgacccagtctccagcctccgtgctgttgttcgtgggcgaggacgggccacctanccaactgacaacgtccaacgaccgtaataaactttatttttaataagttacgtaccctaccaaaactaaaacgttaaaacgttaaacttttaacgtttacggtacctttacggtaaccaacgaacaaacgaaaacccggtaacggaaccgtacccgtaccccttaacccgtaagtcccgttactccgttaacgtttaccgttttacgtccgggtaactaaccgttacccggtaaccccggggttaacggtcccccggggttaccctacggacccggttaacgttaccggtaaggtccgggaccggtacgggttccgggtacggggttacggggaaaccgttaacgtaccgtttaccgtaacctacgttaccggtaagtttaacgtacgtccgacgtccgtacgtcgacggtaccgtaggtaagtacgttcggtacgttactttaattacgtttatacggacgtaagtaactaatttacgttaaaccgtacccgttaccccgggtacccggtaccggtacccgaacggtaaacccgggaacgtaacggggtacggtaacgtaacggtaaaccgtaacccgggtaaggtccgtggtacccgactctaaaccgtcgttacg

SEQ ID NO: 155821 - DNA, 869 bp, Homo sapiens
  misc_feature: GYAE6OF01BYSRP.29.67.G01.1.454.CMB.1.raw
  modified_base (470)..(470): a, c, t, g, unknown or other
  misc_feature (470)..(470): n is a, c, g, or t
  modified_base (697)..(697): a, c, t, g, unknown or other
  misc_feature (697)..(697): n is a, c, g, or t
tcagatagagtactcacgaccggtgctcgatttagagtatacatagtttggggtttgggggagctacaacaggcaggcaggggcaggcaagatggtgttgcagacccaggtcttcattttctcttagttgctactggatcttcgtggtacgtaccggtaacgggctagttccgtgtacgtccggtaccctagttcctacgaacgtcccttcccgtggtccgtttaggtttcgtttcggagggacgacggaccgggacctaaccgtattaaccgaactcggaacctaacgtacccgagaccgtaagttaactttttattttaacgaacgttacgaccttaaccaaattaagtaaacggttactttacgttaacgtacgtttacggaccaagaaccgtaaacaaaccgggtacgaactaccgtacccgttaaccgtaagtccgttaccgtacttacgtttaagttaccgggngttaaccctacggtttaccccgggtaaaccgggtccgtttcccgggacctaacggttcctaacgttcggaggtcgggaccgtaacggggtcggttacgaaccggtattaaccgtttacacctacgttagtttacgtacgttacgttacgcgttactacggtagtaacgggacttaggtaaccgtaagttacggtttacgtaccgtttaactttacgttttacgttanccgttaaacgtacgttaaacgtttacgtttaacctttaacccggtacccgttaaccccgggttaccgttaccgggaccgttaaaccgggagggtaaacccggttaggacgtaaacggtactaaccggaagttacgtcggtacgggtactaggtaccctacggtttcttaccg

SEQ ID NO: 155822 - DNA, 800 bp, Homo sapiens
  misc_feature: GYAE6OF01EEEXR.29.67.G01.1.454.CMB.1.raw
  modified_base (124)..(124): a, c, t, g, unknown or other
  misc_feature (124)..(124): n is a, c, g, or t
  modified_base (153)..(153): a, c, t, g, unknown or other
  misc_feature (153)..(153): n is a, c, g, or t
  modified_base (376)..(376): a, c, t, g, unknown or other
  misc_feature (376)..(376): n is a, c, g, or t
  modified_base (495)..(495): a, c, t, g, unknown or other
  misc_feature (495)..(495): n is a, c, g, or t
tcagatagagtactcacgaccggtgctcgatttagagtatacatattgggtttgggggagctacaacaggcaggccaggggcagcaagatggtgttgcagacccaggtcttcatttctctgttnctctggattctctggtgacccgtaggganactcgtagactcgacccgtagtcctaccgagtccttcccgtggcttcgttgttttccgacgggcgacgggtaccggaccacctagtaccaaagtcgactaacgtccaagccctaagtaatttattttaagtataccgtacctaccgaaaatagtaaaagttaactttacgttgtaccgttacgacctagactaaacgaaccggagtaccacgtccccgttaanacgtcctacgtaccttcgttaacgtttcgcgggaccttaacggtccccggtaaaccgggtcccgttcccgggactacgtaacgtacttcggaacggtcgccggtaacgggccggtttanaccggaattacgttccttacccagttaccctagtaacgttacgttaacgctaccgtacgtcgaccggtaggtaacgtacgtaagttaccgcggttaccgactttttaagttacgttttacgacgttaactcgttaaacgtttattaaaccgttttaccgaacccggttaccccgttacccgggttaaccggtacccgggtaaccgttaaaccgggtaaccgggtaacgggttaaacggacgtaaacggttaacccgtaaaccggtagttaaccggcgttacggacctaccgacgttaccggttcc

SEQ ID NO: 155823 - DNA, 755 bp, Homo sapiens
  misc_feature: GYAE6OF01BGE3Y.29.67.G01.1.454.CMB.1.raw
  modified_base (194)..(194): a, c, t, g, unknown or other
  misc_feature (194)..(194): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagacctccctggctgttgttcgngggcgagagggccaccatccaactgacaagtccagccaagtaattactttatatacgtactaccaaactaataacgtaattaacgttagtacttacggtaacctacgacaacgtaaaccgaggacacgtaccctaccgtaagccgtagcctactacgtttacgtagggacctacgtacccggtaacccgggtaacgtccccggggtacctacggacccgtattacgtacggtacggctacgggtccgggtacgtacgggacctaggttacttccgaacgtacttacgaacgtttatacgccgacgtaccctcggacggtacggtaccgtagggaaacgttggttacgtacgggtaacctttaagtttacttaccggtaggttaccaacggttactaaaacgttttaaccttacgttaaacccccgtccccggttaccccgggtaaccggtccggtaaacccggtaaacgggtaaccggaaagggttccggaaagtacggttaaacccgaaaccgggttacgaccggttaacggtcccaaagtccctacgttaccgtaccgg

SEQ ID NO: 155824 - DNA, 129 bp, Homo sapiens
  misc_feature: GYAE6OF02HYAHE.29.67.G01.1.454.CMB.1.raw
  modified_base (129)..(129): a, c, t, g, unknown or other
  misc_feature (129)..(129): n is a, c, g, or t
tcagatagagtactcacgaccggtgctcgatttagagtatacatattgggtttggcacagcggccctgggctgcctggtcaaggactacttccagtactctatctgagcgggctggcaaggcgcatagn

SEQ ID NO: 155825 - DNA, 124 bp, Homo sapiens
  misc_feature: GYAE6OF02GCFFF.29.67.G01.1.454.CMB.1.raw
  modified_base (124)..(124): a, c, t, g, unknown or other
  misc_feature (124)..(124): n is a, c, g, or t
tcagatagagtactcacgaccggtgctcgatttagagtatacatattggttggcacagcggcctggctgcctggtcaaggactacttccagtactctatctgagcggctggcaaggcgcatagn

SEQ ID NO: 155826 - DNA, 130 bp, Homo sapiens; identical to SEQ ID NO: 155561
  misc_feature: GYAE6OF02HFL71.29.67.G01.1.454.CMB.1.raw
  modified_base (130)..(130): a, c, t, g, unknown or other
  misc_feature (130)..(130): n is a, c, g, or t

SEQ ID NO: 155827 - DNA, 135 bp, Homo sapiens
  misc_feature: GYAE6OF02HMVDG.29.67.G01.1.454.CMB.1.raw
tcagatagagtactcacgaccggtgctcgatttagagtatacatattgggtttgggcacagcggccctgggctgcctggtcaaggactacttccagtactctatctgagcgggctggcaaggcgcataggggggg

SEQ ID NO: 155828 - DNA, 129 bp, Homo sapiens; identical to SEQ ID NO: 155824
  misc_feature: GYAE6OF02G99JW.29.67.G01.1.454.CMB.1.raw
  modified_base (129)..(129): a, c, t, g, unknown or other
  misc_feature (129)..(129): n is a, c, g, or t

SEQ ID NO: 155829 - DNA, 130 bp, Homo sapiens; identical to SEQ ID NO: 155561
  misc_feature: GYAE6OF02GP66K.29.67.G01.1.454.CMB.1.raw
  modified_base (130)..(130): a, c, t, g, unknown or other
  misc_feature (130)..(130): n is a, c, g, or t

SEQ ID NO: 155830 - DNA, 146 bp, Homo sapiens
  misc_feature: GYAE6OF02JED2V.29.67.G01.1.454.CMB.1.raw
  modified_base (130)..(146): a, c, t, g, unknown or other
  misc_feature (130)..(146): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnnnnnnnnnnnnnn

SEQ ID NO: 155831 - DNA, 504 bp, Homo sapiens
  misc_feature: GYAE6OF02F542I.29.67.G01.1.454.CMB.1.raw
tcagatagagtactcacgaccggtgctcgatttagagtatacatattgggtttggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttatactgtcagcaatattatactactcccggacgttcgccacggaccaaggtcggagagtcaaacgaactgtggctgcaccatcg

SEQ ID NO: 155832 - DNA, 499 bp, Homo sapiens
  misc_feature: GYAE6OF02JCARP.29.67.G01.1.454.CMB.1.raw
  modified_base (237)..(237): a, c, t, g, unknown or other
  misc_feature (237)..(237): n is a, c, g, or t
tcagatagagtactcacgaccggtgctcgatttagagtatacatattgggtttggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccggaatccggggtccctgaccgattcagtggcagcgggtctgggacaggatttcacactcagtattagcagcctgcaggctgaagatgtggccatttatactgtcagcaatattatactactcccgacgttcgccaggacaggtggagatcaacgaactagtggctgcaccgatcg

SEQ ID NO: 155833 - DNA, 130 bp, Homo sapiens; identical to SEQ ID NO: 155561
  misc_feature: GYAE6OF02GVBJ4.29.67.G01.1.454.CMB.1.raw
  modified_base (130)..(130): a, c, t, g, unknown or other
  misc_feature (130)..(130): n is a, c, g, or t

SEQ ID NO: 155834 - DNA, 499 bp, Homo sapiens
  misc_feature: GYAE6OF02GB1C6.29.67.G01.1.454.CMB.1.raw
  modified_base (237)..(237): a, c, t, g, unknown or other
  misc_feature (237)..(237): n is a, c, g, or t
tcagatagagtactcacgaccggtgctcgatttagagtatacatattgggtttggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccgggtccctgaccgattcagtgacagcggtctgggacagatttcacactcagtattagcagcctgcaggctgaagatgtggccatttatactgtcagcaatattatactactcccgacgttcgccaggaccaaggtggagatcaaacgaactagtggctgcaccatcg

SEQ ID NO: 155835 - DNA, 127 bp, Homo sapiens
  misc_feature: GYAE6OF02HHOC4.29.67.G01.1.454.CMB.1.raw
  modified_base (127)..(127): a, c, t, g, unknown or other
  misc_feature (127)..(127): n is a, c, g, or t
tcagatagagtactcacgaccggtgctcgatttagagtatacatattggttggcacagcggccctgggctgcctggtcaaggactacttccagtactctatctgagcgggctggcaaggcgcatagn

SEQ ID NO: 155836 - DNA, 130 bp, Homo sapiens; identical to SEQ ID NO: 155561
  misc_feature: GYAE6OF02G9U2D.29.67.G01.1.454.CMB.1.raw
  modified_base (130)..(130): a, c, t, g, unknown or other
  misc_feature (130)..(130): n is a, c, g, or t

SEQ ID NO: 155837 - DNA, 131 bp, Homo sapiens; identical to SEQ ID NO: 155600
  misc_feature: GYAE6OF02HWBSP.29.67.G01.1.454.CMB.1.raw
  modified_base (130)..(131): a, c, t, g, unknown or other
  misc_feature (130)..(131): n is a, c, g, or t

SEQ ID NO: 155838 - DNA, 152 bp, Homo sapiens
  misc_feature: GYAE6OF02HNQJR.29.67.G01.1.454.CMB.1.raw
  modified_base (130)..(152): a, c, t, g, unknown or other
  misc_feature (130)..(152): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnnnnnnnnnnnnnnnnnnnn

SEQ ID NO: 155839 - DNA, 508 bp, Homo sapiens
  misc_feature: GYAE6OF02F4DR9.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttattactgtcagcaatattatactactcccggacgttcgccaggaccgaaggtcggagactacaacgaactgtcggcgtgcaccatcg

SEQ ID NO: 155840 - DNA, 130 bp, Homo sapiens; identical to SEQ ID NO: 155561
  misc_feature: GYAE6OF02G7RDF.29.67.G01.1.454.CMB.1.raw
  modified_base (130)..(130): a, c, t, g, unknown or other
  misc_feature (130)..(130): n is a, c, g, or t

SEQ ID NO: 155841 - DNA, 494 bp, Homo sapiens
  misc_feature: GYAE6OF02IPQRQ.29.67.G01.1.454.CMB.1.raw
  modified_base (238)..(238): a, c, t, g, unknown or other
  misc_feature (238)..(238): n is a, c, g, or t
  modified_base (406)..(406): a, c, t, g, unknown or other
  misc_feature (406)..(406): n is a, c, g, or t
  modified_base (492)..(492): a, c, t, g, unknown or other
  misc_feature (492)..(492): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactggcatctaccgggaatccgggtcctgaccgattcagtggcagcgggtctgggacagatttcacactcagtattagcagcctgcaggctgaagntgtggcctatttatactgtcagcaatattatactactcccggattcgccaggacaaggtggagatacaacgactgtggctgcaccntc

SEQ ID NO: 155842 - DNA, 508 bp, Homo sapiens
  misc_feature: GYAE6OF02F36DL.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgtagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcggtctgggacagatttcacactcagtattagcagcctgcaggctgaagatgtggccatttatactgtcagcaatattatactactcccggacgttcgccaaggaccaaggtggaagatacaaacgaacgtagtggctgcaccatctcg

SEQ ID NO: 155843 - DNA, 502 bp, Homo sapiens
  misc_feature: GYAE6OF02GVAPX.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactacctggctgtgtttctgggcgagagggccaccatcaactgcaagtccagccagaatatttatatagctccaacaataagaattacttagcttggtaccagcagaaaccaggacagcctcctaagctgctcatttactgggcatctacccgggaatccgggtcctgaccgattcagtggcagcgggtctgggacagatttcacactcagtattagcagcctgcaggctgaagatgtggcctatttattactgtcagcaattattatactactcccggacgttcgccacggaccaggtggagagtacaacgaactcgtggctgcacatc

SEQ ID NO: 155844 - DNA, 622 bp, Homo sapiens
  misc_feature: GYAE6OF02JBZ4K.29.67.G01.1.454.CMB.1.raw
  modified_base (191)..(191): a, c, t, g, unknown or other
  misc_feature (191)..(191): n is a, c, g, or t
  modified_base (236)..(236): a, c, t, g, unknown or other
  misc_feature (236)..(236): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagaggccaccatcaactgcaagtccagccagaatatttanatagctaccaacaataagaattacttagcttggtaccagcagaaaccaggacagcctctaagctgctcatttactggcatctacccgggaatccgggtcctgaccgattcagtgcagcggtctgggacagatttcacactcagtatagcagcctgcaggctagaacgatggtacggcctaagttttacttaacgtgtaccgtaggacctaaagttactttaacttaaccttaacccgttacccccggaacggtttccggtacccgtaaacggggaacccggtaaacgggttaccggggtaaacgtaacggtaacccgtaaaaccgggtaacccgttaagggttaccgggtaccgttacggtacccgtaacccgacgtttaacccgg

SEQ ID NO: 155845 - DNA, 517 bp, Homo sapiens
  misc_feature: GYAE6OF02G30XM.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttatactgtcagacaatattatactactcccggtacttcggccacgggtaccgaggtaggagacgtacaaacgtaacacgtggactggacaccatacg

SEQ ID NO: 155846 - DNA, 130 bp, Homo sapiens; identical to SEQ ID NO: 155561
  misc_feature: GYAE6OF02HDVU0.29.67.G01.1.454.CMB.1.raw
  modified_base (130)..(130): a, c, t, g, unknown or other
  misc_feature (130)..(130): n is a, c, g, or t

SEQ ID NO: 155847 - DNA, 506 bp, Homo sapiens
  misc_feature: GYAE6OF02HXMLG.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactggcatctacccgggaatccggggtcctgaccgattcagtggcagcggtctgggacagatttcacactcagtatagcagcctgcaggctgaagatgtggcctatttatactgtcagcaatattatactactcccggagttcgccacggaccaaggtggacgatacgaacgaacgtagtaggctgactaccatcg

SEQ ID NO: 155848 - DNA, 505 bp, Homo sapiens
  misc_feature: GYAE6OF02JGILQ.29.67.G01.1.454.CMB.1.raw
  modified_base (238)..(238): a, c, t, g, unknown or other
  misc_feature (238)..(238): n is a, c, g, or t
  modified_base (493)..(493): a, c, t, g, unknown or other
  misc_feature (493)..(493): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaacttcaagtccagccagaatattttanatagctccaacaataagaattacttagcttggtaccagcagaaaccaggacagcctcctaagctgctcatttactgggcatctaccgggaatccggggtcctgaccgattcagtggcagcgggtctgggacagatttcacactcagtattagcagcctgcaggctgaagatgtggccatttatactgtcagcaatattatactactcccggacgttcgcaaggtaccgaggtggagatacaacgaactagtggcngtcaccatctcg

SEQ ID NO: 155849 - DNA, 507 bp, Homo sapiens
  misc_feature: GYAE6OF02GHE29.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttattactgtcagcaatattatactactcccggacgttcgccagggaccaaggtggagatacaacgaacgtagtggctgcaccatccg

SEQ ID NO: 155850 - DNA, 504 bp, Homo sapiens
  misc_feature: GYAE6OF02F68GF.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttatactgtcagcaatattatactactcccggagttcgccaggaccgaaggtggagatacaacgaactagtggactgcaccatcg

SEQ ID NO: 155851 - DNA, 507 bp, Homo sapiens
  misc_feature: GYAE6OF02H3VJH.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaacttcaagtccagccagaatattttanatagctcaacaataagaattacttagcttggtaccagcagaaccaggacagcctctaagctgctcatttactgggcatctacccgggaatcccggggtcctgaccgattcagtggcagcgggtctgggacagatttcacactcagtattagcagcctgcaggctgaagatgtggccatttattactgtcagcaatatatactactcccggacgttcgccaaggacgaaggtggagactacgaaacgaacgtgtggctgcaccatctacg

SEQ ID NO: 155852 - DNA, 506 bp, Homo sapiens
  misc_feature: GYAE6OF02HLARL.29.67.G01.1.454.CMB.1.raw
  modified_base (274)..(274): a, c, t, g, unknown or other
  misc_feature (274)..(274): n is a, c, g, or t
tcagatagagtactcacgaccggtgctcgatttagagtatacatattgggtttgggggagctacaacaggcaggcaggggctagcaagatggtgttgcaagacccgaggtcttccatttctctgttgctctggatctctggtgccttacggggacatcggtcgatgaccctagtctccagactccctggctgtgtttctgggcgagagggccaccatcaactgcaagtccagccagaatattttatatagctccaacaataagaattacttagnttggtaccagcagaaaccaggacaggcctacgtaagctgctcattactggcatctacccggatccgggtcctcgaccgattcagtgcagcgggtctgggacagatttcacgactcagtatagcagctgcagctagagatgtgcctatttatactgtcagctaatattatactactcccggagttcgaccgacggacaggtgagataccaaacgagtacgtggctgcacatcg

SEQ ID NO: 155853 - DNA, 530 bp, Homo sapiens
  misc_feature: GYAE6OF02JA8QL.29.67.G01.1.454.CMB.1.raw
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctaccgggaatccgggtcctgaccgattcagtggcacgcgggtctgggacaggtatttcacactcagtattagcagccctgcaggctagaagatgtggcctattttactactgtcagctaattattatactacctccccggattccggaccaagggcctaaggtcggagaagtacgaaacgtacgtgtacggtcgtacncaccgtntaccg

SEQ ID NO: 155854 - DNA, 522 bp, Homo sapiens
  misc_feature: GYAE6OF02IJXQ7.29.67.G01.1.454.CMB.1.raw
tcagatagagtactcacgaccggtgctcgatttagagtatacatattggggtttgggggagctacaacagggcaggcaggggcagcaagatggtgttgcagacccaggtcttcatttctctgttgctctggatctctggtgcctacggggacatcgtgatgacccagtctccagactccctggctgttgtttctgggcgagtagggccaccatcaactgcaagtccagccagaatattttagatagctccaacaataagaattacttagcttggtaccagcagaaaccaggacagcctcctaagctgctcatttactggcatctacccgggaatccggggtccctgaccgattccagtggcagcgggtctgggacaggattttcaacactcagtattagctagcctgcagggctagaacgagtggtcggcctatttatactcgtcagacaattattatactactcccggacttcgacacggacaggtggagatacaagaacgtgtggactcgacgaccatcg

SEQ ID NO: 155855 - DNA, 533 bp, Homo sapiens
  misc_feature: GYAE6OF02GN42I.29.67.G01.1.454.CMB.1.raw
  modified_base (239)..(239): a, c, t, g, unknown or other
  misc_feature (239)..(239): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaactattttanatagctccaacaataagaattacttagcttggtaccagcagaaaccaggacagcctcctaagctgctcatttactgggcatctacccgggaatccggggtcctgaccgattcagtgcagcgggtctgggacagatttcacactcagtattagcagcctgcaggctgaagatgtgccatttatactgtcagtcaatattactaacttacctcccggtaacgttcggccgtaagggaccgtaagggtacggtaaggaactacgaaacgaactacgtaggtacctgcgaccataccg

SEQ ID NO: 155856 - DNA, 577 bp, Homo sapiens
  misc_feature: GYAE6OF02HC50O.29.67.G01.1.454.CMB.1.raw
  modified_base (269)..(269): a, c, t, g, unknown or other
  misc_feature (269)..(269): n is a, c, g, or t
  modified_base (459)..(459): a, c, t, g, unknown or other
  misc_feature (459)..(459): n is a, c, g, or t
  modified_base (491)..(491): a, c, t, g, unknown or other
  misc_feature (491)..(491): n is a, c, g, or t
tcagatagagtactcacgaccggtgctcgatttagagtatacatatttggggttttgggggggagctacaacagggcagggcagggggcagcaagatggtgtttgcagacccccagggtctttcatttttctctgtttgctctgggatctctgggtgccctacggggggacatcgtgatgaccccagtctccagactcccctggctgtgttttctggggcgaggaggggcccacccatcaactgcaagtccagccagaatattttttanatagctccaaacaaataaagaatttaacttagcttggtaccagcaagaaaaccaggacagcctcctaagctgctcatttactgggcatctaccccgggatcccggggtccctgaccgattcagtgcagcggggtctggggacaggtactttcactactcagtacttgctagcctgcgtaggctgaacgtntgtcgtcctatttatcctgtcacgtctaattnttaactctaccgtcccgtacgtcgtaccacggaccgaaggtcggacgacgttcaaacgtacgtgtcggtccgtgtacaccgtagtc

SEQ ID NO: 155857 - DNA, 131 bp, Homo sapiens; identical to SEQ ID NO: 155600
  misc_feature: GYAE6OF02GERHR.29.67.G01.1.454.CMB.1.raw
  modified_base (130)..(131): a, c, t, g, unknown or other
  misc_feature (130)..(131): n is a, c, g, or t

SEQ ID NO: 155858 - DNA, 563 bp, Homo sapiens
  misc_feature: GYAE6OF02H0Y0F.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctcaacaataagaattacttagcttggtaccagcagaaaccaggacagcctcctaagctgctcatttactggcatcctacccgggaagtccgggtccctagaccgattcagtcggcaggcggtctgggacagtattcacactcagtatagcagcctgcaggctagaacgtagtgtacggtccttaagtttatactgtccagtactaaattacttattaacctaccgtaccccggtacgttccgtaccgtaacgggaaccgtaacggtacggtaacgagtaacgaaaccggtaactcggtacggtcacggcaccctagtacg

SEQ ID NO: 155859 - DNA, 511 bp, Homo sapiens
  misc_feature: GYAE6OF02IU5YM.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactggcatctaccgggaatccgggtcctgaccgattccagtggcagcggtctgggacagtatttcacactcagtatagcagcctgcaggctagaagatgtcgcctattttactacttgtcagctaatattactactacgtcccggagttcgacgacggacgaggtggagagtacaacgactcgtacggctagctaccatcg

SEQ ID NO: 155860 - DNA, 502 bp, Homo sapiens
  misc_feature: GYAE6OF02FSNXO.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttattactgtcagcaatattatactactcccggagttcgcaggaccaaggtggagatacaacgaacgtagtggctgcaccatc

SEQ ID NO: 155861 - DNA, 559 bp, Homo sapiens
  misc_feature: GYAE6OF02HYPKC.29.67.G01.1.454.CMB.1.raw
  modified_base (364)..(364): a, c, t, g, unknown or other
  misc_feature (364)..(364): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaccaggacagcctcctaagctgctcatttactgggcatctacccgggaatccggggtccctgaccgatcagtggcaggcggtcngggacagatttcacactcagtattagcagcctgcgaggctagaagagtgtggcctaatttacttactgtcagctaattattactacttaccgtcccggacgttcggaccgtaacgggaccgaacgggtacggaacggtaactaacgaaacggtaacgtacggtacggtaccgtacggtaccgtaccgtattaccg

SEQ ID NO: 155862 - DNA, 494 bp, Homo sapiens
  misc_feature: GYAE6OF02GFZNE.29.67.G01.1.454.CMB.1.raw
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactggcatctacccgggaatccgggtccctgaccgattcagtggcagcggtctgggacagatttcacactcagtattagcagcctgcaggctgaagntgtggccatttattactgtcagcaattattatactactcccgagtcgcaggacaggtgaganacaacgacgtgtcggctgcacatcg

SEQ ID NO: 155863 - DNA, 492 bp, Homo sapiens
  misc_feature: GYAE6OF02I1OV8.29.67.G01.1.454.CMB.1.raw
  modified_base (237)..(237): a, c, t, g, unknown or other
  misc_feature (237)..(237): n is a, c, g, or t
  modified_base (489)..(489): a, c, t, g, unknown or other
  misc_feature (489)..(489): n is a, c, g, or t
tcagatagagtactcacgaccggtgctcgatttagagtatacatattgggtttggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaatacttagcttggtaccagcagaaaccaggacagcctcctaagctgctcatttactggcatctacccgggaatccggggtcctgaccgattcagtggcagcgggtctgggacagatttcacactcagtatagcagcctgcagctgaagatgtggctaatttatactgtcagcaatattatacttactcccgtagtcgccaggccaaggtggagatacaacgactgtgctgcacntcg

SEQ ID NO: 155864 - DNA, 506 bp, Homo sapiens
  misc_feature: GYAE6OF02FRCEP.29.67.G01.1.454.CMB.1.raw
  modified_base (410)..(410): a, c, t, g, unknown or other
  misc_feature (410)..(410): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagntgtgccattttatactgtcagcaatattatactactcccggagttcgccaggaccgaaggtggagagtacaacgaacgtcgtggctgcaccatccg

SEQ ID NO: 155865 - DNA, 507 bp, Homo sapiens
  misc_feature: GYAE6OF02ISYNC.29.67.G01.1.454.CMB.1.raw
  modified_base (406)..(406): a, c, t, g, unknown or other
  misc_feature (406)..(406): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctaccggaatccgggtccctgaccgattcagtggcagcggtctgggacagatttcacactcagtattagcagctgcaggctagaagntgtgcctatttatactgtcagcaatattatactactcccgagtccgcacggacgacggtaggacgatacgaacgacgtagtcggactcggcaccgtatacg

SEQ ID NO: 155866 - DNA, 510 bp, Homo sapiens
  misc_feature: GYAE6OF02H8GL8.29.67.G01.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (507)..(507): a, c, t, g, unknown or other
  misc_feature (507)..(507): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccagacagcctctaagctgctcatttacngggcatctaacccgggatccgggtccctgaccgattcagtggcagcgggtctagggacagtatttcacactcagttattagcagcctgcaggctagaagatgtgcctatttatactgtcagcaattattatactaccgtcccggtacgttcgaccaggaccgaaggtggaagagtacaacgatagcgctagcaccntcg

SEQ ID NO: 155867 - DNA, 519 bp, Homo sapiens
  misc_feature: GYAE6OF02G8E9T.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatcctacccgggaatccggggtccctgaccgattcagtggcaggcgggtctgggacagtatttcacactcagtattagcagcctgcaggctgaagatgtggcctaattttatactgtcagctaatattatactaccgtcccgagttcgcgaggagcgaaggtaggagtagtacgaaacgacgtgtggacgtcgacgactacg

SEQ ID NO: 155868 - DNA, 130 bp, Homo sapiens; identical to SEQ ID NO: 155561
  misc_feature: GYAE6OF02GJAHE.29.67.G01.1.454.CMB.1.raw
  modified_base (130)..(130): a, c, t, g, unknown or other
  misc_feature (130)..(130): n is a, c, g, or t

SEQ ID NO: 155869 - DNA, 540 bp, Homo sapiens
  misc_feature: GYAE6OF02GK0Y6.29.67.G01.1.454.CMB.1.raw
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccactatcaactgcaagtccagccagaatattttatatagctccaacaataagaattacttagcttggtaccagcagaaaccaggacagcctcctaagctgctcatttacngggcatctacccggaatccgggtccctgaccgattcagtggcagcgggtctgggacagtactttcacactcagtatagcagcctgcaggctgaagntgtgcctatttatactgtcagctaattattactacttaccgtccccggacgttccggaccaacgggtaccgaacgggtaggacggacgtacgtaaacgtacgtacggtcggtacgtcgacctaccgatccg

SEQ ID NO: 155870 - DNA, 131 bp, Homo sapiens; identical to SEQ ID NO: 155600
  misc_feature: GYAE6OF02IEIGA.29.67.G01.1.454.CMB.1.raw
  modified_base (130)..(131): a, c, t, g, unknown or other
  misc_feature (130)..(131): n is a, c, g, or t

SEQ ID NO: 155871 - DNA, 729 bp, Homo sapiens
  misc_feature: GYAE6OF02HGYA1.29.67.G01.1.454.CMB.1.raw
  modified_base (243)..(243): a, c, t, g, unknown or other
  misc_feature (243)..(243): n is a, c, g, or t
  modified_base (329)..(329): a, c, t, g, unknown or other
  misc_feature (329)..(329): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgactgaccccagtctccagactccctggctgtgtttctgggcgagacggccaccatcaactgacaagtaccagccagaatattttanatagctaccaaacaataagaattacttagcttaggtaccagtacaagaaaccaggacacgcctacctaagctgcctctatttacgnggcagtccgtaccggaacgtccggggtcctggaccgattacgaggtacggacacggtcgggtctcggggaactaggtactttccaacgtactacgaagtttacgttacggactacgtcccttgaccgtaggtacgttaggaaaggtagtttacggtacggttacccgttaaagttttttaaccgtaaccggtttcggtacctaacggttaccgtaaaagttttaacgttaactttaacccgtttaacccggttacccccgggtaacggtttacccgggtacccgggtaaaccggggtaaccggttaaacggggttaacgggtaacggaacgttaaccgaaaaccggtaacgttacggttaacgggtaccgttaccggaccgtaacccgtacgttacccgg

SEQ ID NO: 155872 - DNA, 524 bp, Homo sapiens
  misc_feature: GYAE6OF02GKJIW.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctaccaagctgctcatttactgggcatctacccggaatccggggtccctgaccgattcagtggcagcgggtctgggacagatttcacactcagtattagcagcctgcaggctgaagatgtgcctatttattactgtcagtctaatattatactactcccggtacgtcgtccacggaccgaacggtggtagacgtacgtaacgaacgtagtcggtacgtagcgtaccattacg

SEQ ID NO: 155873 - DNA, 494 bp, Homo sapiens
  misc_feature: GYAE6OF02H53FV.29.67.G01.1.454.CMB.1.raw
  modified_base (312)..(312): a, c, t, g, unknown or other
  misc_feature (312)..(312): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (492)..(492): a, c, t, g, unknown or other
  misc_feature (492)..(492): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccagacagcctcctaagctgctcatttacnggcatctacccgggatccgggtcctgaccgattcagtgcagcgggtctgggacagatttcacactcagtattacgcagcctgcaggctgaagatgtggacctatttatactgtcagctaattattatacctactcccggtagtcgcacggacaggtgagntacaacgagtgngctgcacntc

SEQ ID NO: 155874 - DNA, 499 bp, Homo sapiens
  misc_feature: GYAE6OF02GDU65.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccgggtcctgaccgattcagtgcagcggtctgggacagatttcacactcagtatagcagcctgcaggctgaagatgtggcctatttatactgtcagcaatatatactactcccgactcgccaggaccaaggtgagactacgaacgacgtacgtggctgcaccataccg

SEQ ID NO: 155875 - DNA, 508 bp, Homo sapiens
  misc_feature: GYAE6OF02FMLUL.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaccaggacagcctcctaagctgctcatttactgggcatctacccgggatccggggtccctgaccgattcagtggcagcgggtctgggacagatttcacactcagtattagcagcctgcaggctgaagatgtggcctatttattactgtcagcaatattatactactcccgacgttcgccgaggacgaagggtgagaatacgaaacgaactggtcggctgctaccatcg

SEQ ID NO: 155876 - DNA, 492 bp, Homo sapiens
  misc_feature: GYAE6OF02F9VAZ.29.67.G01.1.454.CMB.1.raw
  modified_base (238)..(238): a, c, t, g, unknown or other
  misc_feature (238)..(238): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (483)..(484): a, c, t, g, unknown or other
  misc_feature (483)..(484): n is a, c, g, or t
  modified_base (489)..(489): a, c, t, g, unknown or other
  misc_feature (489)..(489): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggcctatttattactgttcagcaatatatactactcccgatcgcaggacaggtgagananaacgangtgnngcacntcg

SEQ ID NO: 155877 - DNA, 512 bp, Homo sapiens
  misc_feature: GYAE6OF02GYGHP.29.67.G01.1.454.CMB.1.raw
  modified_base (411)..(411): a, c, t, g, unknown or other
  misc_feature (411)..(411): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatcctacccgggaatccggggtccctgaccgattcagtggcagcgggtctgggacagatttcacactcagtattagcagcctgcaggctgaagntgtgcctatttactactgtcagtcaatattatactaccgtcccggacgttcggaccaggaccgaaggtggagagtacaacgaacgtgtcgctgcaccatcg

SEQ ID NO: 155878 - DNA, 534 bp, Homo sapiens
  misc_feature: GYAE6OF02JAGVG.29.67.G01.1.454.CMB.1.raw
  modified_base (237)..(237): a, c, t, g, unknown or other
  misc_feature (237)..(237): n is a, c, g, or t
  modified_base (304)..(304): a, c, t, g, unknown or other
  misc_feature (304)..(304): n is a, c, g, or t
  modified_base (380)..(380): a, c, t, g, unknown or other
  misc_feature (380)..(380): n is a, c, g, or t
  modified_base (529)..(529): a, c, t, g, unknown or other
  misc_feature (529)..(529): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatatttanatagctccaacaataagaatacttagcttggtaccagcagaaaccaggacagcctcctaagctgctnatttactggacatctacccgggaatccggggtcctcgaccgattcagtgcagcggtctgggacagtattcacactnagtatagcagcctgcaggctagaagatggtcggcctaattttactactgtcagctaaattattaactacttaaccgtccccggtagttaccgccgaacggtaccgaagggtggacgatacgaacgaacgtcggtagacgtcgacaaccntaccg

SEQ ID NO: 155879 - DNA, 716 bp, Homo sapiens
  misc_feature: GYAE6OF02G9AL4.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagaggccaccatcaactgcaagtccagccagaattattttanatagcctaccaacaataagaattacttaagcttacggtaccagacagaaaccaggacacgacctcctaagctgcctcatttactggacatccgtaacccgggatcccggggtccctagacccgattcaggtcgcacggcggtcgtgggacaggtactttcgaacctactacgtagttaacttaggccaacgtcccgtaggaccgagggtaccgtaaggaaaggtacgtttcgggtacgggtacccttaaagtttttaacttaaccgtttacggtaccgtaacggtaaccttaaagtttaactttaaccgttaaccccgtttaaccccggttaccccccggtaaccgggtttaccggtaaccccgggtaacggggtaaccccggtaacggggttacgggtaacggttaaccgtaaccgtaaaaccggtaaccgttacgggttacggtaccggtaccgtaccgacccgttagttaacccg

SEQ ID NO: 155880 - DNA, 532 bp, Homo sapiens
  misc_feature: GYAE6OF02JHNWL.29.67.G01.1.454.CMB.1.raw
  modified_base (318)..(318): a, c, t, g, unknown or other
  misc_feature (318)..(318): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagacttggtaccagacagaaaccaggacacgacctacctaagctgctcatttacnggcatcgtacccggatccggggtcctagaccgattcgagtcggcaggtcggtcgtgggacagtactttcactactacgagttactagacgagtccgtgacaggtctagaagtagtgtcggactatttactctgtcagactatattatactacctcccgagtcgacacggacgaggtcgagacacgaacgaacgtgtcgcgtacgactacgatcg

SEQ ID NO: 155881 - DNA, 130 bp, Homo sapiens; identical to SEQ ID NO: 155561
  misc_feature: GYAE6OF02GK17C.29.67.G01.1.454.CMB.1.raw
  modified_base (130)..(130): a, c, t, g, unknown or other
  misc_feature (130)..(130): n is a, c, g, or t

SEQ ID NO: 155882 - DNA, 501 bp, Homo sapiens
  misc_feature: GYAE6OF02INCCZ.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgcgatgacccagtctccagactccctggctgtgtttctgggcgagagggccaccatcaactgcaagtccagccagaatattttatatagctccaacaataagaattacttagcttggtaccagcagaaccaggacagcctcctaagctgctcatttactgggcatctacccgggaatccgggtcctgaccgattcagtgcagcggtctgggacagatttcacactcagtattagcagcctgcaggctgaagatgtggcctatttatactgtcagcaatattatactacgtcccgagtcgacgacggacaggtggagatacaacgaacgtgtcggctggacaccgatcg

SEQ ID NO: 155883 - DNA, 511 bp, Homo sapiens
  misc_feature: GYAE6OF02IL697.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggcctatttatactgtcagcaatattatactacctcccggacgttcgaccacggaccaacggtggagactacaaacgacgtgtggctacgcaccatcg

SEQ ID NO: 155884 - DNA, 513 bp, Homo sapiens
  misc_feature: GYAE6OF02FX2UC.29.67.G01.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttacnggcatctacccgggaatccgggtccctgaccgatcagtggcagcgggtctgggacagatttcanactcatattagcagcctgcagctgaagatgtgcctagtttattactgtcagactaattattatactacctcccggacgttcgcgaggacgaaggtggaagactacgaaacgacgtgtcggactcgacaccatacg

SEQ ID NO: 155885 - DNA, 547 bp, Homo sapiens
  misc_feature: GYAE6OF02IZVOO.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcaagaaaccaggacagcctcctaagctgctcatttactgggcatcctaaccgggaatccgggtcctgaccgattcagtggcagcggtctgggacagtatttcacgactcgaagtatagcacgctgacaggctagaagtatgtagcctatttatactgtcagactaattattaatacttaccgcccgtacgttcggaccacggaaccgtaaggtacggtaagacgtaacgaaacgtaacgtacggtacggcgtacgacgtaccagttaccg
